United States Patent
Bothmer et al.

(10) Patent No.: US 12,157,898 B2
(45) Date of Patent: *Dec. 3, 2024

(54) METHODS AND COMPOSITIONS FOR MODULATING A GENOME

(71) Applicant: Flagship Pioneering Innovations VI, LLC, Cambridge, MA (US)

(72) Inventors: Anne Helen Bothmer, Cambridge, MA (US); Cecilia Giovanna Silvia Cotta-Ramusino, Cambridge, MA (US); William Edward Salomon, West Roxbury, MA (US); Jacob Rosenblum Rubens, Cambridge, MA (US); Robert James Citorik, Somerville, MA (US); Zi Jun Wang, Arlington, MA (US); Kyusik Kim, Worcester, MA (US); Randi Michelle Kotlar, Arlington, MA (US); Ananya Ray, Melrose, MA (US); Robert Charles Altshuler, Newton, MA (US); Sandeep Kumar, Newton, MA (US); Nathaniel Roquet, Philadelphia, PA (US); Barrett Ethan Steinberg, Somerville, MA (US)

(73) Assignee: Flagship Pioneering Innovations VI, LLC, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/355,017

(22) Filed: Jul. 19, 2023

(65) Prior Publication Data
US 2024/0035049 A1 Feb. 1, 2024

Related U.S. Application Data

(63) Continuation of application No. 17/929,116, filed on Sep. 1, 2022, which is a continuation of application No. PCT/US2021/020948, filed on Mar. 4, 2021.

(60) Provisional application No. 63/067,828, filed on Aug. 19, 2020, provisional application No. 63/035,627, filed on Jun. 5, 2020, provisional application No. 62/985,285, filed on Mar. 4, 2020.

(51) Int. Cl.
C12N 15/90 (2006.01)
C12N 9/22 (2006.01)
C12N 15/11 (2006.01)
C12N 15/88 (2006.01)

(52) U.S. Cl.
CPC ............ *C12N 15/907* (2013.01); *C12N 9/22* (2013.01); *C12N 15/11* (2013.01); *C12N 15/88* (2013.01); *C12N 2310/20* (2017.05); *C12N 2310/321* (2013.01); *C12N 2800/80* (2013.01)

(58) Field of Classification Search
None
See application file for complete search history.

(56) References Cited

U.S. PATENT DOCUMENTS

| | | |
|---|---|---|
| 4,797,368 A | 1/1989 | Carter et al. |
| 5,173,414 A | 12/1992 | Lebkowski et al. |
| 5,789,538 A | 8/1998 | Rebar et al. |
| 5,846,946 A | 12/1998 | Huebner et al. |
| 5,925,523 A | 7/1999 | Dove et al. |
| 6,007,988 A | 12/1999 | Choo et al. |
| 6,013,453 A | 1/2000 | Choo et al. |
| 6,140,466 A | 10/2000 | Barbas, III et al. |
| 6,200,759 B1 | 3/2001 | Dove et al. |
| 6,242,568 B1 | 6/2001 | Barbas, III et al. |
| 6,410,248 B1 | 6/2002 | Greisman et al. |
| 6,453,242 B1 | 9/2002 | Eisenberg et al. |
| 6,503,717 B2 | 1/2003 | Case et al. |
| 6,534,261 B1 | 3/2003 | Cox, III et al. |
| 6,599,692 B1 | 7/2003 | Case et al. |
| 6,689,558 B2 | 2/2004 | Case |
| 6,693,086 B1 | 2/2004 | Dow et al. |
| 6,794,136 B1 | 9/2004 | Eisenberg et al. |
| 7,030,215 B2 | 4/2006 | Liu et al. |
| 7,067,317 B2 | 6/2006 | Rebar et al. |
| 7,070,934 B2 | 7/2006 | Cox, III et al. |
| 7,070,941 B2 | 7/2006 | Zhao et al. |
| 7,169,874 B2 | 1/2007 | Salamone et al. |
| 7,253,273 B2 | 8/2007 | Collingwood |
| 7,262,054 B2 | 8/2007 | Jamieson et al. |
| 7,361,635 B2 | 4/2008 | Miller et al. |
| 7,375,234 B2 | 5/2008 | Sharpless et al. |

(Continued)

FOREIGN PATENT DOCUMENTS

| | | |
|---|---|---|
| GB | 2338237 B | 2/2001 |
| WO | 9324641 A2 | 12/1993 |

(Continued)

OTHER PUBLICATIONS

Lathe et al., "A single lineage of r2 retrotransposable elements is an active, evolutionarily stable component of the Drosophila rDNA locus," Molecular Biology and Evolution (1997) vol. 14, No. 12, pp. 1232-1241.

Laxa et al., "The 5'UTR Intron of Arabidopsis GGT1 Aminotransferase Enhances Promoter Activity by Recruiting RNA Polymerase II," Plant Physiology (2016) 172:313-327.

Lecuyer et al., "Mutants of the Bacteriophage MS2 Coat Protein That Alter Its Cooperative Binding to RNA," Biochemistry-us (1995) vol. 34, No. 33, pp. 10600-10606.

(Continued)

*Primary Examiner* — Nancy J Leith
(74) *Attorney, Agent, or Firm* — K&L Gates LLP

(57) ABSTRACT

Methods and compositions for modulating a target genome are disclosed. This disclosure relates to novel compositions, systems and methods for altering a genome at one or more locations in a host cell, tissue or subject, in vivo or in vitro. In particular, the invention features compositions, systems and methods for inserting, altering, or deleting sequences of interest in a host genome.

17 Claims, 52 Drawing Sheets

Specification includes a Sequence Listing.

(56) References Cited

U.S. PATENT DOCUMENTS

| | | | |
|---|---|---|---|
| 8,158,601 B2 | 4/2012 | Chen et al. | |
| 8,168,775 B2 | 5/2012 | Sah et al. | |
| 8,394,604 B2 | 3/2013 | Liu et al. | |
| 8,404,658 B2 | 3/2013 | Hajjar et al. | |
| 8,454,972 B2 | 6/2013 | Nabel et al. | |
| 9,267,932 B2 | 2/2016 | Boeke et al. | |
| 10,300,146 B2 | 5/2019 | Gao et al. | |
| 11,447,770 B1* | 9/2022 | Liu | C12Y 301/00 |
| 2005/0064474 A1 | 3/2005 | Urnov et al. | |
| 2005/0267061 A1 | 12/2005 | Martin | |
| 2007/0218528 A1 | 9/2007 | Miller | |
| 2009/0162834 A1 | 6/2009 | Fishman | |
| 2011/0214199 A1 | 9/2011 | Coffin | |
| 2012/0164205 A1 | 6/2012 | Baum et al. | |
| 2013/0046084 A1 | 2/2013 | Brown et al. | |
| 2014/0011375 A1 | 1/2014 | Lin | |
| 2015/0344549 A1 | 12/2015 | Muir et al. | |
| 2016/0102322 A1 | 4/2016 | Ravinder et al. | |
| 2018/0028664 A1 | 2/2018 | Besin et al. | |
| 2018/0127780 A1 | 5/2018 | Liu et al. | |
| 2018/0346890 A1 | 12/2018 | Lambowitz et al. | |
| 2019/0078066 A1 | 3/2019 | Wang | |
| 2019/0169639 A1 | 6/2019 | Zhang et al. | |
| 2019/0177735 A1 | 6/2019 | Sederoff et al. | |
| 2019/0225963 A1 | 7/2019 | Khalili et al. | |
| 2019/0255106 A1 | 8/2019 | Lande et al. | |
| 2019/0310251 A1 | 10/2019 | Tovey et al. | |
| 2019/0316121 A1 | 10/2019 | Smith et al. | |
| 2019/0322992 A1 | 10/2019 | Liu et al. | |
| 2020/0109398 A1 | 4/2020 | Rubens et al. | |
| 2020/0385720 A1 | 12/2020 | Cohnen et al. | |
| 2021/0077594 A1 | 3/2021 | In et al. | |
| 2022/0396813 A1 | 12/2022 | Feala et al. | |
| 2023/0131847 A1 | 4/2023 | Rubens et al. | |
| 2023/0235358 A1 | 7/2023 | Citorik et al. | |
| 2023/0242899 A1 | 8/2023 | Steinberg et al. | |
| 2023/0272430 A1* | 8/2023 | Bothmer | C12N 15/907 435/462 |
| 2023/0332184 A1 | 10/2023 | Rubens et al. | |
| 2023/0348939 A1 | 11/2023 | Bothmer et al. | |
| 2024/0002822 A1 | 1/2024 | Altshuler et al. | |
| 2024/0002886 A1 | 1/2024 | Altshuler et al. | |
| 2024/0018551 A1 | 1/2024 | Altshuler et al. | |
| 2024/0026324 A1 | 1/2024 | Altshuler et al. | |
| 2024/0042058 A1 | 2/2024 | Citorik et al. | |
| 2024/0076638 A1 | 3/2024 | Altshuler et al. | |
| 2024/0076698 A1 | 3/2024 | Cleaver et al. | |
| 2024/0082429 A1 | 3/2024 | Altshuler et al. | |
| 2024/0084333 A1 | 3/2024 | Cleaver et al. | |
| 2024/0084334 A1 | 3/2024 | Altshuler et al. | |
| 2024/0093186 A1 | 3/2024 | Altshuler et al. | |

FOREIGN PATENT DOCUMENTS

| | | |
|---|---|---|
| WO | 9837186 A1 | 8/1998 |
| WO | 9853057 A1 | 11/1998 |
| WO | 0027878 A1 | 5/2000 |
| WO | 2001018048 A2 | 3/2001 |
| WO | 0188197 A2 | 11/2001 |
| WO | 2001092501 A1 | 12/2001 |
| WO | 02077227 A2 | 10/2002 |
| WO | 2006008074 A1 | 1/2006 |
| WO | 2010086626 A1 | 8/2010 |
| WO | 2011064750 A1 | 6/2011 |
| WO | 2012123430 A1 | 9/2012 |
| WO | 2014004336 A2 | 1/2014 |
| WO | 2014136086 A1 | 9/2014 |
| WO | 2014150624 A1 | 9/2014 |
| WO | 2015095340 A1 | 6/2015 |
| WO | 2017099823 A1 | 6/2017 |
| WO | 2017132580 A2 | 8/2017 |
| WO | 2017173054 A1 | 10/2017 |
| WO | 2018002812 A1 | 1/2018 |
| WO | 2018071663 A1 | 4/2018 |
| WO | 2018081535 A2 | 5/2018 |
| WO | 2018089860 A1 | 5/2018 |
| WO | 2018106727 A1 | 6/2018 |
| WO | 2018170184 A1 | 9/2018 |
| WO | 2019005955 A1 | 1/2019 |
| WO | 2019040650 A1 | 2/2019 |
| WO | 2019067910 A1 | 4/2019 |
| WO | 2019067992 A1 | 4/2019 |
| WO | 2019070843 A1 | 4/2019 |
| WO | 2019113310 A1 | 6/2019 |
| WO | 2019123014 A1 | 6/2019 |
| WO | 2019169233 A1 | 9/2019 |
| WO | 2019178428 A1 | 9/2019 |
| WO | 2019186348 A1 | 10/2019 |
| WO | 2020014209 A1 | 1/2020 |
| WO | 2020033083 A1 | 2/2020 |
| WO | 2020051561 A1 | 3/2020 |
| WO | 2020112908 A2 | 6/2020 |
| WO | 2020160514 A1 | 8/2020 |
| WO | 2020191153 A9 | 9/2020 |
| WO | 2020191233 A1 | 9/2020 |
| WO | 2020191242 A1 | 9/2020 |
| WO | 2020191248 A1 | 9/2020 |
| WO | 2020191249 A1 | 9/2020 |
| WO | 2020252361 A1 | 12/2020 |
| WO | 2021042047 A1 | 3/2021 |
| WO | 2021062410 A2 | 4/2021 |
| WO | 2021080922 A1 | 4/2021 |
| WO | 2021133261 A1 | 7/2021 |
| WO | 2021138469 A1 | 7/2021 |
| WO | 2021188840 A1 | 9/2021 |
| WO | 2021204877 A2 | 10/2021 |
| WO | 2021226558 A1 | 11/2021 |
| WO | 2022129438 A1 | 6/2022 |
| WO | 2022150790 A2 | 7/2022 |
| WO | 2022155055 A1 | 7/2022 |
| WO | 2022155532 A1 | 7/2022 |
| WO | 2022170058 A1 | 8/2022 |
| WO | 2022173830 A1 | 8/2022 |
| WO | 2022212926 A1 | 10/2022 |

OTHER PUBLICATIONS

Lee et al., "Adenovirus-Mediated Gene Delivery: Potential Applications for Gene and Cell-Based Therapies in the New Era of Personalized Medicine," Genes & Diseases (2017) 4(2):43-63.

Lee et al., "Directed evolution of CRISPR-Cas9 to increase its specificity," Nat Commun (2018) vol. 9, No. 1, pp. 3048.

Leenay et al., "Identifying and Visualizing Functional PAM Diversity across CRISPR-Cas Systems," Mol Cell (2016) vol. 62, No. 1, pp. 137-147.

Lemaitre et al., "DSB (Im)mobility and DNA Repair Compartmentalization in Mammalian Cells," J Mol Biol (2015) vol. 427, No. 3, pp. 652-658.

Letunic et al., "20 years of the SMART protein domain annotation resource," Nucleic Acids Res (2017) vol. 46, No. Database issue, pp. gkx922-.

Li et al., "Enhanced Tropism of Species B1 Adenoviral-Based Vectors for Primary Human Airway Epithelial Cells, " Mol Ther Methods Clin Dev (2019)14:228-236.

Li et al., "Expression of the SM22alpha promoter in transgenic mice provides evidence for distinct transcriptional regulatory programs in vascular and visceral smooth muscle cells," J. Cell Biol. (1996) 132, 849-859.

Li et al., "Production and characterization of novel recombinant adeno-associated virus replicative-form genomes: a eukaryotic source of DNA for gene transfer," PLoS One (2013) 8(8):e69879, 14 pages.

Li et al.,"A Review of the Structure, Preparation, and Application of NLCs, PNPs, and PLNs," Nanomaterials 7, 122, 2017.

Li et al.,"Easy-Prime: a machine learning-based prime editor design tool," Genome Biol (Aug. 19, 2021) vol. 22, No. 1, pp. 235.

Li et al.,"Effects of Chemically Modified Messenger RNA on Protein Expression," Bioconjugate Chem (2016) vol. 27, No. 3, pp. 849-853.

Li et al.,"piggyBac transposase tools for genome engineering," Proc National Acad Sci (2013) vol. 110, No. 25, pp. E2279-E2287.

(56) References Cited

OTHER PUBLICATIONS

Lim et al., "Mixed tailing by TENT4A and TENT4B shields mRNA from rapid deadenylation," Science (2018) 361:701-704.
Lin et al., "The splicing factor SC35 has an active role in transcriptional elongation," Nature Structural and Molecular Biology (2008) 15:819-826.
Lin et al., "High-efficiency prime editing with optimized, paired pegRNAs in plants," Nat Biotechnol (Mar. 25, 2021) vol. 39, No. 8, pp. 923-927.
Lin et al.,"Modeling a cataract disorder in mice with prime editing," Mol Ther—Nucleic Acids (Jul. 1, 2021) vol. 25, No., pp. 494-501.
Linn et al., "Conservation of an AE3 CI-/HCO3-exchanger cardiac-specific exon and promoter region and AE3 mRNA expression patterns in murine and human hearts," Circ. Res. (1995) 6(4):584-591.
Lisowski et al., "Selection and evaluation of clinically relevant AAV variants in a xenograft liver model," Nature (2014) 506:382-386.
Liu et al. "CMV enhancer/human PDGF-beta promoter for neuron-specific transgene expression," Gene Therapy (2004) 11:52-60.
Liu et al.,"Efficient generation of mouse models with the prime editing system," Cell Discov (2020) vol. 6, No. 1, pp. 27.
Liu et al.,"Enhancing prime editing by Csy4-mediated processing of pegRNA," Cell Res (Jun. 8, 2021) vol. 31, No. 10, pp. 1134-1136.
Liu et al.,"Flap Endonuclease 1: A Central Component of DNA Metabolism," Annu Rev Biochem (2004) vol. 73, No. 1, pp. 589-615.
Liu et al.,"Improved prime editors enable pathogenic allele correction and cancer modelling in adult mice," Nat Commun (Apr. 9, 2021) vol. 12, No. 1, pp. 2121.
Liu et al.,"Synthetic chimeric nucleases function for efficient genome editing," Nat Commun (2019) vol. 10, No. 1, pp. 5524.
Llewellyn et al., "Orderly recruitment of motor units under optical control in vivo," Nat. Med. (2010) 16(10):1161-1166.
Lopez et al.,"Improved architectures for flexible DNA production using retrons across kingdoms of life," (Mar. 26, 2021) vol. , No. , pp.
Lu and Cullen, "Analysis of the stimulatory effect of splicing on mRNA production and utilization in mammalian cells," RNA (2003) 9:618-630.
Lu et al., "CDD/SPARCLE: the conserved domain database in 2020," Nucleic Acids Res (2020) 48:D265-268.
Lu et al., "Development of therapeutic antibodies for the treatment of diseases," J Biomed Sci (2020) 27, Article 1, 30 pages.
Luan et al.,"RNA Template Requirements for Target DNA-Primed Reverse Transcription by the R2 Retrotransposable Element," Mol Cell Biol (1995) vol. 15, No. 7, pp. 3882-3891.
Ma et al., "Enhancing site-specific DNA integration by a Cas9 nuclease fused with a DNA donor-binding domain," Nucleic Acids Res (2020) vol. 48, No. 18, pp. gkaa779-.
MacKay et al., "The therapeutic landscape for cells engineered with chimeric antigen receptors," Nat Biotechnol (2020) 38:233-244.
Mahbub et al., "Globular domain structure and function of restriction-like-endonuclease LINEs-similarities to eukaryotic splicing factor Prp8," Mobile DNA (2017) vol. 8, Article 16, 15 pages.
Maita et al., "Crystal Structure of the Endonuclease Domain Encoded by the Telomere-specific Long Interspersed Nuclear Element, TRAS1," Journal of Biological Chemistry (2004) vol. 279, No. 39, pp. 41607-41076.
Maji, B. et al. A high-throughput platform to identify small molecule inhibitors of CRISPR-Cas9, Cell (2019) 177 (4):1067-1079.
Makarova et al., "Evolutionary classification of CRISPR-Cas systems: a burst of class 2 and derived variants," Nat Rev Microbiol (2020) vol. 18, No. 2, pp. 67-83.
Malik et al.,"Ribonuclease H evolution in retrotransposable elements," Cytogenet Genome Res (2005) vol. 110, No. 44930, pp. 392-401.
Mannironi et al., "H2A.X. a histone isoprotein with a conserved C-terminal sequence, is encoded by a novel mRNA with both DNA replication type and polyA 3' processing signals," Nucleic Acid Research (1989) 17:9113-9126.

Maresca et al., "Obligate Ligation-Gated Recombination (ObLiGaRe): Custom-designed nuclease-mediated targeted integration through nonhomologous end joining," Genome Res (2013) vol. 23, No. 3, pp. 539-546.
Mason et al.. "Regulation of leptin promoter function by Sp1, C/EBP, and a novel factor," Endocrinol (1998) 139 (3):1013-22.
Mastroianni et al., "Group II Intron-Based Gene Targeting Reactions in Eukaryotes," Plos One (2008) vol. 3, No. 9, pp. e3121.
Matsuura et al.,"A bacterial group II intron encoding reverse transcriptase, maturase, and DNA endonuclease activities: Biochemical demonstration of maturase activity and insertion of new genetic information within the intron," Genes & Development (1997) vol. 11, pp. 2910-2924.
Mayford et al., "The 3'-untranslated region of CaMKII alpha is a cis-acting signal for the localization and translation of mRNA in dendrites," Proc. Natl. Acad. Sci. USA (1996) 93(23):13250-13255.
Mazina et al.,"Rad52 Inverse Strand Exchange Drives RNA-Templated DNA Double-Strand Break Repair," Mol Cell (2017) vol. 67, No. 1, pp. 19-29.e3.
McConnell Smith et al., "Generation of a nicking enzyme that stimulates site-specific gene conversion from the I-Anil LAGLIDADG homing endonuclease," PNAS (2009) 106(13):5099-104.
McKinnon et al.,"Flow Cytometry: An Overview," Curr Protoc Immunol (2018) vol. 120, No. 1, pp. 5.1.1-5.1.11.
Meaker et al.,"Advances in engineering CRISPR-Cas9 as a molecular Swiss Army knife," Synthetic Biology (2020) vol. 5, No. 1, pp. ysaa021.
Oh et al.,"Expansion of the prime editing modality with Cas9 from Francisella novicida," Biorxiv (May 25, 2021) vol. , No. , pp. 2021.05.25.445577.
Okano et al.,"Accurate fidelity analysis of the reverse transcriptase by a modified next-generation sequencing," Enzyme Microb Tech (2018) vol. 115, No., pp. 81-85.
Osanai et al., "Essential Motifs in the 3' Untranslated Region Required for Retrotransposition and the Precise Start of Reverse Transcription in Non-Long-Terminal-Repeat Retrotransposon SART1," Molecular and Cellular Biology (2004) vol. 24, No. 18, pp. 7902-7913.
Oscorbin et al.,"The attachment of a DNA-binding Sso7d-like protein improves processivity and resistance to inhibitors of M-MuLV reverse transcriptase," Febs Lett (2020) vol. 594, No. 24, pp. 4338-4356.
Ostertag et al., "Twin Priming—A Proposed Mechanism for the Creation of Inversions in L1 Retrotransposition," Genome Research (2001) vol. 11, pp. 2059-2065.
Ostertag et al.,"Biology of Mammalian L1 Retrotransposons," Annu Rev Genet (2001) vol. 35, No. 1, pp. 501-538.
Ouyang et al.,"RNA transcripts stimulate homologous recombination by forming DR-loops," Nature (May 12, 2021) vol. 594, No. 7862, pp. 283-288.
Pabo et al., "Design and selection of novel Cys2His2 zinc finger proteins," Ann. Rev. Biochem. (2001) 70:313-340.
Pajvani et al., "Fat apoptosis through targeted activation of caspase 8: a new mouse model of inducible and reversible ipoatrophy," Nat. Med. (2005)11(7):797-803.
Pardi et al.,"Synthetic Messenger RNA and Cell Metabolism Modulation, Methods and Protocols," Methods Mol Biology (2012) vol. 969, No. , pp. 29-42.
Park et al.,"Targeted mutagenesis in mouse cells and embryos using an enhanced prime editor," Genome Biol (Jun. 3, 2021) vol. 22, No. 1, pp. 170.
Parks et al. "A helper-dependent system for adenovirus vector production helps define a lower limit for efficient DNA packaging" J Virol (1997) 71(4): 3293-3298.
Parmacek et al., "A novel myogenic regulatory circuit controls slow/cardiac troponin C gene transcription in skeletal muscle," Mol. Cell. Biol. (1994) 14:1870-1885.
Patil et al., "Engineered nanocarriers of doxorubicin: a current update," Crit Rev Ther Drug Carrier Syst (2008) 25:1-61.
Paulk et al., "Bioengineered AAV Capsids with Combined High Human Liver Transduction In Vivo and Unique Humoral Seroreactivity," Mol. Ther. (2018) 26:289-303.

(56) References Cited

OTHER PUBLICATIONS

Paulsen et al.,"Ectopic expression of RAD52 and dn53BP1 improves homology-directed repair during CRISPR-Cas9 genome editing," Nat Biomed Eng (2017) vol. 1, No. 11, pp. 878-888.
Pawluk et al., "Anti-CRISPR: discovery, mechanism and function," Nature Reviews Microbiology (2018) vol. 16, pp. 12-17.
Peer and Lieberman, "Special delivery: targeted therapy with small RNAs," Gene Ther (2011) 18:1127-1133.
Peer et al., "Selective gene silencing in activated leukocytes by targeting siRNAs to the integrin lymphocyte function-associated antigen-1," PNAS (2007) 104:4095-4100.
Peer et al., "Systemic leukocyte-directed siRNA delivery revealing cyclin D1 as an anti-inflammatory target," Science (2008) 319:627-630.
Peer, "Induction of therapeutic gene silencing in leukocyte-implicated diseases by targeted and stabilized nanoparticles: a mini-review," J Control Release (2010) 20:63-68.
Pei et al.,"PROMALS3D: a tool for multiple protein sequence and structure alignments," Nucleic Acids Res (2008) vol. 36, No. 7, pp. 2295-2300.
Pellenz et al., "New human chromosomal safe harbor sites for genome engineering with CRISPR/Cas9, TAL effector and homing endonucleases," Human Gene Therapy (2018) doi: 10.1101/396390, 39 pages.
Petek et al., "Frequent endonuclease cleavage at off-target locations in vivo," Mol. Ther. (2010) 18(5):983-986.
Petek et al., "Efficient KRT14 targeting and functional characterization of transplanted human keratinocytes for the treatment of epidermolysis bullosa simplex," Mol. Ther. (2010) 8(9):1624-1632.
Peterka et al.,"Harnessing DSB repair to promote efficient homology-dependent and -independent prime editing," Biorxiv (Aug. 10, 2021) vol. , No. , pp. 2021.08.10.455572.
Peters et al.,"Recruitment of CRISPR-Cas systems by Tn7-like transposons," Proc National Acad Sci (2017) vol. 114, No. 35, pp. E7358-E7366.
Piccioli et al., "Neuroantibodies: ectopic expression of a recombinant anti-substance P antibody in the central nervous system of transgenic mice," Neuron (1995) 15:373-384.
Piccioli et al., "Neuroantibodies: molecular cloning of a monoclonal antibody against substance P for expression in the central nervous system," Proc. Natl. Acad. Sci. USA (1991) 88:5611-5615.
Platt et al., "Obesity-linked regulation of the adipsin gene promoter in transgenic mice," Proc. Natl. Acad. Sci. USA (1989) 86:7490-7494.
Porteus et al.,"A New Class of Medicines through DNA Editing," New Engl J Med (2019) vol. 380, No. 10, pp. 947-959.
Protein Data Bank, PDB file: "5F9R, Crystal structure of catalytically-active *Streptococcus pyogenes* CRISPR-Cas9 in complex with single-guided RNA and double-stranded DNA primed for target DNA cleavage," deposited by Jiang et al. on Dec. 10, 2015.
Qian et al., "Efficient and precise generation of Tay-Sachs disease model in rabbit by prime editing system," Cell Discov (Jul. 6, 2021) vol. 7, No. 1, pp. 50.
Qu et al., "Structure of a group II intron in complex with its reverse transcriptase," Nature Structural & Molecular Biology (2016) vol. 23, No. 6, pp. 549-557.
Radovick et al. "Migratory arrest of gonadotropin-releasing hormone neurons in transgenic mice," Proc. Natl. Acad. Sci. USA (1991) 88:3402-3406.
Ran et al., "Double Nicking by RNA-Guided CRISPR Cas9 for Enhanced Genome Editing Specificity," Cell (2013) vol. 154, No. 6, pp. 1380-1389.
Ravin et al., "The protelomerase of the phage-plasmid N15 is responsible for its maintenance in linear form," J Mol Biol 2001.
Rees et al., "Development of hRad51-Cas9 nickase fusions that mediate HDR without double-stranded breaks," Nat Commun (2019) vol. 10, No. 1, pp. 2212.
Remacle et al., "New mode of DNA binding of multi-zinc finger transcription factors: deltaEF1 family members bind with two hands to two target sites," EMBO Journal (1999) 18(18):5073-5084.
Renaud et al.,"Improved Genome Editing Efficiency and Flexibility Using Modified Oligonucleotides with TALEN and CRISPR-Cas9 Nucleases," Cell Reports (2016) vol. 14, No. 9, pp. 2263-2272.
Richner et al., "Modified mRNA Vaccines Protect against Zika Virus Infection," Cell (2017) 168(6): P1114-1125.
Robbins et al., "In vivo definition of a cardiac specific promoter and its potential utility in remodeling the heart," Ann. N. Y. Acad. Sci. (1995) 752:492-505.
Rodriguez-Fornes et al., "Targeted gene therapy into a safe harbor site in human hematopoietic progenitor cells," Gene Therapy (2020) 27(9):435-450.
Ross et al., "A fat-specific enhancer is the primary determinant of gene expression for adipocyte P2 in vivo," Proc. Natl. Acad. Sci. USA (1990) 87:9590-9594.
Rothgangl et al., "In vivo adenine base editing of PCSK9 in macaques reduces LDL cholesterol levels," Nat Biotechnol (May 19, 2021) vol. 39, No. 8, pp. 949-957.
Ruminski et al., "Processing and translation initiation of non-long terminal repeat retrotransposons by hepatitis delta virus (HDV)-like self-cleaving ribozymes," J Biol Chem (2011) 286: 41286-41295.
Rybarski et al., "Metagenomic Discovery of CRISPR-Associated Transposons," bioRxiv (2021) 13 pages.
Sabatini et al., "RAFT1: a mammalian protein that binds to FKBP12 in a rapamycin-dependent fashion and is homologous to yeast TORs," Cell (1994) 78(1):35-43.
Samulski et al., "Helper-free stocks of recombinant adeno-associated viruses: normal integration does not require viral gene expression," J. Virol. (1989) 63:03822-3828.
Sanford et al., "A novel role for shuttling SR proteins in mRNA translation," Genes & Development (2004) 18:755-768.
Bogdanove et al., "Two new complete genome sequences offer insight into host and tissue specificity of plant pathogenic *Xanthomonas* spp," J Bacteriol (2011) 193(19):5450-5464.
Boissinot et al., "L1 (LINE-1) Retrotransposon Evolution and Amplification in Recent Human History," Molecular Biology and Evolution 2000, 915-928.
Bothmer et al., "Characterization of the interplay between DNA repair and CRISPR/Cas9-induced DNA lesions at an endogenous locus," Nat Commun (2017) vol. 8, Article 13905, 12 pages.
Boundy et al., "Regulation of tyrosine hydroxylase promoter activity by chronic morphine in TH9.0-LacZ transgenic mice," J. Neurosci. (1998) 18(23): 9989-9995.
Brown et al., "A mammalian protein targeted by G1-arresting rapamycin-receptor complex," Nature (1994) 369 (6483):756-758.
Brown et al., "Formation of triple-helical structures by the 3'-end sequences of MALAT1 and MENBeta noncoding RNAs," PNAS (2012) vol. 109, pp. 19202-19207.
Bulcha et al.,"Viral vector platforms within the gene therapy landscape," Signal Transduct Target Ther (Feb. 8, 2021) vol. 6, No. 1, pp. 53.
Burke et al., "Sequence relationship of retrotransposable elements R1 and R2 within and between divergent insect species," Molecular Biology and Evolution (1993) vol. 10, No. 1, pp. 163-185.
Burke et al., "The domain structure and retrotransposition mechanism of R2 elements are conserved throughout arthropods.," Mol Biol Evol (1999) vol. 16, No. 4, pp. 502-511.
Cameron et al.,"Harnessing type I CRISPR-Cas systems for genome engineering in human cells," Nat Biotechnol (2019) vol. 37, No. 12, pp. 1471-1477.
Candales et al., "Database for bacterial group II introns," Nucleic Acids Research (2012) vol. 40, pp. D187-D190.
Carroll et al.,"Genome Engineering with Targetable Nucleases," Biochemistry-us (2014) vol. 83, No. 1, pp. 409-439.
Casanova et al., "A CamKIIalpha iCre BAC allows brain-specific gene inactivation," Genesis (2001) 31(1):37-42.
Chaikind et al.,"A programmable Cas9-serine recombinase fusion protein that operates on DNA sequences in mammalian cells," Nucleic Acids Res (2016) vol. 44, No. 20, pp. 9758-9770.
Chakrabarti, "Promoting adipose specificity: the adiponectin promoter," Endocrinol. (2010) 51(6):2408-2410.
Chan et al., "Crystal structure of a group II intron in the pre-catalytic state," Nature Structural & Molecular Biology (2012) vol. 19, No. 5, pp. 555-557.

(56) References Cited

OTHER PUBLICATIONS

Chandler et al.,"Breaking and joining single-stranded DNA: the HUH endonuclease superfamily," Nat Rev Microbiol (2013) vol. 11, No. 8, pp. 525-538.
Chandramouly et al.,"Polθ reverse transcribes RNA and promotes RNA-templated DNA repair," Sci Adv (Jun. 11, 2021) vol. 7, No. 24, pp. eabf1771.
Chang et al., "TAIL-seq: genome-wide determination of poly(A) tail length and 3' end modifications," Molecular Cell (2014) vol. 53, pp. 1044-1052.
Chatterjee et al.,"An engineered ScCas9 with broad PAM range and high specificity and activity," Nat Biotechnol (2020) vol. 38, No. 10, pp. 1154-1158.
Chemello et al.,"Precise correction of Duchenne muscular dystrophy exon deletion mutations by base and prime editing," Sci Adv (Apr. 30, 2021) vol. 7, No. 18, pp. eabg4910.
Chen et al., "A lymphoproliferative abnormality associated with inappropriate expression of the Thy-1 antigen in transgenic mice," Cell (1987) 51:7-19.
Chen et al., "Analysis of a 762-bp proximal leptin promoter to drive and control regulation of transgene expression of growth hormone receptor in mice," Biochem. Biophys. Res. Comm. (1999) 262(1):187-192.
Chen et al., "CRISPR-Cas12a target binding unleashes indiscriminate single-stranded DNase activity," Science (2018) vol. 360(6387):436-439.
Chen et al., "Expression of rat bone sialoprotein promoter in transgenic mice," J. Bone Miner. Res. (1996) 11:654-664.
Chen et al., "Identification of an 11-kDa FKBP12-rapamycin-binding domain within the 289-kDa FKBP12-rapamycin-associated protein and characterization of a critical serine residue," Proc Natl Acad Sci USA. 1995; 92(11):4947-4951.
Chen et al.,"Fusion Protein Linkers: Property, Design and Functionality," Adv Drug Deliv Rev (2013) 65(10): 1357-1369.
Chen et al.,"Programmable C:G to G:C genome editing with CRISPR-Cas9-directed base excision repair proteins," Nat Commun (Mar. 2, 2021) vol. 12, No. 1, pp. 1384.
Cheng et al., "Selective organ targeting (SORT) nanoparticles for tissue-specific mRNA delivery and CRISPR-Cas gene editing," Nat Nanotechnol (2020) 15(4):313-320.
Chicaybam et al.,"Chimeric Antigen Receptor T Cells, Development and Production," Methods Mol Biology (2019) vol. 2086, No. , pp. 131-137.
Choi et al., "Interplay between RNASEH2 and MOV10 controls LINE-1 retrotransposition," Nucleic Acids Research (2018) doi: 10/1093/nar/gkx1312, 15 pages.
Choi et al., "Structure of the FKBP12-rapamycin complex interacting with the binding domain of human FRAP," Science (1996) 273(5272):239-242.
Choi et al.,"Precise genomic deletions using paired prime editing," Biorxiv (Jan. 2, 2021) vol. , No. , pp. 2020.12.30.424891.
Choo et al., "Advances in zinc finger engineering," Curr. Opin. Struct. Biol. (2000) 10:411-416.
Chow et al.,"A web tool for the design of prime-editing guide RNAs," Nat Biomed Eng (Aug. 28, 2020) vol. 5, No. 2, pp. 190-194.
Christensen et al., "RNA from the 5' end of the R2 retrotransposon controls R2 protein binding to and cleavage of its DNA target site," Proceedings of the National Academy of Sciences (2006) vol. 103, No. 47, pp. 17602-17607.
Christensen et al., "Role of the Bombyx mori R2 element N-terminal domain in the target-primed reverse transcription (TPRT) reaction," Nucleic Acids Research (2005) vol. 33, No. 20, pp. 6461-6468.
Christensen et al.,"R2 Target-Primed Reverse Transcription: Ordered Cleavage and Polymerization Steps by Protein Subunits Asymmetrically Bound to the Target DNA," Mol Cell Biol (2005) vol. 25, No. 15, pp. 6617-6628.
Clement et al.,"CRISPResso2 provides accurate and rapid genome editing sequence analysis," Nat Biotechnol (2019) vol. 37, No. 3, pp. 224-226.
Coggins et al.,"Enhanced enzyme kinetics of reverse transcriptase variants cloned from animals infected with SIVmac239 lacking viral protein X," J Biol Chem (2020) vol. 295, No. 50, pp. 16975-16986.
Cohen et al.,"Prime editing promises to be a cut above CRISPR," Science (2019) vol. 366, No. 6464, pp. 406-406.
Collias et al.,"CRISPR technologies and the search for the PAM-free nuclease," Nat Commun (Jan. 22, 2021) vol. 12, No. 1, pp. 555.
Comb et al., "Proteins bound at adjacent DNA elements act synergistically to regulate human proenkephalin cAMP Inducible transcription," EMBO J (1988) 17:3793-3805.
Cooney et al., "A Novel AAV-mediated Gene Delivery System Corrects CFTR Function in Pigs," Am J Respir Cell Mol Biol (2019) 61(6):747-754.
Cordaux et al., "The impact of retrotransposons on human genome evolution,"Nature Reviews Genetics (2009) Nature Reviews vol. 10, pp. 691-703.
Cost et al., "Targeting of Human Retrotransposon Integration Is Directed by the Specificity of the L1 Endonuclease for Regions of Unusual DNA Structure," Biochemistry (1998) vol. 37, pp. 18081-18093.
Craig et al., Editors, "Mobile DNA III," ASM Press (2015) pp. 1-1346.
Dalwadi et al.,"AAV integration in human hepatocytes," Mol Ther (Aug. 28, 2021) vol. 29, No. 10, pp. 2898-2909.
Davidson et al., "Emulsion based selection of T7 promoters of varying activity," Pac Symp Biocomput (2010) pp. 433-443.
Davidsson et al., "A systematic capsid evolution approach performed in vivo for the design of AAV vectors with tailored properties and tropism," Proc Natl Acad Sci USA (2019) 116(52):27053-27062.
Thiel et al., "Infectious RNA transcribed in vitro from a cDNA copy of the human coronavirus genome cloned in vaccinia virus," J Gen Virol (2001) 82(6):1273-1281.
Thompson et al., "Independently derived targeting of the 28S rDNA by A- and D-clade R2 retrotransposons," Mobile Genetic Elements (2011) vol. 1, pp. 29-37.
Tian et al.,"Co-Evolutionary Fitness Landscapes for Sequence Design," Angewandte Chemie Int Ed (2018) vol. 57, No. 20, pp. 5674-5678.
To et al.,"An overview of rational design of mRNA-based therapeutics and vaccines," Expert Opin Drug Dis (Jul. 19, 2021) vol. 16, No. 11, pp. 1307-1317.
Tong et al.,"CRISPR-nRAGE, a Cas9 nickase-reverse transcriptase assisted versatile genetic engineering toolkit for *E. coli*," Biorxiv (2020) vol. , No. , pp. 2020.09.02.279141.
Tong et al.,"The Versatile Type V Crispr Effectors and Their Application Prospects," Frontiers Cell Dev Biology (Feb. 4, 2021) vol. 8, No. , pp. 622103.
Toro et al.,"The Reverse Transcriptases Associated with CRISPR-Cas Systems," Sci Rep-uk (2017) vol. 7, No. 1, pp. 7089.
Tozzo et al., "Amelioration of insulin resistance in streptozotocin diabetic mice by transgenic overexpression of GLUT4 driven by an adipose-specific promoter," Endocrinol. (1997) 138:1604-1611.
Tratschin et al., "A human parvovirus, adeno-associated virus, as a eucaryotic vector: transient expression and encapsidation of the procaryotic gene for chloramphenicol acetyltransferase," Mol. Cell. Biol. (1984) 4:2072-2081.
Tratschin et al., "Adeno-associated virus vector for high-frequency integration, expression, and rescue of genes in mammalian cells," Mol. Cell. Biol. (1985) 5:3251-3260.
Trevino et al.,"Chapter Eight Genome Editing Using Cas9 Nickases," Methods Enzymol (2014) vol. 546, No. , pp. 161-174.
Truong et al., "Retrohoming of a Mobile Group II Intron in Human Cells Suggests How Eukaryotes Limit Group II Intron Proliferation," PLoS Genetics (2015) vol. 11, No. 8, Article e1005422, 35 pages.
Tsai et al.,"CIRCLE-seq: a highly sensitive in vitro screen for genome-wide CRISPR-Cas9 nuclease off-targets," Nat Methods (2017) vol. 14, No. 6, pp. 607-614.

(56) References Cited

OTHER PUBLICATIONS

Tsai et al.,"Defining and improving the genome-wide specificities of CRISPR-Cas9 nucleases," Nat Rev Genet (2016) vol. 17, No. 5, pp. 300-312.
Tsai et al.,"GUIDE-seq enables genome-wide profiling of off-target cleavage by CRISPR-Cas nucleases," Nat Biotechnol (2015) vol. 33, No. 2, pp. 187-197.
Tuerk and Gold, "Systematic evolution of ligands by exponential enrichment: RNA ligands to bacteriophage T4 DNA polymerase," Science (1990) 249(4968):505-510.
Uchida et al., "Development of a forward-oriented therapeutic lentiviral vector for hemoglobin disorders," Nat Commun (2019) vol. 10, Article 4479, 14 pages.
UniProt Consortium, "UniProt: UniProt: a worldwide hub of protein knowledge," Nucleic Acids Res (2019) 47:D506-D515.
Usmani et al., "THPdb: Database of FDA-approved peptide and protein therapeutics," PLoS One (2017) 12(7): e0181748, 12 pages.
Ustyantsev et al., "Convergence of retrotransposons in oomycetes and plants," Mobile DNA (2017) vol. 8, Article 4, 11 pages.
Valencia et al., "Splicing promotes rapid and efficient mRNA export in mammalian cells," PNAS (2008) 105:3386-3391.
Vashishtha et al., "Different Divalent Cations Alter the Kinetics and Fidelity of DNA Polymerases*," J Biol Chem (2016) vol. 291, No. 40, pp. 20869-20875.
Wada et al.,"Precision genome editing in plants: state-of-the-art in CRISPR/Cas9-based genome engineering," Bmc Plant Biol (2020) vol. 20, No. 1, pp. 234.
Wagstaff et al., "Molecular reconstruction of extinct LINE-1 elements and their interaction with nonautonomous elements," Molecular Biology and Evolution (2013) 30(1): 88-99.
Wallace et al., "L1 mobile element expression causes multiple types of toxicity," Gene (2008) vol. 419, pp. 75-81.
Walton et al., "Unconstrained genome targeting with near-PAMless engineered CRISPR-Cas9 variants," Science (2020) vol. 368, No. 6488, pp. 290-296.
Wang et al., "Comparative Study of Liver Gene Transfer With AAV Vectors Based on Natural and Engineered AAV Capsids," Mol. Ther. (2015) 23:1877-1887.
Wang et al., "High-level protein production in erythroid cells derived from in vivo transduced hematopoietic stem cells," Blood Adv (2019) 3(19):2883-2894.
Wang et al., "Systematic evaluation of AAV vectors for liver directed gene transfer in murine models," Mol. Ther. (2010) 18:118-125.
Wang et al.,"A novel strategy to engineer DNA polymerases for enhanced processivity and improved performance in vitro," (38018) vol. , No. , pp. 2004.
Wang et al.,"Microbial single-strand annealing proteins enable CRISPR gene-editing tools with improved knock-in efficiencies and reduced off-target effects," Nucleic Acids Res (Apr. 6, 2021) vol. 49, No. 6, pp. e36-e36.
Wang et al.,"Rare variant contribution to human disease in 281,104 UK Biobank exomes," Nature (Aug. 10, 2021) vol. 597, No. 7877, pp. 527-532.
Webber et al.,"Highly efficient multiplex human T cell engineering without double-strand breaks using Cas9 base editors," Nat Commun (2019) vol. 10, No. 1, pp. 5222.
Wells et al.,"A Field Guide to Eukaryotic Transposable Elements," Annu Rev Genet (2020) vol. 54, No. 1, pp. 44949.
Wesselhoeft et al., "Engineering circular RNA for potent and stable translation in eukaryotic cells," Nature Communications (2018) 9(1):2629.
Wesselhoeft et al.,"RNA Circularization Diminishes Immunogenicity and Can Extend Translation Duration In-Vivo," Mol Cell (2019) vol. 74, No. 3, pp. 508-520.e4.
West et al., "Gene expression in adeno-associated virus vectors: the effects of chimeric mRNA structure, helper virus, and adenovirus VA1 RNA," Virology (1987) 160:38-47.
Whifield et al., "Stem-loop binding protein, the protein that binds the 3' end of histone mRNA, is cell cycle regulated by both translational and posttranslational mechanisms," Molecular Cellular Biology (2000) 20:4188-4198.
Wicker et al., "A unified classification system for eukaryotic transposable elements," Nature Reviews Genetics (2007) vol. 8, pp. 973-982.
Wolfs et al., "Biasing genome-editing events toward precise length deletions with an RNA-guided TevCas9 dual nuclease," PNAS (2016) 113(52):14988-14993.
Wolfs et al., "MegaTevs: single-chain dual nucleases for efficient gene disruption," Nucleic Acids Res (2014) 42 (13):8816-29.
Wood et al., "Wood et al., J. Biol. Chem.289(21); 14512-9 (2014)," J. Biol. Chem. (2014) 289(21):14512-14519.
Wu et al.,"Highly efficient therapeutic gene editing of human hematopoietic stem cells," Nat Med (2019) vol. 25, No. 5, pp. 776-783.
Wurth et al., "Hypermethylated-capped selenoprotein mRNAs in mammals," Nucleic Acid Res (2014) 42: 8663-8677.
Xiong et al.,"Functional expression of a sequence-specific endonuclease encoded by the retrotransposon R2Bm," Cell (1988) vol. 55, No. 2, pp. 235-246.
Xiong et al.,"Origin and evolution of retroelements based upon their reverse transcriptase sequences.," Embo J (1990) vol. 9, No. 10, pp. 3353-3362.
Xu et al., "Engineered miniature CRISPR-Cas system for mammalian genome regulation and editing," Mol Cell (Oct. 21, 2021) vol. 81, No. 20, pp. 4333-4345.e4.
Yan et al.,"Functionally diverse type V CRISPR-Cas systems," Science (2019) vol. 363, No. 6422, pp. 88-91.
Yang et al., "Identification and characterization of nuclear and nucleolar localization signals in 58-kDa microspherule protein (MSP58)," Journal of Biomedical Science (2015) vol. 22, Article 33, 15 pages.
Yasukawa et al.,"Next-generation sequencing-based analysis of reverse transcriptase fidelity," Biochem Bioph Res Co (2017) vol. 492, No. 2, pp. 147-153.
[No Author Listed] GenBank 5-HT1C serotonin receptor {promoter region} [mice, Genomic, 1859 nt] S62283.1 (1993).
[No AuthorListed] GenBank Human synapsin I gene, 5' end, Accession M55301 J05630 (1995) 2 pages.
Adamala et al.,"Programmable RNA-binding protein composed of repeats of a single modular unit," Proc National Acad Sci (2016) vol. 113, No. 19, pp. E2579-88.
Adikusuma et al.,"Optimized nickase- and nuclease-based prime editing in human and mouse cells," Biorxiv (Jul. 2, 2021) vol. , No. , pp. 2021.07.01.450810.
Aird et al.,"Increasing Cas9-mediated homology-directed repair efficiency through covalent tethering of DNA repair template," Commun Biology (2018) vol. 1, No. 1, pp. 54.
Aird et al.,"Split *Staphylococcus aureus* prime editor for AAV delivery," Biorxiv (Jan. 11, 2021) vol. , No. , pp. 2021.01.11.426237.
Akinc et al., "Targeted delivery of RNAi therapeutics with endogenous and exogenous ligand-based mechanisms," Mol Ther 18(7):1357-1364 (2010).
Akyürek et al., "SM22alpha promoter targets gene expression to vascular smooth muscle cells in vitro and in vivo," Mol. Med. (2000) 6(11):983-91.
Almada et al., "Promoter directionality is controlled by U1 snRNP and polyadenylation signals," Nature (2013) 499: 360-363.
Altae-Tran et al.,"The widespread IS200/605 transposon family encodes diverse programmable RNA-guided endonucleases," Science (Sep. 9, 2021) vol. 374, No. 6563, pp. 57-65.
An et al., "Plug and play modular strategies for synthetic retrotransposons," Methods (2009) vol. 49, pp. 227-235.
Anand et al., "Structure based design of protein linkers for zinc finger nuclease," FEBS Letters, 587:19, 2013.
Anders et al., "Structural basis of PAM-dependent target DNA recognition by the Cas9 endonuclease," Nature (2014) vol. 513, No. 7519, pp. 569-573.

(56) References Cited

OTHER PUBLICATIONS

Andersen et al., "Herpesvirus-mediated gene delivery into the rat brain: specificity and efficiency of the neuron-specific enolase promoter," Cell. Mol. Neurobiol., 13:503-15 (1993).
Anderson et al.,"pegIT—a web-based design tool for prime editing," Nucleic Acids Res (Jul. 2, 2021) vol. 49, No. W1, pp. gkab427.
Andries et al.,"N1-methylpseudouridine-incorporated mRNA outperforms pseudouridine-incorporated mRNA by providing enhanced protein expression and reduced immunogenicity in mammalian cell lines and mice," J Control Release (2015) vol. 217, pp. 337-344.
Anzalone et al., Search-and replace genome editing without double-strand breaks or donor DNA, Nature (2019) vol. 576, No. 7785, pp. 149-157.
Anzalone et al.,"Genome editing with CRISPR-Cas nucleases, base editors, transposases and prime editors," Nat Biotechnol (2020) vol. 38, No. 7, pp. 824-844.
Arbuthnot et al., "In vitro and in vivo hepatoma cell-specific expression of a gene transferred with an adenoviral vector" Hum. Gene Ther., 7:1503-14 (1996).
Ardeljan et al.,"Cell fitness screens reveal a conflict between LINE-1 retrotransposition and DNA replication," Nat Struct Mol Biol (2020) vol. 27, No. 2, pp. 168-178.
Asmari et al. "Thermophoresis for characterizing biomolecular interaction," Methods (2018) 146:107-119.
Asrani et al., "Optimization of mRNA untranslated regions for improved expression of therapeutic mRNA," RNA biology 15, 756-762 (2018).
Babushok et al., "Progress in understanding the biology of the human mutagen LINE-1," Human Mutation (2007) vol. 28, No. 6, pp. 527-539.
Bader et al.,"The roles of RNA in DNA double-strand break repair," Brit J Cancer (2020) vol. 122, No. 5, pp. 613-623.
Bailey et al., "The MEME Suite," Nucleic Acids Research (2015) vol. 43, pp. W39-W49.
Bogdanove et al. "TAL effectors: customizable proteins for DNA targeting," Science (2011) 333(6051):1843-61846.
Baltimore, "Expression of animal virus genomes," Bacteriol Rev 35(3):235-241 (1971).
Bao et al., "Repbase Update, a database of repetitive elements in eukaryotic genomes," Mobile DNA (2015) vol. 6, Article 11, 6 pages.
Bibillo et al., "The Reverse Transcriptase of the R2 Non-LTR Retrotransposon: Continuous Synthesis of cDNA on Non-continuous RNA Templates," J Mol Biol (2002) vol. 316, pp. 459-473.
Baranauskas et al.,"Generation and characterization of new highly thermostable and processive M-MuLV reverse transcriptase variants," Protein Eng Des Sel (2012) vol. 25, No. 10, pp. 657-668.
Bartge et al., "Transgenic mice express the human phenylethanolamine N-methyltransferase gene in adrenal medulla and retina," Proc. Natl. Acad. Sci. USA (1988) 85:3648-3652.
Bateman et al.,"UniProt: the universal protein knowledgebase," Nucleic Acids Res (2017) vol. 45, No. D1, pp. D158-D169.
Bednarek et al., "mRNAs biotinylated within the 5' cap and protected against decapping: new tools to capture RNA-protein complexes," Phil Trans R Soc B (2018) vol. 373, Article 20180167, 12 pages.
Beerli, et al.,"Engineering polydactyl zinc-finger transcription factors," Nature Biotechnol. (2002) 20:135-141.
Belfort et al., "Group II Intron RNPs and Reverse Transcriptases-From Retroelements to Research Tools," Cold Spring Harbor Perspectives in Biology (2019) 11:a032375, 17 pages.
Bell et al., "In silico design and validation of high-affinity RNA aptamers targeting epithelial cellular adhesion molecule dimers," PNAS 117(15):8486-8493, 2020.
Bellaousov et al., "RNAstructure: Web servers for RNA secondary structure prediction and analysis," Nucleic Acids Res 41:W471-W474 (2013).
Ben-Arie et al., "Integrin-targeted nanoparticles for siRNA delivery," Methods Mol Biol. 2012 757:497-507.

Benitez-Guijarro et al.,"RNase H2, mutated in Aicardi-Goutieres syndrome, promotes LINE-1 retrotransposition," Embo J (2018) vol. 37, No. 15, Article e98506, 22 pages.
Benoit et al., "Synthesis of folate-functionalized RAFT polymers for targeted siRNA delivery," Biomacromolecules (2011) 12: 2708-2714.
Berg et al., "U1 snRNP determines mRNA length and regulates isoform expression," Cell (2012) 150:53-64.
Bhattarai-Kline et al.,"Reconstructing transcriptional histories by CRISPR acquisition of retron-based genetic barcodes," Biorxiv (Aug. 12, 2021) vol. , No. , pp. 2021.08.11.455990.
Bibillo et al., "High Processivity of the Reverse Transcriptase from a Non-long Terminal Repeat Retrotransposon," J Biol Chem (2002) vol. 277, No. 38, pp. 34836-34845.
Bock et al.,"Treatment of a metabolic liver disease by in vivo prime editing in mice," Biorxiv (Aug. 17, 2021) vol. , No. , pp. 2021.08.17.456632.
Bieberstein et al., "First exon length controls active chromatin signatures and transcription," Cell Reports (2012) 2:62-68.
Birbach et al., "Cytosolic, nuclear and nucleolar localization signals determine subcellular distribution and activity of the NF-kappaB inducing kinase NIK," Journal of Cell Science (2004) 117:3615-3624.
Bitter et al., "Expression and secretion vectors for yeast," Methods in Enzymology (1987) 153:516-544.
Boehme et al., "The sleeping beauty transposon vector system for treatment of rare genetic diseases: an unrealized hope?" Curr Gene Ther (2015) 15(3):255-265.
Sano et al.,"Mutations to create thermostable reverse transcriptase with bacterial family A DNA polymerase from Thermotoga petrophila K4," J Biosci Bioeng (2012) vol. 113, No. 3, pp. 315-321.
Sanz et al.,"High-resolution, strand-specific R-loop mapping via S9.6-based DNA:RNA immunoprecipitation and high-throughput sequencing," Nat Protoc (2019) vol. 14, No. 6, pp. 1734-1755.
Sapranauskas et al.,"The *Streptococcus thermophilus* CRISPR/Cas system provides immunity in *Escherichia coli*," Nucleic Acids Res (2011) vol. 39, No. 21, pp. 9275-9282.
Sartorelli et al., "Myocardial activation of the human cardiac alpha-actin promoter by helix-loop-helix proteins," Proc. Natl. Acad. Sci. USA (1992) 89:4047-4051.
Sasaoka et al., "Analysis of the human tyrosine hydroxylase promoter-chloramphenicol acetyltransferase chimeric gene expression in transgenic mice," Mol. Brain Res. (1992) 16:274-286.
Sato et al., "Dual promoter structure of mouse and human fatty acid translocase/CD36 genes and unique transcriptional activation by peroxisome proliferator-activated receptor alpha and gamma ligands," J. Biol. Chem. (2002) 277: 15703-15711.
Sato et al., "Efficiency of the pioneer round of translation affects the cellular site of nonsense-mediated mRNA decay," Molecular Cell (2008) 29: 255-262.
Schene et al.,"Prime editing for functional repair in patient-derived disease models," Nat Commun (2020) vol. 11, No. 1, pp. 5352.
Schmid-Burgk et al.,"Highly Parallel Profiling of Cas9 Variant Specificity," Mol Cell (2020) vol. 78, No. 4, pp. 794-800.e8.
Schmidt et al.,"Transcriptional recording by CRISPR spacer acquisition from RNA," Nature (2018) vol. 562, No. 7727, pp. 380-385.
Scholze et al., "TAL effector-DNA specificity," Virulence (2010) 1:5, 428-462.
Segal et al., "Custom DNA-binding proteins come of age: polydactyl zinc-finger proteins," Curr. Opin. Biotechnol. (2001) 12:632-637.
Segel et al.,"Mammalian retrovirus-like protein PEG10 packages its own mRNA and can be pseudotyped for mRNA delivery," Science (Aug. 19, 2021) vol. 373, No. 6557, pp. 882-889.
Seo et al., "Functional characterization of the human resistin promoter with adipocyte determination- and differentiation-dependent factor 1/sterol regulatory element binding protein 1c and CCAAT enhancer binding protein-alpha," Molec. Endocrinol. (2003) 17:1522-1533.
Shah et al., "Inteins: Nature's Gift to Protein Chemists," Chem Sci. (2014) 5(1):446-461.
Shams et al., "Comprehensive deletion landscape of CRISPR-Cas9 identifies minimal RNA-guided DNA-binding modules," BioRxiv (2020) 18 pages.

(56) References Cited

OTHER PUBLICATIONS

Sharan et al.,"Recombineering: a homologous recombination-based method of genetic engineering," Nat Protoc (2009) vol. 4, No. 2, pp. 206-223.
Sharon et al.,"Functional Genetic Variants Revealed by Massively Parallel Precise Genome Editing," Cell (2018) vol. 175, No. 2, pp. 544-557.e16.
Shcherbakova & Brenowitz, "Monitoring structural changes in nucleic acids with single residue spatial and millisecond time resolution by quantitative hydroxyl radical footprinting, " Nature Protocols (2008) 3:288-302.
Shivram et al., "Targeting novel sites: The N-terminal DNA binding domain of non-LTR retrotransposons is an adaptable module that is implicated in changing site specificities," Mobile Genetic Elements (2011) vol. 1, No. 3, pp. 169-178.
Shukla et al., "High-throughput identification of RNA nuclear enrichment sequences," The EMBO Journal (2018) vol. 37, Article e98452, 11 pages.
Siegner et al.,"PnB Designer: a web application to design prime and base editor guide RNAs for animals and plants," Bmc Bioinformatics (Mar. 2, 2021) vol. 22, No. 1, pp. 101.
Simon et al.,"Retrons and their applications in genome engineering," Nucleic Acids Res (2019) vol. 47, No. 21, pp. 11007-11019.
Sixma et al.,"DNA mismatch repair: MutS structures bound to mismatches," Curr Opin Struc Biol (2001) vol. 11, No. 1, pp. 47-52.
Slade et al.,"Recombination and Replication in DNA Repair of Heavily Irradiated Deinococcus radiodurans," Cell (2009) vol. 136, No. 6, pp. 1044-1055.
Slaymaker et al.,"Engineering Cas9 for human genome editing," Curr Opin Struc Biol (May 5, 2021) vol. 69, No., pp. 86-98.
Smyshlyaev et al.,"Acquisition of an Archaea-like ribonuclease H domain by plant L1 retrotransposons supports modular evolution," Proc National Acad Sci (2013) vol. 110, No. 50, pp. 20140-20145.
Song et al., "Antibody mediated in vivo delivery of small interfering RNAs via cell-surface receptors," Nat Biotechnol. (2005) 23:709-717.
Spuch and Navarro, "Liposomes for Targeted Delivery of Active Agents against Neurodegenerative Diseases (Alzheimer's Disease and Parkinson's Disease)," Journal of Drug Delivery, vol. 2011, Article ID 469679, 12 pages, 2011. doi: 10.1155/2011/469679 for review.
Srinivasan et al., "Integrin-targeted stabilized nanoparticles for an efficient delivery of siRNAs in vitro and in vivo," Methods Mol Biol (2012) 820:105-116.
Stamos et al.,"Structure of a Thermostable Group II Intron Reverse Transcriptase with Template-Primer and Its Functional and Evolutionary Implications," Mol Cell (2017) vol. 68, No. 5, pp. 926-939. e4.
Standage-Beier et al.,"Prime Editing Guide RNA Design Automation Using PINE-CONE," Acs Synth Biol (Jan. 19, 2021) vol. 10, No. 2, pp. 422-427.
Stauber et al., "A signal regulating mouse histone H4 mRNA levels in a mammalian cell cycle mutant and sequences controlling RNA 3' processing are both contained within the same 80-bp fragment," EMBO Journal (1986) 5:3297-3303.
Stein et al., "The osteocalcin gene: a model for multiple parameters of skeletal-specific transcriptional control," Mol. Biol. Rep. (1997) 24:185-196.
Stevens et al., "Design of a Split Intein with Exceptional Protein Splicing Activity," J Am Chem Soc (2016) 138 (7):2162-2165.
Storici et al.,"RNA-templated DNA repair," Nature (2007) vol. 447, No. 7142, pp. 338-341.
Strecker et al., "RNA-guided DNA insertion with CRISPR-associated transposases," Science (2019) vol. 365, No. 6448, pp. 48-53.
Strobel et al.,"High-throughput determination of RNA structures," Nat Rev Genet (2018) vol. 19, No. 10, pp. 615-634.
Su et al.,"Sequence-specific retrotransposition of 28S rDNA-specific Line R201 in human cells," Rna (2019) vol. 25, No. 11, pp. 1432-1438.
Subramanya et al., "Enhanced induction of HIV-specific cytotoxic T lymphocytes by dendritic cell-targeted delivery of SOCS-1 siRNA," Mol Ther (2010) 18:2028-2037.
Subtelny et al., "Poly(A)-tail profiling reveals an embryonic switch in translational control," Nature (2014) 508:66-71.
Sultana et al., "Integration site selection by retroviruses and transposable elements in eukaryotes," Nature Reviews Genetics (2017) doi: 10.1038/nrg.2017.7, 17 pages.
Sultana et al., "The Landscape of L1 Retrotransposons in the Human Genome Is Shaped by Pre-insertion Sequence Biases and Post-insertion Selection," Molecular Cell (2019) vol. 74, pp. 555-570.
Surun et al.,"Efficient Generation and Correction of Mutations in Human iPS Cells Utilizing mRNAs of CRISPR Base Editors and Prime Editors," Genes-basel (2020) vol. 11, No. 5, pp. 511.
Suzuki et al.,"In vivo genome editing via CRISPR/Cas9 mediated homology-independent targeted integration," Nature (2016) vol. 540, No. 7631, pp. 144-149.
Tabor et al., "Identification of conserved cis-elements and transcription factors required for sterol-regulated transcription of stearoyl-CoA desaturase 1 and 2," J. Biol. Chem. (1999) 274:20603-20610.
Tang et al.,"Class 2 CRISPR/Cas: an expanding biotechnology toolbox for and beyond genome editing," Cell Biosci (2018) vol. 8, No. 1, pp. 59.
Tang et al.,"Structural basis of suppression of host translation termination by Moloney Murine Leukemia Virus," Nat Commun (2016) vol. 7, No. 1, pp. 12070.
Taylor et al.,"Affinity Proteomics Reveals Human Host Factors Implicated in Discrete Stages of LINE-1 Retrotransposition," Cell (2013) vol. 155, No. 5, pp. 1034-1048.
Templeton et al., "Improved DNA: liposome complexes for increased systemic delivery and gene expression," Nature Biotech, 15:647-652, 1997.
Grimm et al., Novel tools for production and purification of recombinant adenoassociated virus vectors, Hum Gene Ther (1998) 9(18):2745-2760. doi: 10.1089/hum.1998.9.18-2745.
Grindley et al.,"Mechanisms of Site-Specific Recombination*," Annu Rev Biochem (2006) vol. 75, No. 1, pp. 567-605.
Gu et al.,"Substitution of Asp114 or Arg116 in the Fingers Domain of Moloney Murine Leukemia Virus Reverse Transcriptase Affects Interactions with the Template-primer Resulting in Decreased Processivity," J Mol Biol (2001) vol. 305, No. 2, pp. 341-359.
Guha and Edgell, "Applications of Alternative Nucleases in the Age of CRISPR/Cas9," Int J Mol Sci (2017) 18(22):2565.
Guynet et al.,"Resetting the Site: Redirecting Integration of an Insertion Sequence in a Predictable Way," Mol Cell (2009) vol. 34, No. 5, pp. 612-619.
Ha et al.,"Exosomes as therapeutic drug carriers and delivery vehicles across biological membranes: current perspectives and future challenges," Acta Pharmaceutica Sinica B (2016) vol. 6, Issue 4, pp. 287-296.
Haack et al., "Cryo-EM Structures of a Group II Intron Reverse Splicing into DNA," Cell (2019) vol. 178, pp. 612-623.
Halperin et al., "CRISPR-guided DNA polymerases enable diversification of all nucleotides in a tunable window," Nature (2018) vol. 560, No. 7717, pp. 248-252.
Han et al., "Circular retrotransposition products generated by a LINE retrotransposon," Nucleic Acids Research (2012) vol. 40, No. 21, pp. 10866-10877.
Han, "Non-long terminal repeat (non-LTR) retrotransposons: mechanisms, recent developments, and unanswered questions," Mobile Dna-uk (2010) vol. 1, No. 1, pp. 15-15.
Hansal et al., "Cutting Edge: Induction of antigen-specific hyporesponsiveness by transplantation of hemopoietic cells containing an MHC class I transgene regulated by a lymphocyte-specific promoter," J. Immunol. (1998) 161:1063-1068.
Harris et al., "Regulation of histone mRNA in the unperturbed cell cycle: evidence suggesting control at two posttranscriptional steps," Molecular Cellular Biology (1991) 11: 2416-2424.
Hashimoto et al.,"Crystal structure of DNA polymerase from hyperthermophilic archaeon *Pyrococcus kodakaraensis* KOD1I1Edited by R. Huber," J Mol Biol (2001) vol. 306, No. 3, pp. 469-477.

(56) References Cited

OTHER PUBLICATIONS

Hausl et al., "Hyperactive sleeping beauty transposase enables persistent phenotypic correction in mice and a canine model for hemophilia B," Mol Ther (2010) 18(11):1896-906.
He and Pu, "Genome-wide location analysis by pull down of in vivo biotinylated transcription factors," Curr. Protoc Mol Biol (2010) Chapter 21, Unit 21.20., 18 pages.
Hendel et al., "Chemically modified guide RNAs enhance CRISPR-Cas genome editing in human primary cells," Nature Biotechnol. (2015) 33(9): 985-989.
Hendel et al.,"Directed evolution in mammalian cells," Nat Methods (Apr. 7, 2021) vol. 18, No. 4, pp. 346-357.
Hermonat & Muzyczka, "Use of adeno-associated virus as a mammalian DNA cloning vector: transduction of neomycin resistance into mammalian tissue culture cells," PNAS (1984) 81:6466-6470.
Hernandez et al., "B2 and ALU retrotransposons are self-cleaving ribozymes whose activity is enhanced by EZH2," PNAS (2020) 117(1):415-425.
Herschhorn et al., "Retroviral reverse transcriptases," Cellular and Molecular Life Sciences (2010) vol. 67, pp. 2717-2747.
Herschhorn et al.,"Retroviral reverse transcriptases," Cell Mol Life Sci (2010) vol. 67, No. 16, pp. 2717-2747.
Higashimoto et al.,"The woodchuck hepatitis virus post-transcriptional regulatory element reduces readthrough transcription from retroviral vectors," Gene Ther (2007) vol. 14, No. 17, pp. 1298-1304.
Hille et al.,"The Biology of CRISPR-Cas: Backward and Forward," Cell (2018) vol. 172, No. 6, pp. 1239-1259.
Hodge et al., "Wide Awake and Ready to Move: 20 Years of Non-Viral Therapeutic Genome Engineering with the Sleeping Beauty Transposon System," Hum Gene Ther (2017) 28(10):842-855.
Hou et al.,"DeepSF: deep convolutional neural network for mapping protein sequences to folds," Bioinformatics (2018) vol. 34, No. 8, pp. 1295-1303.
Hrecka et al.,"Vpx relieves inhibition of HIV-1 infection of macrophages mediated by the SAMHD1 protein," Nature (2011) vol. 474, No. 7353, pp. 658-661.
Hsieh et al., "The Devil is in the details for DNA mismatch repair," Proc National Acad Sci (2017) vol. 114, No. 14, pp. 3552-3554.
Hisu et al.,"PrimeDesign software for rapid and simplified design of prime editing guide RNAs," Nat Commun (Feb. 15, 2021) vol. 12, No. 1, pp. 1034.
Hu et al.,"Evolved Cas9 variants with broad PAM compatibility and high DNA specificity," Nature (2018) vol. 556, No. 7699, pp. 57-63.
Huang et al., "Precision genome editing using cytosine and adenine base editors in mammalian cells," Nat Protoc (Jan. 18, 2021) vol. 16, No. 2, pp. 1089-1128.
Hunter et al., "Targeting gene expression to specific cardiovascular cell types in transgenic mice," Hypertension (1993) 22:608-617.
Hussman et al., Mapping the Genetic Langscape of DNA Double-strand Break Repair) bioRxiv (2021) 55 pages.
Hwang et al.,"PE-Designer and PE-Analyzer: web-based design and analysis tools for CRISPR prime editing," Nucleic Acids Res (Jul. 2, 2021) vol. 49, No. W1, pp. gkab319-.
Imburgio et al., Studies of promoter recognition and start site selection by T7 RNA polymerase using a comprehensive collection of promoter variants, Biochemistry (2000) 39(34):10419-10430.
International Search Report and Written Opinion issued in PCT/US2021/020948, mailed Oct. 7, 2021.
Isalan et al., "A rapid, generally applicable method to engineer zinc fingers illustrated by targeting the HIV-1 promoter," Nature Biotechnol. (2001) 19:656-660.
Ishii et al., "Analysis of the Role of Homology Arms in Gene-Targeting Vectors in Human Cells," PLoS One (2014) 9:9: e108236, 9 pages.
Ivancevic et al., "LINEs between Species—Evolutionary Dynamics of LINE-1 Retrotransposons across the Eukaryotic Tree of Life," Genome Biology and Evolution (2016) vol. 8, No. 11, pp. 3301-3322.
Ivics et al., "Molecular Reconstruction of Sleeping Beauty, a Tc1-like Transposon from Fish, and Its Transposition in Human Cells," Cell 1997, vol. 91, pp. 501-510.
Jackson et al.,"The mechanism of eukaryotic translation initiation and principles of its regulation," Nat Rev Mol Cell Bio (2010) vol. 11, No. 2, pp. 113-127.
Jager et al., "A rapid protocol for construction and production of high-capacity adenoviral vectors," Nat Protoc (2009) 4 (4):547-564.
Jamburuthugoda et al., "The Reverse Transcriptase Encoded by the Non-LTR Retrotransposon R2 Is as Error-Prone as That Encoded by HIV-1," J Mol Biol (2011) vol. 407, pp. 661-672.
Jang et al., "Application of prime editing to the correction of mutations and phenotypes in adult mice with liver and eye diseases," Nat Biomed Eng (Aug. 26, 2021) vol. , No. , pp. 44940.
Jayaraman et al., "Maximizing the potency of siRNA lipid nanoparticles for hepatic gene silencing in vivo," Angew Chem Int Ed Engl (2012) 51(34):8529-8533.
Jiang et al.,"Chemical modifications of adenine base editor mRNA and guide RNA expand its application scope," Nat Commun (2020) vol. 11, No. 1, pp. 1979.
Jiang et al.,"Programming large target genomic deletion and concurrent insertion via a prime editing-based method: PEDAR," Biorxiv (May 13, 2021) vol. , No. , pp. 2021.05.12.443800.
Jiang et al.,"Structures of a CRISPR-Cas9 R-loop complex primed for DNA cleavage," Science (2016) vol. 351, No. 6275, pp. 867-871.
Jinek et al., "A Programmable Dual-RNA-Guided DNA Endonuclease in Adaptive Bacterial Immunity," Science (2012) vol. 337, pp. 816-821 and Supplementary Materials.
Johansson et al.,"A thermodynamic analysis of the sequence-specific binding of RNA by bacteriophage MS2 coat protein," Proc National Acad Sci (1998) vol. 95, No. 16, pp. 9244-9249.
Jozwiakowski et al.,"A Modified Family-B Archaeal DNA Polymerase with Reverse Transcriptase Activity," Chembiochem (2011) vol. 12, No. 1, pp. 35-37.
Jumper et al.,"Highly accurate protein structure prediction with AlphaFold," Nature (Jul. 15, 2021) vol. 596, No. 7873, pp. 583-589.
Jurka et al., "Sequence patterns indicate an enzymatic involvement in integration of mammalian retroposons," Proceedings of the National Academy of Sciences (1997) vol. 94, pp. 1872-1877.
Kaida et al., "U1 snRNP protects pre-mRNAs from premature cleavage and polyadenylation," Nature (2010) 468:664-668.
Kajikawa et al.,"A new mechanism to ensure integration during LINE retrotransposition: A suggestion from analyses of the 5' extra nucleotides," Gene (2012) vol. 505, No. 2, pp. 345-351.
Kaneda et al., "Tissue-specific and high-level expression of the human tyrosine hydroxylase gene in transgenic mice," Neuron (1991) 6:583-594.
Karst et al., "Enabling high-accuracy long-read amplicon sequences using unique molecular identifiers with Nanopore or PacBio sequencing," bioRxiv (2020) doi.org/10.1101/645903, 72 pages.
Karst et al.,"High-accuracy long-read amplicon sequences using unique molecular identifiers with Nanopore or PacBio sequencing," Nat Methods (Jan. 11, 2021) vol. 18, No. 2, pp. 165-169.
Ampson B.C. (2007) Prokaryotic Reverse Transcriptases. In: Polaina J., MacCabe A.P. (eds) Industrial Enzymes. Springer, Dordrecht).
Kawashima et al.,"A novel target-specific gene delivery system combining baculovirus and sequence-specific long interspersed nuclear elements," Virus Res (2007) vol. 127, No. 1, pp. 49-60.
Kebriaei et al.,"Gene Therapy with the Sleeping Beauty Transposon System," Trends Genet (2017) vol. 33, No. 11, pp. 852-870.
Kelley et al.,"The Phyre2 web portal for protein modeling, prediction and analysis," Nat Protoc (2015) vol. 10, No. 6, pp. 845-858.
Kelly et al.,"Yeast tRNAPhe expressed in human cells can be selected by HIV-1 for use as a reverse transcription primer," Virology (2003) vol. 313, No. 2, pp. 354-363.
Kennedy et al.," Protein-responsive ribozyme switches in eukaryotic cells," Nucleic Acids Res (2014) 42 (19):12306-12321.
Keskin et al.,"Transcript RNA supports precise repair of its own DNA gene," Rna Biol (2015) vol. 13, No. 2, pp. 157-165.
Khalil et al.,"Lipid Nanoparticles for Cell-Specific in Vivo Targeted Delivery of Nucleic Acids," Biological Pharm Bulletin (2020) vol. 43, No. 4, pp. 584-595.

(56) References Cited

OTHER PUBLICATIONS

Kiani et al.,"Cas9 gRNA engineering for genome editing, activation and repression," Nat Methods (2015) vol. 12, No. 11, pp. 1051-1054.

Kiledjian, "Eukaryotic RNA 5'-End NAD+ Capping and DeNADding," Trends in Cell Biology (2018) 28:454-464.

Kim et al., "A serum response factor-dependent transcriptional regulatory program identifies distinct smooth muscle cell sublineages," Mol. Cell. Biol. (1997) 17: 2266-2278.

Kim et al., "Antibody-mediated delivery of siRNAs for anti-HIV therapy," Methods Mol Biol. 2011 721:339-353.

Kim et al.,"Digenome-seq: genome-wide profiling of CRISPR-Cas9 off-target effects in human cells," Nat Methods (2015) vol. 12, No. 3, pp. 237-243.

Kim et al.,"Increasing the genome-targeting scope and precision of base editing with engineered Cas9-cytidine deaminase fusions," Nat Biotechnol (2017) vol. 35, No. 4, pp. 371-376.

Kim et al., "Predicting the efficiency of prime editing guide RNAs in human cells," Nat Biotechnol (Sep. 21, 2020) vol. 39, No. 2, pp. 198-206.

Kim et al.,"Unbiased investigation of specificities of prime editing systems in human cells," Nucleic Acids Res (2020) vol. 48, No. 18, pp. 10576-10589.

Kita et al.,"Identification of the promoter region required for human adiponectin gene transcription: Association with CCAAT/enhancer binding protein-beta and tumor necrosis factor-alpha," Biochem. Biophys. Res. Comm. (2005) 331 (2):484-490.

Kleinstiver et al., "Monomeric site-specific nucleases for genome editing, " PNAS (2012) 109(21):8061-8066.

Kleinstiver et al.,"Engineered CRISPR-Cas9 nucleases with altered PAM specificities," Nature (2015) vol. 523, No. 7561, pp. 481-485.

Kleinstiver et al.,"High-fidelity CRISPR-Cas9 nucleases with no detectable genome-wide off-target effects," Nature (2016) vol. 529, No. 7587, pp. 490-495.

Klompe et al., "Transposon-encoded CRISPR-Cas systems direct RNA-guided DNA integration," Nature (2019) vol. 571, No. 7764, pp. 219-225.

Knight et al., "Regulation of the human GLUT4 gene promoter: interaction between a transcriptional activator and myocyte enhancer factor 2A," PNAS (2003) 00(25):14725-14730.

Koblan et al.,"Efficient C:G-to-G:C base editors developed using CRISPRi screens, target-library analysis, and machine learning," Nat Biotechnol (Jun. 28, 2021) vol. 39, No. 11, pp. 1414-1425.

Kocak et al., "Increasing the specificity of CRISPR systems with engineered RNA secondary structures," Nat Biotechnol (2019) 37(6):657-666.

Kojima et al., Recent Expansion of a New Ingi-Related Clade of Vingi non-LTR Retrotransposons in Hedgehog, Molecular Biology and Evolution (2011) vol. 28, No. 1, pp. 17-20.

Kolb et al.,"Site-directed genome modification: nucleic acid and protein modules for targeted integration and gene correction," (2005) vol. 23, No. 8, pp. 399-406.

Kolhatkar et al., "Active tumor targeting of nanomaterials using folic acid, transferrin and integrin receptors," Curr Drug Discov Technol (2011) 8:197-206.

Komor et al., "Programmable editing of a target base in genomic DNA without double-stranded DNA cleavage," Nature (2016) vol. 533, No. 7603, pp. 420-424.

Kong et al.,"Precise genome editing without exogenous donor DNA via retron editing system in human cells," Protein Cell (Aug. 17, 2021) vol. 12, No. 11, pp. 899-902.

Kotewicz et al., "Isolation of cloned Moloney murine leukemia virus reverse transcriptase lacking ribonuclease H activity," Nucleic Acids Res (1988) 16(1):265-277.

Kotin, "Prospects for the use of adeno-associated virus as a vector for human gene therapy," Human Gene Therapy (1994) 5:793-801.

Krieg, "Improved synthesis of full-length RNA probe at reduced incubation temperatures," Nucleic Acids Res (1990) 18:6463.

Krokan et al.,"Base Excision Repair," Csh Perspect Biol (2013) vol. 5, No. 4, pp. a012583.

Kuhn et al., "Phosphorothioate cap analogs increase stability and translational efficiency of RNA vaccines in immature dendritic cells and induce superior immune responses in vivo," Gene Therapy (2010) 17:961-971.

Kulmanov et al.,"DeepGO: predicting protein functions from sequence and interactions using a deep ontology-aware classifier," Bioinformatics (2018) vol. 34, No. 4, pp. 660-668.

Kuriki et al., "Structural and functional analysis of a new upstream promoter of the human FAT/CD36 gene," Biol. Pharm. Bull. (2002) 25:1476.

Kurt et al., "CRISPR C-to-G base editors for inducing targeted DNA transversions in human cells," Nat Biotechnol (Jul. 20, 2020) vol. 39, No. 1, pp. 41-46.

Kurzynska-Kokorniak et al.,"DNA-directed DNA Polymerase and Strand Displacement Activity of the Reverse Transcriptase Encoded by the R2 Retrotransposon," J Mol Biol (2007) vol. 374, No. 2, pp. 322-333.

Kwek et al., "U1 snRNA associates with TFIIH and regulates transcriptional initiation," Nature Structural Biology (2002) 9:800-805.

Kweon et al.,"Engineered prime editors with PAM flexibility," Mol Ther (Sep. 3, 2021) vol. 29, No. 6, pp. 2001-2007.

Laakso et al.,"Replicative fidelity of lentiviral vectors produced by transient transfection," Virology (2006) vol. 348, No. 2, pp. 406-417.

Labno et al., "Cytoplasmic RNA decay pathways—Enzymes and mechanisms," Biochemica et Biophysica Acta (2016) 1863:3125-3147.

Davis et al.,"Homology-directed repair of DNA nicks via pathways distinct from canonical double-strand break repair," Proc National Acad Sci (2014) vol. 111, No. 10, pp. E924-E932.

Dewannieux et al., "Role of poly(A) tail length in Alu retrotransposition," Genomics (2005) vol. 86, pp. 378-381.

Dewran Kocak et al.,"Increasing the specificity of CRISPR systems with engineered RNA secondary structures," Nat Biotechnol (2019) vol. 37, No. 6, pp. 657-666.

Doench et al.,"Optimized sgRNA design to maximize activity and minimize off-target effects of CRISPR-Cas9," Nat Biotechnol (2016) vol. 34, No. 2, pp. 184-191.

Doucet al., "A 3' Poly(A) Tract Is Required for LINE-1 Retrotransposition," Molecular Cell (2015) vol. 60, pp. 728-741.

Duncan et al., "An Adeno-Associated Viral Vector Capable of Penetrating the Mucus Barrier to Inhaled Gene Therapy," Mol Ther Methods Clin Dev (2018)9:296-304.

Egli et al.,"Re-Engineering RNA Molecules into Therapeutic Agents," Accounts Chem Res (2019) vol. 52, No. 4, pp. 1036-1047.

Eickbush et al., "Integration of Bombyx mori R2 Sequences into the 28S Ribosomal RNA Genes of Drosophila melanogaster," Molecular and Cellular Biology (2000) vol. 20, No. 1, pp. 213-223.

Eickbush et al., "Integration, Regulation, and Long-Term Stability of R2 Retrotransposons," Microbiology Spectrum (2015) vol. 3, No. 2, MDNA3-011, 20 pages.

Eickbush et al., "R2 and R2-R1 hybrid non-autonomous retrotransposons derived by internal deletions of full-length elements," Mobile DNA (2012) vol. 3, Article 10, 15 pages.

Eickbush et al., "R2 Retrotransposons Encode a Self-Cleaving Ribozyme for Processing from an rRNA Cotranscript," Molecular and Cellular Biology (2010) vol. 30, No. 13, pp. 3142-3150.

Eickbush et al., "The diversity of retrotransposons and the properties of their reverse transcriptases," Virus Res (2008) 134(1-2):221-234.

Elacqua et al, "NickSeq for genome-wide strand-specific identification of DNA single-strand break sites with single nucleotide resolution," bioRxiv (2019) doi.org/10.1101/867937, 27 pages.

Ellefson et al., "Synthetic evolutionary origin of a proofreading reverse transcriptase," Science (2016) vol. 352, No. 6293, pp. 1590-1593.

Ellington and Szostak, "In vitro selection of RNA molecules that bind specific ligands," Nature (1990) 346 (6287):818-822.

Enyeart et al.,"Biotechnological applications of mobile group II introns and their reverse transcriptases: gene targeting, RNA-seq, and non-coding RNA analysis," Mobile Dna-uk (2014) vol. 5, No. 1, pp. 2.

(56) References Cited

OTHER PUBLICATIONS

Eygeris et al., "Deconvoluting Lipid Nanoparticle Structure for Messenger RNA Delivery," Nano Lett (2020) vol. 20, pp. 4543-4549.
Fagerberg et al., "Analysis of the human tissue-specific expression by genome-wide integration of transcriptomics and antibody-based proteomics," Mol Cell Proteomics (2014) 13(2):397-406.
Feng et al., "Precise targeted integration by a chimaeric transposase zinc-finger fusion protein," Nucleic Acids Res (2010) vol. 38, No. 4, pp. 1204-1216.
Filippo et al., "Characterization of the C-terminal DNA-binding/DNA Endonuclease Region of a Group II Intron-encoded Protein," J Mol Biol (2002) vol. 324, pp. 933-951.
Filippova et al., "Guide RNA modification as a way to improve CRISPR/Cas9-based genome-editing systems," Biochimie (2019) vol. 167, No. , pp. 49-60.
Finn et al., "A Single Administration of CRISPR/Cas9 Lipid Nanoparticles Achieves Robust and Persistent In Vivo Genome Editing," Cell Rep (2018) 22(9):2227-2235.
Finn et al., "InterPro in 2017—beyond protein family and domain annotations," Nucleic Acids Research (2017) vol. 45, pp. D190-D199.
Govindaraju et al., "Endonuclease domain of non-LTR retrotransposons: loss-of-function mutants and modeling of the R2Bm endonuclease," Nucleic Acids Researh (2016) vol. 44, No. 7, pp. 3276-3287.
Finnegan, "Transposable elements—How non-LTR retrotransposons do it," Current Biology (1997) vol. 7, pp. R245-R248.
Flasch et al., "Genome-wide de novo L1 Retrotransposition Connects Endonuclease Activity with Replication," Cell (2019) vol. 177, p. 877-851.
Fonfara et al., "Creating highly specific nucleases by fusion of active restriction endonucleases and catalytically inactive homing endonucleases," Nucleic Acids Res (2012) 40(2):847-860.
Frangoul et al., "CRISPR-Cas9 Gene Editing for Sickle Cell Disease and ?-Thalassemia, " New Engl J Med (2020) vol. 384, No. 3, pp. 252-260.
Franz et al., "Analysis of tissue-specific gene delivery by recombinant adenoviruses containing cardiac-specific promoters," Cardiovasc. Res. (1997) 35:560-566.
Fu et al., "High-frequency off-target mutagenesis induced by CRISPR-Cas nucleases in human cells," Nat Biotechnol (2013) vol. 31, No. 9, pp. 822-826.
Fu et al., "Improving CRISPR-Cas nuclease specificity using truncated guide RNAs," Nat Biotechnol (2014) vol. 32, No. 3, pp. 279-284.
Fujimoto et al., "Integration of the 5' end of the retrotransposon, R2Bm, can be complemented by homologous recombination," Nucleic Acids Res (2004) vol. 32, No. 4, pp. 1555-1565.
Fujiwara et al., "Site-specific non-LTR retrotransposons," Microbiol Spectr (2015) vol. 3, No. 2, pp. MDNA3-0001-2014.
Gangopadhyay et al., "Precision control of CRISPR-Cas9 using small molecules and light," Biochemistry (2019) 58 (4):234-244.
Gao et al., "No observable guide-RNA-independent off-target mutation induced by prime editor," Biorxiv (Apr. 9, 2021) vol. , No. , pp. 2021.04.09.439109.
Gao et al., "Prime editing in mice reveals the essentiality of a single base in driving tissue-specific gene expression," Genome Biol (Mar. 16, 2021) vol. 22, No. 1, pp. 83.
Garcia-Rodriguez et al., "Use of the computer-retargeted group II intron Rmint1 of Sinorhizobium meliloti for gene targeting," Rna Biol (2014) vol. 11, No. 4, pp. 391-401.
Garneau et al., "The CRISPR/Cas bacterial immune system cleaves bacteriophage and plasmid DNA," Nature (2010) vol. 468, No. 7320, pp. 67-71.
Gasiunas et al., "A catalogue of biochemically diverse CRISPR-Cas9 orthologs," Nat Commun (2020) vol. 11, No. 1, pp. 5512.
Gaudelli et al., "Programmable base editing of A:T to G:C in genomic DNA without DNA cleavage.," Nature (2017) vol. 551, No. 7681, pp. 464-471.

George et al., "Analysis of the 5' Junctions of R2 Insertions With the 28S Gene—Implications for Non-LTR Retrotransposition," Genetics (1996) vol. 142, pp. 853-863.
Geurts et al., "Evaluating CRISPR-based prime editing for cancer modeling and CFTR repair in organoids," Life Sci Alliance (Aug. 9, 2021) vol. 4, No. 10, pp. e202000940.
Giannoukos et al., "UDiTaS(TM), a genome editing detection method for indels and genome rearrangements," Bmc Genomics (2018) vol. 19, No. 1, pp. 212.
Gilbert et al., "Multiple Fates of L1 Retrotransposition Intermediates in Cultured Human Cells," Mol Cell Biol (2005) vol. 25, No. 17, pp. 7780-7795.
Gillmore et al., "CRISPR-Cas9 In Vivo Gene Editing for Transthyretin Amyloidosis," New Engl J Med (Jun. 26, 2021) vol. 385, No. 6, pp. 493-502.
Ginn et al., "Efficient in vivo editing of OTC-deficient patient-derived primary human hepatocytes," JHEP Reports (2019) 2(1):100065, 12 pages.
Gladyshev and Arkhipova, "Rotifer rDNA-specific R9 retrotransposable elements generate an exceptionally long target site duplication upon insertion," Gene (2009) 448(2):145-150.
Gonzalez-Delgado et al., "Prokaryotic reverse transcriptases: from retroelements to specialized defense systems," Fems Microbiol Rev (May 13, 2021) vol. 45, No. 6, pp. fuab025.
Goodier et al., "Restricting retrotransposons: a review," Mobile Dna-uk (2016) vol. 7, No. 1, pp. 16.
Meers et al., "DNA repair by RNA: Templated, or not templated, that is the question," Dna Repair (2016) vol. 44, No. , pp. 17-21.
Menéndez-Arias et al., "Viral reverse transcriptases," Virus Res (2017) 234:153-176.
Meyer (Ed.), Therapeutic Protein Drug Products: Practical Approaches to formulation in the Laboratory, Manufacturing, and the Clinic, Woodhead Publishing Series (2012).
Miller et al., "Design of retrovirus vectors for transfer and expression of the human beta-globin gene," J Virol (1988) 62:4337-4345.
Miller et al., "A TALE nuclease architecture for efficient genome editing," Nat Biotechnol (2011) vol. 29, No. 2, pp. 143-148.
Miller et al., "Continuous evolution of SpCas9 variants compatible with non-G PAMs," Nat Biotechnol (2020) vol. 38, No. 4, pp. 471-481.
Millevoi et al., "A physical and functional link between splicing factors promotes pre-mRNA 3' end processing," Nucleic Acid Research (2009) 37: 4672-4683.
Mills et al., "Which transposable elements are active in the human genome," Trends in Genetics (2007) vol. 23, No. 4, pp. 183-191.
Minczuk et al., "Development of a single-chain, quasi-dimeric zinc-finger nuclease for the selective degradation of mutated human mitochondrial DNA," Nucleic Acids Res (2008) 36(12):3926-3938.
Mir et al., "Heavily and fully modified RNAs guide efficient SpyCas9-mediated genome editing," Nat Commun (2018) 9 (1):2641.
Mir et al., "Type II-C CRISPR-Cas9 Biology, Mechanism, and Application," Acs Chem Biol (2018) vol. 13, No. 2, pp. 357-365.
Mita et al., "LINE-1 protein localization and functional dynamics during the cell cycle,"eLife (2018) vol. 7, Article e30058, 35 pages.
Mita et al., "BRCA1 and S phase DNA repair pathways restrict LINE-1 retrotransposition in human cells," Nat Struct Mol Biol (2020) vol. 27, No. 2, pp. 179-191.
Mitchell et al., "InterPro in 2019: improving coverage, classification and access to protein sequence annotations," Nucleic Acids Res (2019) 47:D351-360.
Mitchell et al., "Retroviral DNA Integration: ASLV, HIV, and MLV Show Distinct Target Site Preferences," Plos Biol (2004) vol. 2, No. 8, pp. e234.
Miyagawa et al., "Identification of cis- and trans-acting factors involved in the localization of MALAT-1 noncoding RNA to nuclear speckles," RNA (2012) 18:738-751.
Miyoshi et al., "Poly(ADP-Ribose) Polymerase 2 Recruits Replication Protein A to Sites of LINE-1 Integration to Facilitate Retrotransposition," Molecular Cell (2019) vol. 75, pp. 1286-1298.
Moessler et al., "The SM 22 promoter directs tissue-specific expression in arterial but not in venous or visceral smooth muscle cells in transgenic mice," Development (1996) 122:2415-2425.

(56) References Cited

OTHER PUBLICATIONS

Mohr et al., "A Reverse Transcriptase-Cas1 Fusion Protein Contains a Cas6 Domain Required for Both Crispr Rna Biogenesis and RNA Spacer Acquisition," Molecular Cell (2019) vol. 72, No. 4, pp. 700-714.
Mok et al.,"A bacterial cytidine deaminase toxin enables CRISPR-free mitochondrial base editing," Nature (2020) vol. 583, No. 7817, pp. 631-637.
Molina et al., "Engineering a Nickase on the Homing Endonuclease I-Dmol Scaffold," J Biol Chem (2015) vol. 290, No. 30, pp. 18534-18544.
Moore and Query, "Joining of RNAs by splinted ligation," Methods in Enzymology (2000) 317:109-123.
Moran et al.,"High Frequency Retrotransposition in Cultured Mammalian Cells," Cell (1996) vol. 87, No. 5, pp. 917-927.
Morris et al.,"Automated design of CRISPR prime editors for thousands of human pathogenic variants," Biorxiv (2020) vol. , No. , pp. 2020.05.07.083444.
Morrison et al.,"The developing toolkit of continuous directed evolution," Nat Chem Biol (2020) vol. 16, No. 6, pp. 610-619.
Moss et al., "The R2 retrotransposon RNA families," RNA Biology (2011) vol. 8, No. 5, pp. 714-718.
Oh et al., "Expression of transgenes in midbrain dopamine neurons using the tyrosine hydroxylase promoter," Gene Ther (2009) 16(3):437-440.
Mukha et al., "Endonuclease domain of the Drosophila melanogaster R2 non-LTR retrotransposon and related retroelements—a new model for transposition," Frontiers in Genetics (2013) vol. 4, Article 63, 15 pages.
Mulepati et al., "Structural biology. Crystal structure of a CRISPR RNA-guided surveillance complex bound to a ssDNA target," Science (2014) vol. 345, Issue 6203, pp. 1479-1484.
Murugan et al., "The Revolution Continues: Newly Discovered Systems Expand the CRISPR-Cas Toolkit," Mol Cell (2017) vol. 68, No. 1, pp. 15-25.
Musacchio and Torchilin, "Recent developments in lipid-based pharmaceutical nanocarriers," Front Biosci (2011) 16:1388-1412.
Muzyczka, "Adeno-associated virus (AAV) vectors: will they work? ," J. Clin. Invest. (1994) 94:1351.
Muzyczka, "Use of adeno-associated virus as a general transduction vector for mammalian cells," Curr. Top. Micro. Immunol. (1992) 158:97-129.
Naldini et al.,"In Vivo Gene Delivery and Stable Transduction of Nondividing Cells by a Lentiviral Vector," Science (1996) vol. 272, No. 5259, pp. 263-267.
Nami et al., "Strategies for In Vivo Genome Editing in Nondividing Cells," Trends Biotechnol (2018) vol. 36, No. 8, pp. 770-786.
Narayanavari et al., "Sleeping Beauty transposition: from biology to applications," Crit Rev Biochem Mol Biol (2017) 52 (1):18-44.
Nelson et al.,"Engineering Delivery Vehicles for Genome Editing," Annu Rev Chem Biomol (2015) vol. 7, No. 1, pp. 44952.
Newby et al.,"Base editing of haematopoietic stem cells rescues sickle cell disease in mice," Nature (Jun. 2, 2021) vol. 595, No. 7866, pp. 295-302.
Newby et al.,"In vivo somatic cell base editing and prime editing," Mol Ther (Sep. 10, 2021) vol. 29, No. 11, pp. 3107-3124.
Nichuguti et al., "Both the Exact Target Site Sequence and a Long Poly(A) Tail Are Required for Precise Insertion of the 18S Ribosomal DNA-Specific Non-Long Terminal Repeat Retrotransposon R7Ag," Molecular and Cellular Biology (2016) vol. 36, No. 10, pp. 1494-1508.
Nicoud et al., "Development of photoreceptor-specific promoters and their utility to investigate EIAV lentiviral vector mediated gene transfer to photoreceptors," J. Gene Med. (2007) 9(12):1015-1023.
Nishimasu et al., "Crystal structure of Cas9 in complex with guide RNA and target DNA," Cell (2014) 156: P935-949.
Nishimasu et al.,"Engineered CRISPR-Cas9 nuclease with expanded targeting space," Science (2018) vol. 361, No. 6408, pp. 1259-1262.

Niu et al., "Engineering variants of the I-Scel homing endonuclease with strand-specific and site-specific DNA-nicking activity," J Mol Biol (2008) 382(1):188-202.
Nott et al., "A quantitative analysis of intron effects on mammalian gene expression," RNA (2003) 9(5):607-617.
Nott et al., "Splicing enhances translation in mammalian cells: an additional function of the exon junction complex," Genes & Development (2004) 18:210-222.
Nowak et al.,"Structural analysis of monomeric retroviral reverse transcriptase in complex with an RNA/DNA hybrid," Nucleic Acids Res (2013) vol. 41, No. 6, pp. 3874-3887.
Nunez et al.,"Cas1-Cas2 complex formation mediates spacer acquisition during CRISPR-Cas adaptive immunity," Nat Struct Mol Biol (2014) vol. 21, No. 6, pp. 528-534.
Oberdick et al., "A promoter that drives transgene expression in cerebellar Purkinje and retinal bipolar neurons," Science (1990) 248:223-226.
Yin et al.,"Structure-guided chemical modification of guide RNA enables potent non-viral in vivo genome editing," Nat Biotechnol (2017) vol. 35, No. 12, pp. 1179-1187.
Yokoyama et al., "Photoreceptor-specific activity of the human interphotoreceptor retinoid-binding protein (IRBP) promoter in transgenic mice," Exp Eye Res. (1992) 55:225-233.
Young et al., "A short, highly active photoreceptor-specific enhancer/promoter region upstream of the human hodopsin kinase gene," Invest. Ophthalmol. Vis. Sci. (2003) 44:4076-4085.
Yu et al., "Colonization of rice leaf blades by an African strain of *Xanthomonas oryzae* pv. oryzae depends on a new TAL effector that induces the rice nodulin-3 Os11N3 gene," Mol Plant Microbe Interact (2011) 24(9):1102-1113.
Yu et al., "Receptor-targeted nanocarriers for therapeutic delivery to cancer," Mol Membr Biol (2010) 27:286-298.
Zeng et al., "The initiation, propagation and dynamics of CRISPR-SpyCas9 R-loop complex," Nucleic Acids Res (2017) vol. 46, No. 1, pp. gkx1117-.
Zetsche et al., "Cpf1 is a single RNA-guided endonuclease of a class 2 CRISPR-Cas system," Cell (2015) 163:759-771.
Zhang et al., "A novel RNA motif mediates the strict nuclear localization of a long noncoding RNA," Molecular and Cellular Biology 34, 2318-2329 (2014).
Zhang et al., "Efficient construction of sequence-specific TAL effectors for modulating mammalian transcription," Nat Biotechnol (2011) 29(2):149-153.
Zhang et al., "Intron function in the nonsense-mediated decay of beta-globin mRNA: indications that pre-mRNA splicing in the nucleus can influence mRNA translation in the cytoplasm," RNA (1998) 4:801-815.
Zhang et al.,"Expanding the Potential of Mammalian Genome Engineering via Targeted DNA Integration," Acs Synth Biol (Feb. 17, 2021) vol. 10, No. 3, pp. 429-446.
Zhang et al.,"Genome Editing with mRNA Encoding ZFN, TALEN, and Cas9," Mol Ther (2019) vol. 27, No. 4, pp. 735-746.
Zhang et al., "Lipids and Lipid Derivatives for RNA Delivery," Chem Rev (Jul. 19, 2021) vol. 121, No. 20, pp. 12181-12277.
Zhao et al., "An ultraprocessive, accurate reverse transcriptase encoded by a metazoan group II intron," RNA (2018) 24: 183-195.
Zhao et al., "Crystal structures of a group II intron maturase reveal a missing link in spliceosome evolution," Nature Structural & Molecular Biology (2016) vol. 23, No. 6, pp. 558-567.
Zhao et al., "Targeted drug delivery via folate receptors," Expert Opin Drug Deliv (2008) 5:309-319.
Zhao et al.,"Bacterial retrons enable precise gene editing in human cells," Biorxiv (Mar. 29, 2021) vol. , No. , pp. 2021.03.29.437260.
Zhao et al.,"Glycosylase base editors enable C-to-A and C-to-G base changes," Nat Biotechnol (Jul. 20, 2020) vol. 39, No. 1, pp. 35-40.
Zhao et al.,"High-Efficiency Transfection of Primary Human and Mouse T Lymphocytes Using RNA Electroporation," Mol Ther (2006) vol. 13, No. 1, pp. 151-159.
Zheng et al.,"Development of a flexible split prime editor using truncated reverse transcriptase," Biorxiv (Aug. 29, 2021) vol. , No. , pp. 2021.08.26.457801.

(56) References Cited

OTHER PUBLICATIONS

Zhi et al., "Dual-AAV delivering split prime editor system for in vivo genome editing," Mol Ther (Jul. 20, 2021) vol., No. , pp.
Zimmerly et al., "A Group II Intron RNA Is a Catalytic Component of a DNA Endonuclease Involved in Intron Mobility," Cell (1995) vol. 83, pp. 529-538.
Zimmerly et al., "An Unexplored Diversity of Reverse Transcriptases in Bacteria," Microbiology Spectrum (2015) vol. 3, No. 2, Article MDNA-0058-2014, 16 pages.
Zimmermann et al., "A Completely Reimplemented MPI Bioinformatics Toolkit with a New HHpred Server at its Core," J Mol Biol (2018) vol. 430, No. 15, pp. 2237-2243.
Zingler et al., "Analysis of 5' junctions of human LINE-1 and Alu retrotransposons suggests an alternative model for 5'-end attachment requiring microhomology-mediated end-joining," Genome Res (2005) vol. 15, No. 6, pp. 780-789.

* cited by examiner

| Module | Function |
|---|---|
| A: 5' homology arm | The 5' homology arm module is complementary to the DNA sequence 5' to where the GeneWriter system nicks target DNA |
| B: Ribozyme | The ribozyme module is a sub-part of the 5' UTR sequence of the retrotransposase |
| C: 5' UTR | The 5' UTR module is the RNA sequence or interacting moiety that the driver of retrotransposase uses in the process of retrotransposition |
| D: Heterologous object sequence | The heterologous object sequence is an RNA sequence that serves as the template for the GeneWriter polypeptide to insert a desired payload into the targeted genomic location |
| E: 3' UTR | The 3' UTR module is an RNA sequence or interacting moiety that the GeneWriter polypeptide interacts with to bind to the template RNA molecule that is used in whole and/or in part as a template for retrotransposition |
| F: 3' homology arm | The 3' homology arm module is complementary to the DNA sequence 3' to where the GeneWriter system nicks target DNA |

FIG. 6

Natural linker deletion

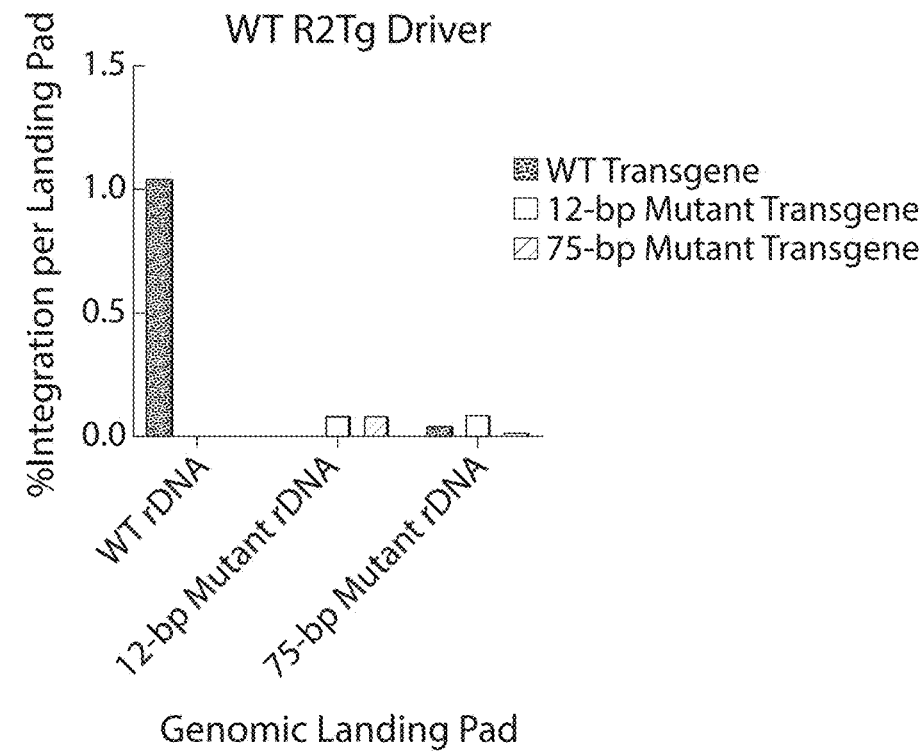
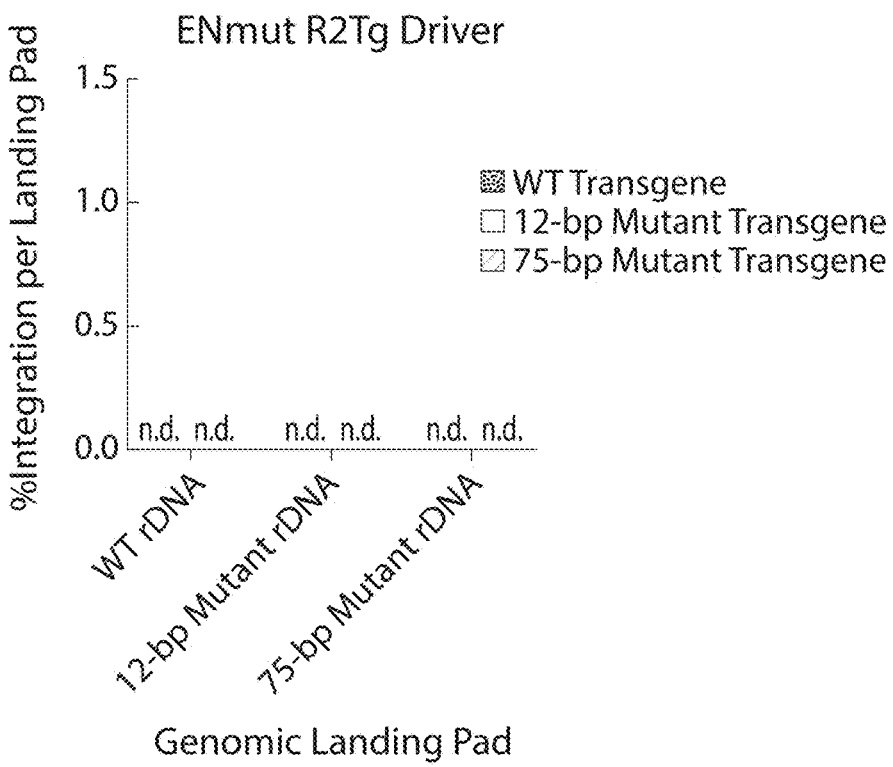
FIG. 10A

Examples of Re-targeting Gene Writer polypeptide by replacing DNA binding domain Examples of Re-targeting Gene Writer polypeptide by replacing DNA binding domain

Second Strand Nicking: Cas9-Gene Writer Fusion with 3′ extended gRNA donor
R2Tg Cas9 fusion constructs
Cas9-N863A-R2tg(RBD*, RT, EN) Gene Writer
Cas9-H840A-R2tg(RBD*, RT, EN) Gene Writer
Cas9-D10A-R2tg(RBD*, RT, EN) Gene Writer
dCas9-R2tg(RBD*, RT, EN) Gene Writer
FIG. 14A
Donor: gRNA extended at 5′ end
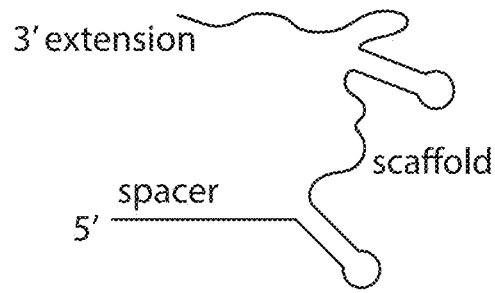
FIG. 14B

Second Strand Nicking: Cas9-Gene Writer Fusions with UTR flanked transgene
N863A-R2tg(RBD, RT, EN) Gene Writer
H840A-R2tg(RBD, RT, EN) Gene Writer
D10A-R2tg(RBD, RT, EN) Gene Writer
dCas9-R2tg(RBD, RT, EN) Gene Writer
FIG. 15A
Donor: UTR-transgene
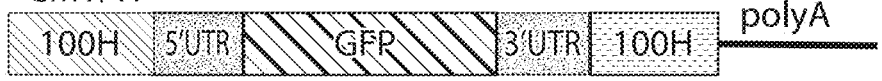
FIG. 15B

Second Strand Nicking: Cas9 Nickase

Donor: UTR-transgene

Improved Gene Writer polypeptide expression

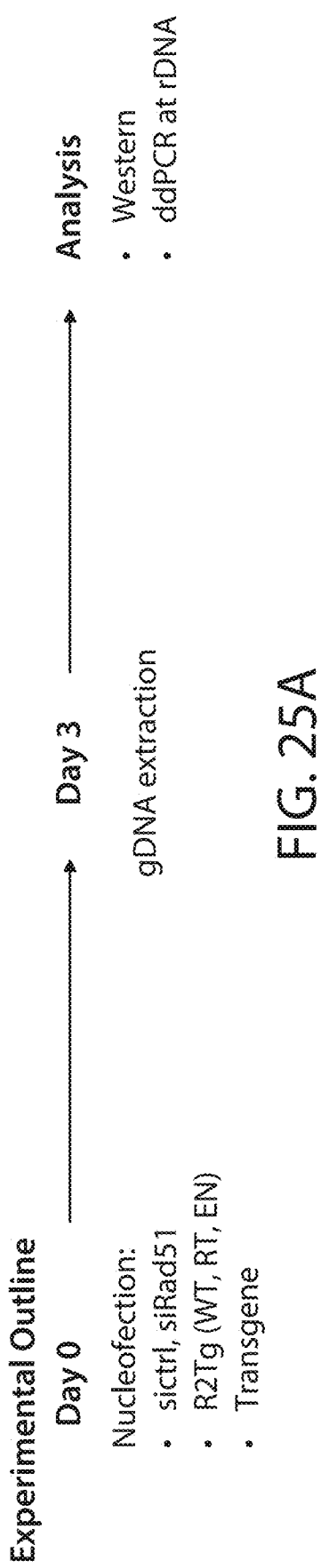
FIG. 25A
FIG. 25B
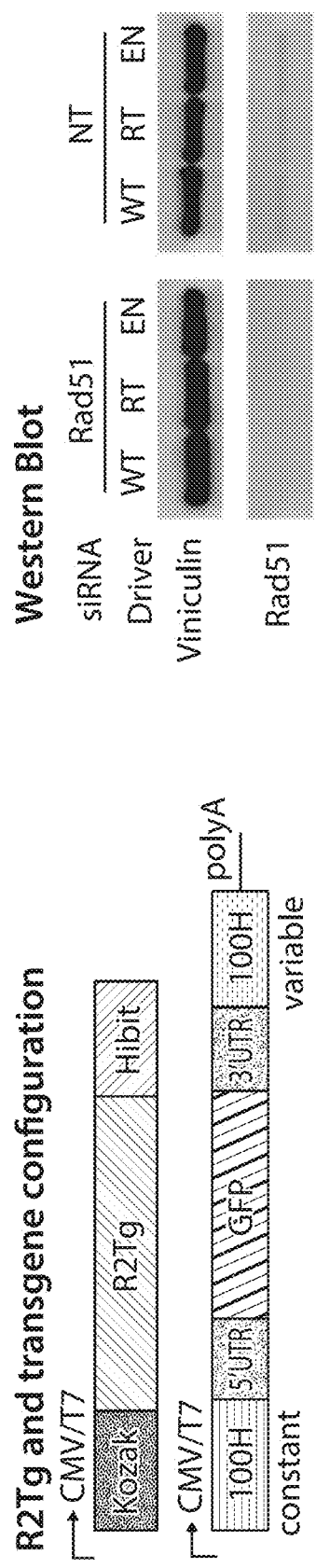
FIG. 25C

```
5'-XXXXXXXCATCATCATCATCATCATCATCATCATCATCATCATXXXXXXX-3'
3'-YYYYYYYGTAGTAGTAGTAGTAGTAGTAGTAGTAGTAGTAGTAYYYYYYY-5'

5'-XXXXXXXCATCATCATCATCATCATCATCATCATCATCATCATXXXXXXX-3'
3'-YYYYYYYGTAGTAGTAGTAGTAGTAGTAGTAGTAGTA
                                                    CATXXX-3'
                                          CATCATCAT       YYY-5'
                            RNA template    CATCAT    YYYYY
                                  5'-XXXXXXX        AY
                                                 GT
                                                  ←TPRT 5'-XXXXXXXCATCATCATCATCATCATCATCATCATCATCATCATXXXXXXX-3'
3'-YYYYYYY                   3'-YYYYYYYGTAGTAGTAGTAYYYYYYY-5'

5'-XXXXXXXCATCATCATCATXXXXXXX-3'
        3'-YYYYYYYGTAGTAGTAGTAYYYYYYY-5'
```

FIG. 30

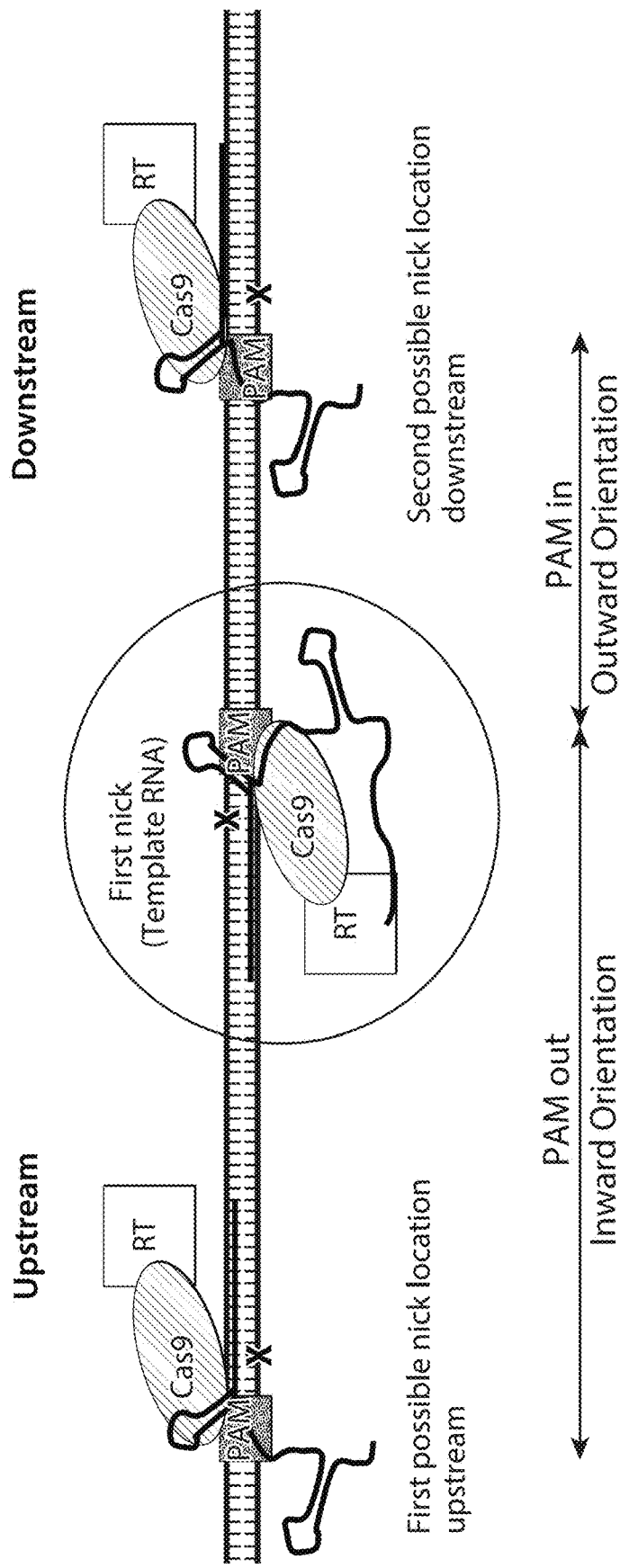

FIG. 31

A template RNA is directed to the HEK locus to introduce a CTT insertion mediated by the Gene Writer polypeptide. The first nick is indicated with a red X. To enhance the installation of the desired edit, a second nick can be placed on the opposite strand of the first nick. The second nick can be placed upstream or downstream of the first nick. In this example, the PAM orientation is "PAM-out" if the second nick is targeted upstream or "PAM-in" if the second nick is targeted downstream, with respect to the first nick.

Optimizing PAM orientation and distance between nicks to reduce undesired editing outcomes

"PAM-in" orientation leads to reduction in undesired editing outcomes resulting from the occurrence of dual nicks "PAM-out" orientation leads to reduction in undesired editing outcomes when the two nicks are separated by an increased distance

METHODS AND COMPOSITIONS FOR MODULATING A GENOME

RELATED APPLICATIONS

This application is a continuation of U.S. patent application Ser. No. 17/929,116, filed Sep. 1, 2022, which is a continuation of International Application No. PCT/US2021/020948, filed Mar. 4, 2021, which claims priority to U.S. Ser. No. 62/985,285 filed Mar. 4, 2020, U.S. Ser. No. 63/035,627 filed Jun. 5, 2020, and U.S. Ser. No. 63/067,828 filed Aug. 19, 2020, the entire contents of each of which is incorporated herein by reference.

SEQUENCE LISTING

The instant application contains a Sequence Listing which has been submitted electronically in ASCII format and is hereby incorporated by reference in its entirety. Said ASCII copy, created on Nov. 14, 2022, is named V2065-700621FT_SL.xml and is 4,441,816 bytes in size.

BACKGROUND

Integration of a nucleic acid of interest into a genome occurs at low frequency and with little site specificity, in the absence of a specialized protein to promote the insertion event. Some existing approaches, like CRISPR/Cas9, are more suited for small edits that rely on host repair pathways, and are less effective at integrating longer sequences. Other existing approaches, like Cre/loxP, require a first step of inserting a loxP site into the genome and then a second step of inserting a sequence of interest into the loxP site. There is a need in the art for improved compositions (e.g., proteins and nucleic acids) and methods for inserting, altering, or deleting sequences of interest in a genome.

SUMMARY OF THE INVENTION

This disclosure relates to novel compositions, systems and methods for altering a genome at one or more locations in a host cell, tissue or subject, in vivo or in vitro. In particular, the invention features compositions, systems and methods for inserting, altering, or deleting sequences of interest in a host genome.

Features of the compositions or methods can include one or more of the following enumerated embodiments.

ENUMERATED EMBODIMENTS

1. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence (e.g., a CRISPR spacer) that binds a target site (e.g., a second strand of a site in a target genome), (ii) optionally a sequence that binds the polypeptide, (iii) a heterologous object sequence, and (iv) a 3' target homology domain.

2. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain;
wherein:
(i) the polypeptide comprises a heterologous targeting domain (e.g., in the DBD or the endonuclease domain) that binds specifically to a sequence comprised in the target site; and/or
(ii) the template RNA comprises a heterologous homology sequence having at least 85%, 90%, 95%, 96%, 97%, 98%, 99%, or 100% homology to a sequence comprised in a target site.

3. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the RT domain comprises a sequence of Table 2 or 4 or a sequence of a reverse transcriptase domain of Table 3 or a sequence having at least 70%, 75%, 80%, 85%, 90%, 95%, 96%, 97%, 98%, or 99% identity thereto.

4. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the RT domain comprises a sequence of Table 2 or 4, or a sequence of a reverse transcriptase domain of Table 3,
wherein the RT domain further comprises a number of substitutions relative to the natural sequence, e.g., at least 1, 2, 3, 4, 5, 10, 20, 30, 40, 50, 60, 70, 80, 90, or 100 substitutions.

5. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain, wherein the system is capable of producing an insertion into the target site of at least 45, 50, 55, 60, 65, 70, 75, 80, 85, 90, 95, or 100 nucleotides.

6. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the system is capable of producing an insertion into the target site of at least 1, 2, 3, 4, 5, 10, 20, 30, 40, or 44 nucleotides.

7. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the heterologous object sequence is at least 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, or 1,000 nts in length.

8. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the heterologous object sequence is at least 1, 2, 3, 4, 5, 10, 20, 30, 40, 50, 60, 70, or 73 nucleotides in length.

9. The system of any of the preceding embodiments, wherein one or more of: the RT domain is heterologous to the DBD; the DBD is heterologous to the endonuclease domain; or the RT domain is heterologous to the endonuclease domain.

10. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the system is capable of producing a deletion into the target site of at least 81, 85, 90, 95, 100, 110, 120, 130, 140, 150, 160, 170, 180, 190, or 200 nucleotides.

11. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the system is capable of producing a deletion into the target site of at least 1, 2, 3, 4, 5, 10, 20, 30, 40, 50, 60, 70, or 80 nucleotides.

12. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein the system is capable of producing nucleotide substitutions, e.g., transitions and/or transversions, into the target site of at least 1, 2, 3, 4, 5, 6, 7, 8, 9, or 10 nucleotides.

13. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template (or DNA encoding the template RNA) comprising (e.g., from 5' to 3') (i) optionally a sequence that binds a target site (e.g., a second strand of a site in a target genome), (ii) optionally a sequence that binds the polypeptide, (iii) a heterologous object sequence, and (iv) a 3' target homology domain,
wherein (a) (ii) and/or (a) (iii) comprises a TAL domain; a zinc finger domain; or a CRISPR/Cas domain chosen from Table 10 or a functional variant (e.g., mutant) thereof.

14. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence (e.g., a CRISPR spacer) that binds a target site (e.g., a second strand of a site in a target genome), (ii) optionally a sequence that binds the polypeptide, (iii) a heterologous object sequence, and (iv) a 3' target homology domain,
wherein the endonuclease domain, e.g., nickase domain, cuts both the first strand and the second strand of the target site DNA, and wherein the cuts are separated from one another by at least 2, 3, 4, 5, 6, 7, 8, 9, 10, 15, 20, or 30 nucleotides.

15. A system for modifying DNA comprising:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds a target site (e.g., a second strand of a site in a target genome), (ii) a sequence that specifically binds the RT domain, (iii) a heterologous object sequence, and (iv) a 3' target homology domain.

16. The system of any of the preceding embodiments, wherein the template RNA further comprises a sequence that binds (a) (ii) and/or (a) (iii).

17. A system for modifying DNA comprising:
(a) a first polypeptide or a nucleic acid encoding the first polypeptide, wherein the first polypeptide comprises (i) a reverse transcriptase (RT) domain and (ii) optionally a DNA-binding domain,
(b) a second polypeptide or a nucleic acid encoding the second polypeptide, wherein the second polypeptide comprises (i) a DNA-binding domain (DBD); (ii) an endonuclease domain, e.g., a nickase domain; and
(c) a template RNA (or DNA encoding the template RNA) comprising (e.g., from 5' to 3') (i) optionally a sequence that binds the second polypeptide (e.g., that binds (b) (i) and/or (b) (ii)), (ii) optionally a sequence that binds the first polypeptide (e.g., that specifically binds the RT domain), (iii) a heterologous object sequence, and (iv) a 3' target homology domain.

18. A system for modifying DNA comprising:
(a) a polypeptide or a nucleic acid encoding the polypeptide, wherein the polypeptide comprises (i) a reverse transcriptase (RT) domain, and (ii) a DNA-binding domain (DBD); and (iii) an endonuclease domain, e.g., a nickase domain;
(b) a first template RNA (or DNA encoding the RNA) comprising (e.g., from 5' to 3') (i) a sequence that binds the polypeptide (e.g., that binds (a) (ii) and/or (a) (iii)) and (ii) a sequence that binds a target site (e.g., a second strand of a site in a target genome), (e.g., wherein the first RNA comprises a gRNA);
(c) a second template RNA (or DNA encoding the RNA) comprising (e.g., from 5' to 3') (i) optionally a sequence that binds the polypeptide (e.g., that specifically binds the RT domain), (ii) a heterologous object sequence, and (iii) a 3' target homology domain.

19. The system of any of the preceding embodiments, wherein the second template RNA comprises (i).

20. The system of any of the preceding embodiments, wherein the first template RNA comprises a first conjugating domain and the second template RNA comprises a second conjugating domain.

21. The system of any of the preceding embodiments, wherein the first and second conjugating domains are capable of hybridizing to one another, e.g., under stringent conditions, e.g., wherein the stringent conditions for hybridization includes hybridization in 4× sodium chloride/sodium citrate (SSC), at about 65° C., followed by a wash in 1×SSC, at about 65° C.

22. The system of any of the preceding embodiments, wherein the first and second conjugating domains may be joined covalently, e.g., by splint ligation, e.g., by the method described by Moore, M. J., & Query, C. C. Methods in Enzymology, 317, 109-123, 2000.

23. The system of any of the preceding embodiments, wherein association of the first conjugating domain and the second conjugating domain colocalizes the first template RNA and the second template RNA.

24. The system of any of the preceding embodiments, wherein the reverse transcriptase (RT) domain is from a retrotransposon, or a sequence having at least 85%, 90%, 95%, 96%, 97%, 98%, or 99% identity thereto.

25. A system for modifying DNA comprising:
(a) a polypeptide or a nucleic acid encoding the polypeptide, wherein the polypeptide comprises (i) a reverse transcriptase (RT) domain from a retrotransposon, or a sequence having at least 85%, 90%, 95%, 96%, 97%, 98%, or 99% identity thereto, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence (e.g., a CRISPR spacer) that binds a target site (e.g., a second strand of a site in a target genome), (ii) optionally a sequence that binds the polypeptide, (iii) a heterologous object sequence, and (iv) a 3' target homology domain.

26. The system of any of the preceding embodiments, wherein the template RNA comprises (i).

27. The system of any of the preceding embodiments, wherein the template RNA comprises (ii).

28. The system of any of the preceding embodiments, wherein the template RNA comprises (i) and (ii).

29. The system of any of the preceding embodiments, wherein the reverse transcriptase domain comprises an amino acid sequence according to a reverse transcriptase domain of any of Table 5, Table 6, Table 8, Table 9, or Table 1, or a sequence having at least 70%, 75%, 80%, 85%, 90%, 95%, 96%, 97%, 98%, or 99% identity thereto, or a functional fragment thereof.

30. A template RNA (or DNA encoding the template RNA) comprising a targeting domain (e.g., a heterologous targeting domain) that binds specifically to a sequence comprised in the target DNA molecule (e.g., a genomic DNA), a sequence that specifically binds an RT domain of a polypeptide, and a heterologous object sequence.

31. A template RNA (or DNA encoding the template RNA) comprising (e.g., from 5' to 3') (i) optionally a sequence that binds a target site (e.g., a second strand of a site in a target genome), (ii) optionally a sequence that binds an endonuclease and/or a DNA-binding domain of a polypeptide, (iii) a heterologous object sequence, and (iv) a 3' target homology domain.

32 The template RNA of any of the preceding embodiments, wherein the template RNA comprises (i).

33. The template RNA of any of the preceding embodiments, wherein the template RNA comprises (ii).

34. A template RNA (or DNA encoding the template RNA) comprising (e.g., from 5' to 3') (i) a sequence that binds a target site (e.g., a second strand of a site in a target genome), (ii) a sequence that binds an endonuclease and/or a DNA-binding domain of a polypeptide, (iii) a heterologous object sequence, and (iv) a 3' target homology domain,
wherein (i) comprises a nucleic acid sequence with complementarity to a sequence of a gene of any of Tables 27-30 or with no more than 1, 2, 3, 4, or 5 differences from said sequence having said complementarity.

35. A template RNA (or DNA encoding the template RNA) comprising (e.g., from 5' to 3') (i) a sequence that binds a target site (e.g., a second strand of a site in a target genome), (ii) a sequence that specifically binds an RT domain of a polypeptide, (iii) a heterologous object sequence, and (iv) a 3' target homology domain.

36. The template RNA of any of the preceding embodiments, further comprising (v) a sequence that binds an endonuclease and/or a DNA-binding domain of a polypeptide (e.g., the same polypeptide comprising the RT domain).

37. The template RNA of any of the preceding embodiments, wherein the RT domain comprises a sequence selected of Table 2 or 4 or a sequence of a reverse transcriptase domain of Table 3 or a sequence that has at least 70%, 75%, 80%, 85%, 90%, 95%, 96%, 97%, 98%, or 99% identity thereto.

38. The template RNA of any of the preceding embodiments, wherein the RT domain comprises a sequence selected of Table 2 or 4 or a sequence of a reverse transcriptase domain of Table 3, wherein the RT domain further comprises a number of substitutions relative to the natural sequence, e.g., at least 1, 2, 3, 4, 5, 10, 20, 30, 40, 50, 60, 70, 80, 90, or 100 substitutions.

39. The template RNA of any of the preceding embodiments, wherein the sequence of (ii) specifically binds the RT domain.

40. The template RNA of any of the preceding embodiments, wherein the sequence that specifically binds the RT domain is a sequence, e.g., a UTR sequence, of Table 2 or from a domain of Table 3, or a sequence having at least 70, 75, 80, 85, 90, 95, or 99% identity thereto.

41. A template RNA (or DNA encoding the template RNA) comprising from 5' to 3': (ii) a sequence that binds an endonuclease and/or a DNA-binding domain of a polypeptide, (i) a sequence that binds a target site (e.g., a second strand of a site in a target genome), (iii) a heterologous object sequence, and (iv) a 3' target homology domain.

42. A template RNA (or DNA encoding the template RNA) comprising from 5' to 3': (iii) a heterologous object sequence, (iv) a 3' target homology domain, (i) a sequence that binds a target site (e.g., a second strand of a site in a target genome), and (ii) a sequence that binds an endonuclease and/or a DNA-binding domain of a polypeptide.

43. The system or template RNA of any of the preceding embodiments, wherein the template RNA, first template RNA, or second template RNA comprises a sequence that specifically binds the RT domain.

44. The system or template RNA of any of the preceding embodiments, wherein the sequence that specifically binds the RT domain is disposed between (i) and (ii).

45. The system or template RNA of any of the preceding embodiments, wherein the sequence that specifically binds the RT domain is disposed between (ii) and (iii).

46. The system or template RNA of any of the preceding embodiments, wherein the sequence that specifically binds the RT domain is disposed between (iii) and (iv).

47. The system or template RNA of any of the preceding embodiments, wherein the sequence that specifically binds the RT domain is disposed between (iv) and (i).

48. The system or template RNA of any of the preceding embodiments, wherein the sequence that specifically binds the RT domain is disposed between (i) and (iii).

49. A system for modifying DNA, comprising:
(a) a first template RNA (or DNA encoding the first template RNA) comprising (i) sequence that binds an endonuclease domain, e.g., a nickase domain, and/or a DNA-binding domain (DBD) of a polypeptide, and (ii) a sequence that binds a target site (e.g., a second strand of a site in a target genome), (e.g., wherein the first RNA comprises a gRNA);
(b) a second template RNA (or DNA encoding the second template RNA) comprising (i) a sequence that specifically binds a reverse transcriptase (RT) domain of a polypeptide (e.g., the polypeptide of (a)), (ii) a heterologous object sequence, and (iii) 3' target homology domain.

50. The system of any of the preceding embodiments, wherein the nucleic acid encoding the first template RNA and the nucleic acid encoding the second template RNA are two separate nucleic acids.

51. The system of any of the preceding embodiments, wherein the nucleic acid encoding the first template RNA and the nucleic acid encoding the second template RNA are part of the same nucleic acid molecule, e.g., are present on the same vector.

52. The system of any of the preceding embodiments, wherein the system is capable of producing an insertion into the target site of at least 45, 50, 55, 60, 65, 70, 75, 80, 85, 90, 95, or 100 nucleotides.

53. The system of any of the preceding embodiments, wherein the heterologous object sequence is at least 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, or 1,000 nts in length.

54. The system of any of the preceding embodiments, wherein the system is capable of producing a deletion into the target site of at least 81, 85, 90, 95, 100, 110, 120, 130, 140, 150, 160, 170, 180, 190, or 200 nucleotides.

55. The system of any of the preceding embodiments, wherein one or both of the template RNA and the RNA encoding the polypeptide of (a) comprises chemically modified mRNA, e.g., mRNA comprising a chemically modified base, e.g., mRNA comprising 5-methoxyuridine.

56. The system of any of the preceding embodiments, wherein one or both of the template RNA and the RNA encoding the polypeptide of (a) comprises chemically modified RNA, e.g., RNA comprising a chemically modified base, e.g., RNA comprising 2'-o-methyl phosphorothioate.

57. The system of any of the preceding embodiments, wherein one or both of the template RNA and the RNA encoding the polypeptide of (a) comprises chemically modified RNA, e.g., RNA comprising a chemically modified base, e.g., 2'-o-methyl phosphorothioate, at one or both of the 3, 4, or 5 bases at the 5' or 3' end of the RNA.

58. A polypeptide or a nucleic acid encoding the polypeptide, wherein the polypeptide comprises (i) a reverse transcriptase (RT) domain, (ii) a DNA-binding domain (DBD); and (iii) an endonuclease domain; wherein the DBD and/or the endonuclease domain comprise a heterologous targeting domain that binds specifically to a sequence comprised in a target DNA molecule (e.g., a genomic DNA).

59. A polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain, wherein the RT domain has a sequence of Table 2 or 4 or a sequence of a reverse transcriptase domain of Table 3, or a sequence having at least 70%, 75%, 80%, 85%, 90%, 95%, 96%, 97%, 98%, or 99% identity thereto.

60. A polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain, wherein the RT domain has a sequence of Table 2 or 4 or a sequence of a reverse transcriptase domain of Table 3, wherein the RT domain further comprises a number of substitutions relative to the natural sequence, e.g., at least 1, 2, 3, 4, 5, 10, 20, 30, 40, 50, 60, 70, 80, 90, or 100 substitutions.

61. The polypeptide of any of the preceding embodiments, wherein the polypeptide is encoded by an mRNA, e.g., a chemically modified mRNA, e.g., an mRNA comprising a chemically modified base, e.g., an mRNA comprising 5-methoxyuridine.

62. The polypeptide of any of the preceding embodiments, wherein the polypeptide is encoded by an mRNA, e.g., a chemically modified mRNA, e.g., an mRNA comprising a chemically modified base, e.g., an mRNA comprising N1-Methyl-Psuedouridine.

63. A system for modifying DNA, comprising:
(a) a first polypeptide or a nucleic acid encoding the polypeptide, wherein the polypeptide comprises a reverse transcriptase (RT) domain, wherein the RT domain has a sequence of Table 2 or 4 or a sequence of a reverse transcriptase domain of Table 3, or a sequence having at least 70%, 75%, 80%, 85%, 90%, 95%, 96%, 97%, 98%, or 99% identity thereto; and optionally a DNA-binding domain (DBD) (e.g., a first DBD); and
(b) a second polypeptide or a nucleic acid encoding the polypeptide, wherein the polypeptide comprises (i) a DBD (e.g., a second DBD); and (ii) an endonuclease domain, e.g., a nickase domain.

64. A system for modifying DNA, comprising:
(a) a first polypeptide or a nucleic acid encoding the polypeptide, wherein the polypeptide comprises a reverse transcriptase (RT) domain, wherein the RT domain has a sequence of Table 2 or 4 or a sequence of a reverse transcriptase domain of Table 3, wherein the RT domain further comprises a number of substitutions relative to the natural sequence, e.g., at least 1, 2, 3, 4, 5, 10, 20, 30, 40, 50, 60, 70, 80, 90, or 100 substitutions; and optionally a DNA-binding domain (DBD) (e.g., a first DBD); and
(b) a second polypeptide or a nucleic acid encoding the polypeptide, wherein the polypeptide comprises (i) a DBD (e.g., a second DBD); and (ii) an endonuclease domain, e.g., a nickase domain.

65. The system of any of the preceding embodiments, wherein the nucleic acid encoding the first polypeptide and the nucleic acid encoding the second polypeptide are two separate nucleic acids.

66. The system of any of the preceding embodiments, wherein the nucleic acid encoding the first polypeptide and the nucleic acid encoding the second polypeptide are part of the same nucleic acid molecule, e.g., are present on the same vector.

67. A reaction mixture comprising:
a cell and any system, polypeptide, template RNA, or DNA encoding the same of any preceding embodiment.

68. A reaction mixture comprising:
a DNA comprising a target site and any system, polypeptide, template RNA, or DNA encoding the same of any preceding embodiment.

69. A kit comprising:
the system, polypeptide, template RNA, or DNA encoding the same of any preceding embodiment;
instructions for using the system, polypeptide, template RNA, or DNA encoding the same; and
one or both of a cell or a DNA comprising a target site.

70. The system, kit, polypeptide, or reaction mixture of any of the preceding embodiments, wherein the DBD comprises a TAL domain.

71. The system, kit, polypeptide, or reaction mixture of any of the preceding embodiments, wherein the DBD comprises a zinc finger domain.

72. The system, kit, polypeptide, or reaction mixture of any of the preceding embodiments, wherein the DBD comprises a CRISPR/Cas domain.

73. The system, kit, polypeptide, or reaction mixture of any of the preceding embodiments, wherein the endonuclease domain is a nickase domain.

74. The system, kit, polypeptide, or reaction mixture of any of the preceding embodiments, wherein the endonuclease domain comprises a CRISPR/Cas domain.

75. The system, kit, polypeptide, or reaction mixture of any of the preceding embodiments, wherein the CRISPR/Cas domain comprises a domain or polypeptide from Table 10, or a functional variant (e.g., mutant) thereof.

76. The system, kit, polypeptide, or reaction mixture of any of the preceding embodiments, wherein the CRISPR/Cas domain comprises a domain or polypeptide from genus/species from Table 10.

77. The system, kit, polypeptide, or reaction mixture of any of the preceding embodiments, wherein the endonuclease domain comprises a type IIs nuclease (e.g., FokI), a Holliday Junction resolvase, or a double-stranded DNA nuclease comprising an alteration that abrogates its ability to cut one strand (e.g., transforming the double-stranded DNA nuclease into a nickase).

78. The system, kit, polypeptide, or reaction mixture of any of the preceding embodiments, wherein the RT domain comprises a reverse transcriptase or functional fragment or variant thereof chosen from Table 2 or 4 or a sequence of a reverse transcriptase domain of Table 3.

79. The system, kit, polypeptide, or reaction mixture of any of the preceding embodiments, wherein the RT domain comprises one or more mutations (e.g., an insertion, deletion, or substitution) relative to a naturally occurring RT domain or an RT domain or functional fragment chosen from Table 2 or 4 or a sequence of a reverse transcriptase domain of Table 3, or sequence listing SEQ ID NO: 1-67 from WO2018089860A1, incorporated herein by reference.

80. The system, kit, polypeptide, or reaction mixture of any of the preceding embodiments, wherein the one or more mutations are chosen from D200N, L603W, T330P, D524G, E562Q, D583N, P51L, S67R, E67K, T197A, H204R, E302K, F309N, W313F, L435G, N454K, H594Q, L671P, E69K or D653N in the RT domain of murine leukemia virus reverse transcriptase or a corresponding mutation at a corresponding position of another RT domain.

81. The system, kit, polypeptide, or reaction mixture of any of the preceding embodiments, wherein the one or more mutations are chosen from WO2018089860A1, incorporated herein by reference (e.g., a C952S, and/or C956S, and/or C952S, C956S (double mutant), and/or C969S, and/or H970Y, and/or R979Q, and/or R976Q, and/or R1071S, and/or R328A, and/or R329A, and/or Q336A, and/or R328A, R329A, Q336A (triple mutant), and/or G426A, and/or D428A, and/or G426A,D428A (double mutant) mutation, and/or any combination thereof; positions relative to WO2018089860A1 SEQ ID NO: 52), in the RT domain of R2Bm retrotransposase or a corresponding mutation at a corresponding position of another RT domain.

82. The system, kit, polypeptide, or reaction mixture of any of the preceding embodiments, wherein the DBD and/or the endonuclease domain (e.g., a CRISPR/Cas domain)

comprises a domain or polypeptide from Table 10, or a functional variant (e.g., mutant) thereof.

83. The system, kit, polypeptide, or reaction mixture of any of the preceding embodiments, wherein the DBD and/or the endonuclease domain (e.g., CRISPR/Cas domain) comprises a domain or polypeptide from Table 10.

84. The system, kit, polypeptide, or reaction mixture of any of the preceding embodiments, wherein the RT domain and the DBD and/or the endonuclease domain (e.g., CRISPR/Cas domain) are fused via a peptide linker, e.g., a linker of Table [56.

85. The system, kit, polypeptide, or reaction mixture of any of the preceding embodiments, wherein the linker is about 6-18, 8-16, 10-14, or 12 amino acids in length.

86. The system, kit, polypeptide, or reaction mixture of any of the preceding embodiments, wherein the linker is comprises glycine and serine, e.g., wherein the linker comprises solely glycine and serine residues, e.g., wherein the linker comprises a sequence of GSSGSS (SEQ ID NO: 1736).

87. The system, kit, polypeptide, or reaction mixture of any of the preceding embodiments, wherein the linker comprises a sequence according Table 56, e.g, linked 10 as disclosed in Table 56 to or a sequence having no more then 1, 2, or 3 substitutions relative thereto.

88. The system, kit, polypeptide, or reaction mixture of any of the preceding embodiments, wherein the CRISPR/Cas domain comprises Cas9, e.g., wild-type Cas9 or nickase Cas9.

89. The system, kit, polypeptide, or reaction mixture of any of the preceding embodiments, wherein the RT domain is positioned C-terminal of the DBD in the polypeptide.

90. The system, kit, polypeptide, or reaction mixture of any of the preceding embodiments, wherein the RT domain is positioned C-terminal of the nickase domain in the polypeptide.

91. The system, kit, polypeptide, or reaction mixture of any of the preceding embodiments, wherein the RT domain is positioned N-terminal of the DBD in the polypeptide.

92. The system, kit, polypeptide, or reaction mixture of any of the preceding embodiments, wherein the RT domain is positioned N-terminal of the nickase domain in the polypeptide.

93. The system, kit, polypeptide, or reaction mixture of any of the preceding embodiments, wherein the polypeptide comprises a linker, e.g., positioned between the RT domain and the DBD or the RT domain and the nickase domain.

94. The system, kit, polypeptide, or reaction mixture of any of the preceding embodiments, wherein the linker is between 2-50, e.g., 2-30, amino acids in length.

95. The system, kit, polypeptide, or reaction mixture of any of the preceding embodiments, wherein the linker is a flexible linker, e.g., comprising Gly and/or Ser residues.

96. The system, kit, template RNA, or reaction mixture of any of the preceding embodiments, wherein the 3' target homology domain is complementary to a sequence adjacent to a site to be modified by the system, or comprises no more than 1, 2, 3, 4, or 5 mismatches to a sequence complementary to the sequence adjacent to a site to be modified by the system.

97. The system, kit, template RNA, or reaction mixture of any of the preceding embodiments, wherein the 3' target homology domain is more than 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 110, 120, 130, 140, 150, 160, 170, 180, 190, or 200 nucleotides long, (e.g., 4, 5, 6, 7, 8, 9, 10, 11, 12, 13, 14, 15, 16, 17, 18, 19, 20, 21, 22, 23, 24, 25, 26, 27, 28, 29, or 30 nucleotides long).

98. The system, kit, template RNA, or reaction mixture of any of the preceding embodiments, wherein the 3' target homology domain is no more than 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 110, 120, 130, 140, 150, 160, 170, 180, 190, or 200 nucleotides long.

99. The system, kit, template RNA, or reaction mixture of any of the preceding embodiments, wherein the heterologous object sequence is complementary to a site to be modified by the system except at the position or positions to be modified.

100. The system, kit, template RNA, or reaction mixture of any of the preceding embodiments, wherein the heterologous object sequence is complementary to a site to be modified by the system except at positions encoding a sequence to be inserted to the site.

101. The system, kit, template RNA, or reaction mixture of any of the preceding embodiments, wherein the heterologous object sequence is complementary to a site to be modified by the system except the heterologous object sequence does not comprise nucleotides encoding a sequence to be deleted at the site.

102. The system, kit, template RNA, or reaction mixture of any of the preceding embodiments, wherein the heterologous object sequence is more than 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides long, (e.g., 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides long).

103. The system, kit, template RNA, or reaction mixture of any of the preceding embodiments, wherein the heterologous object sequence is no more than 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides long.

104. The system, kit, template RNA, or reaction mixture of any of the preceding embodiments, wherein the heterologous object sequence substitutes at least 1, 2, 3, 4, 5, 6, 7, 8, 9, or 10 nucleotides for non-target site nucleotides.

105. The system, kit, template RNA, or reaction mixture of any of the preceding embodiments, wherein the heterologous object sequence inserts at least 1, 2, 3, 4, 5, 6, 7, 8, 9, 10, 15, 20, 25, 30, 35, 40, 45, 50, 55, 60, 65, 70, 75, 80, 85, 90, 95, or 100 nucleotides, or at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases into the target site.

106. The system, kit, template RNA, or reaction mixture of any of the preceding embodiments, wherein the heterologous object sequence deletes at least 1, 2, 3, 4, 5, 6, 7, 8, 9, 10, 15, 20, 25, 30, 35, 40, 45, 50, 55, 60, 65, 70, 75, 80, 81, 85, 90, 95, 100, 110, 120, 130, 140, 150, 160, 170, 180, 190, or 200 nucleotides.

107. The system, kit, template RNA, or reaction mixture of any of the preceding embodiments, wherein the heterologous object sequence is separated from the sequence that binds the polypeptide (e.g., that binds the endonuclease domain and/or DBD domain) by at least 1, 2, 3, 4, 5, 6, 7, 8, 9, 10, 15, 20, 25, or 30 nucleotides.

108. The system, kit, template RNA, or reaction mixture of any of the preceding embodiments, wherein the sequence that binds the polypeptide (e.g., that binds the endonuclease domain and/or DBD domain) is at least 45, 50, 55, 60, 65, 70, 75, 80, 85, 90, 95, 100, 110, 120, or 130 nucleotides long (and optionally no more than 150, 140, 130, 120, 110, 100, 90, 85, or 80 nucleotides long).

109. The system, kit, template RNA, or reaction mixture of any of the preceding embodiments, wherein the sequence that binds the polypeptide binds the endonuclease domain and/or DBD domain.

110. The system, kit, template RNA, or reaction mixture of any of the preceding embodiments, wherein the sequence that binds the polypeptide comprises a sequence according to one or both of a predicted 5' UTR and a predicted 3' UTR of Table 4 or Table 8, or a sequence having at least 70%, 75%, 80%, 85%, 90%, 95%, 96%, 97%, 98%, or 99% identity thereto, or functional fragment thereof.

111. The system, kit, template RNA, or reaction mixture of any of the preceding embodiments, wherein the sequence that binds the polypeptide (e.g., that binds the endonuclease domain and/or DBD domain) comprises a gRNA.

112. The system, kit, template RNA, or reaction mixture of any of the preceding embodiments, wherein the sequence that binds a target site (e.g., a second strand of a site in a target genome) is at least 15, 16, 17, 18, 19, 20, 21, 22, 23, 24, 25, 30, 35, 40, 45, 50, 55, 60, 65, 70, 75, 80, 85, 90, 95, 100, 110, 120, or 130 nucleotides long (and optionally no more than 150, 140, 130, 120, 110, 100, 90, 80, 70, 60, 50, 40, 30, 29, 28, 27, 26, 25, 24, 23, 22, 21, or 20 nucleotides long), e.g., is 17, 18, 19, 20, 21, 22, 23, or 24 nucleotides long.

113. The system, kit, template RNA, or reaction mixture of any of the preceding embodiments, wherein the sequence that binds a target site is complementary to the second strand of the target site, or comprises no more than 1, 2, 3, 4, or 5 mismatches to a sequence complementary to the second strand of the target site.

114. The system, kit, template RNA, or reaction mixture of any of the preceding embodiments, wherein the sequence that binds a target site (e.g., a second strand of a site in a target genome) is separated from the sequence that binds the polypeptide (e.g., that binds the endonuclease domain and/or DBD domain) by at least 1, 2, 3, 4, 5, 6, 7, 8, 9, 10, 15, 20, 25, or 30 nucleotides.

115. The system, kit, template RNA, or reaction mixture of any of the preceding embodiments, further comprising a second strand-targeting gRNA that directs the endonuclease domain (e.g., nickase) domain to nick the second strand (e.g., in the target genome).

116. The system, kit, template RNA, or reaction mixture of any of the preceding embodiments, wherein the template RNA further comprises the second strand-targeting gRNA.

117. The system, kit, template RNA, or reaction mixture of any of the preceding embodiments, wherein the second strand-targeting gRNA is disposed on a separate nucleic acid from the template RNA.

118. The system, kit, template RNA, or reaction mixture of any of the preceding embodiments, wherein the gRNA directs the endonuclease domain (e.g., nickase) domain to nick the second strand (e.g., in the target genome) at a site that is at least 10, 15, 20, 25, 30, 35, 40, 45, 50, 55, 60, 65, 70, 75, 80, 85, 90, 95, 100, 105, 110, 115, 120, 125, 130, 135, 140, 145, or 150 nucleotides 5' or 3' of the target site modification (e.g., the nick on the first strand).

119. The system, kit, template RNA, or reaction mixture of any of the preceding embodiments, wherein the gRNA specifically binds the edited strand.

120. The system, method, kit, template RNA, or reaction mixture of any of the preceding embodiments, wherein the polypeptide comprises a heterologous targeting domain that binds specifically to a sequence comprised in the target DNA molecule (e.g., a genomic DNA).

121. The system, method, kit, template RNA, or reaction mixture of any of the preceding embodiments, wherein the heterologous targeting domain binds to a different nucleic acid sequence than the unmodified polypeptide.

122. The system, method, kit, template RNA, or reaction mixture of any of the preceding embodiments, wherein the polypeptide does not comprise a functional endogenous targeting domain (e.g., wherein the polypeptide does not comprise an endogenous targeting domain).

123. The system, method, kit, template RNA, or reaction mixture of any of the preceding embodiments, wherein the heterologous targeting domain comprises a zinc finger (e.g., a zinc finger that binds specifically to the sequence comprised in the target DNA molecule).

124. The system, method, kit, template RNA, or reaction mixture of any of the preceding embodiments, wherein the heterologous targeting domain comprises a Cas domain (e.g., a Cas9 domain, or a mutant or variant thereof, e.g., a Cas9 domain that binds specifically to the sequence comprised in the target DNA molecule).

125. The system, method, kit, template RNA, or reaction mixture of any of the preceding embodiments, wherein the Cas domain is associated with a guide RNA (gRNA).

126. The system, method, kit, template RNA, or reaction mixture of any of the preceding embodiments, wherein the heterologous targeting domain comprises an endonuclease domain (e.g., a heterologous endonuclease domain).

127. The system, method, kit, template RNA, or reaction mixture of any of the preceding embodiments, wherein the endonuclease domain comprises a Cas domain (e.g., a Cas9 or a mutant or variant thereof).

128. The system, method, kit, template RNA, or reaction mixture of any of the preceding embodiments, wherein the Cas domain is associated with a guide RNA (gRNA).

129. The system, method, kit, template RNA, or reaction mixture of any of the preceding embodiments, wherein the endonuclease domain comprises a Fok1 domain.

130. The system, method, kit, template RNA, or reaction mixture of any of the preceding embodiments, wherein the template nucleic acid molecule comprises at least one (e.g., one or two) heterologous homology sequence having at least 85%, 90%, 95%, 96%, 97%, 98%, 99%, or 100% homology to a sequence comprised in a target DNA molecule (e.g., a genomic DNA).

131. The system, method, kit, template RNA, or reaction mixture of any of the preceding embodiments, wherein one of the at least one heterologous homology sequences is positioned at or within about 1, 2, 3, 4, 5, 6, 7, 8, 9, 10, 15, 20, 25, 30, 35, 40, 45, 50, 60, 70, 80, 90, or 100 nucleotides of the 5' end of the template nucleic acid molecule.

132. The system, method, kit, template RNA, or reaction mixture of any of the preceding embodiments, wherein one of the at least one heterologous homology sequences is positioned at or within about 1, 2, 3, 4, 5, 6, 7, 8, 9, 10, 15, 20, 25, 30, 35, 40, 45, 50, 60, 70, 80, 90, or 100 nucleotides of the 3' end of the template nucleic acid molecule.

133. The system, method, kit, template RNA, or reaction mixture of any of the preceding embodiments, wherein the heterologous homology sequence binds within 1, 2, 3, 4, 5, 6, 7, 8, 9, or 10 nucleotides of a nick site (e.g., produced by a nickase, e.g., an endonuclease domain, e.g., as described herein) in the target DNA molecule.

134. The system, method, kit, template RNA, or reaction mixture of any of the preceding embodiments, wherein the heterologous homology sequence has less than 50%, 40%, 30%, 20%, 10%, 5%, 4%, 3%, 2%, or 1% sequence identity with a nucleic acid sequence complementary to an endogenous homology sequence of an unmodified form of the template RNA.

135. The system, method, kit, template RNA, or reaction mixture of any of the preceding embodiments, wherein the heterologous homology sequence has having at least 85%, 90%, 95%, 96%, 97%, 98%, 99%, or 100% homology to a sequence of the target DNA molecule that is different the sequence bound by an endogenous homology sequence (e.g., replaced by the heterologous homology sequence).

136. The system, method, kit, template RNA, or reaction mixture of any of the preceding embodiments, wherein the heterologous homology sequence comprises a sequence (e.g., at its 3' end) having at least 85%, 90%, 95%, 96%, 97%, 98%, 99%, or 100% homology to a sequence positioned 5' to a nick site of the target DNA molecule (e.g., a site nicked by a nickase, e.g., an endonuclease domain as described herein).

137. The system, method, kit, template RNA, or reaction mixture of any of the preceding embodiments, wherein the heterologous homology sequence comprises a sequence (e.g., at its 5' end) suitable for priming target-primed reverse transcription (TPRT) initiation.

138. The system, method, kit, template RNA, or reaction mixture of any of any of the preceding embodiments, wherein the heterologous homology sequence has at least 85%, 90%, 95%, 96%, 97%, 98%, 99%, or 100% homology to a sequence positioned within about 1, 2, 3, 4, 5, 6, 7, 8, 9, 10, 15, 20, 25, 30, 35, 40, 45, 50, 60, 70, 80, 90, or 100 nucleotides of (e.g., 3' relative to) a target insertion site, e.g., for a heterologous object sequence (e.g., as described herein), in the target DNA molecule.

139. The system, method, kit, template RNA, or reaction mixture of any of the preceding embodiments, wherein the template nucleic acid molecule comprises a guide RNA (gRNA), e.g., as described herein.

140. The system, method, kit, template RNA, or reaction mixture of any of the preceding embodiments, wherein the template nucleic acid molecule comprises a gRNA spacer sequence (e.g., at or within 1, 2, 3, 4, 5, 10, 15, 20, 25, 30, 40, 50, 60, 70, 80, 90, or 100 nucleotides of its 5' end).

141. The system, method, kit, template RNA, or reaction mixture of any of the preceding embodiments, wherein an RNA of the system (e.g., template RNA, the RNA encoding the polypeptide of (a), or an RNA expressed from a heterologous object sequence integrated into a target DNA) comprises a microRNA binding site, e.g., in a 3' UTR.

142. The system, method, kit, template RNA, or reaction mixture of any of the preceding embodiments wherein the microRNA binding site is recognized by a miRNA that is present in a non-target cell type, but that is not present (or is present at a reduced level relative to the non-target cell) in a target cell type.

143. The system, method, kit, template RNA, or reaction mixture of any of the preceding embodiments, wherein the miRNA is miR-142, and/or wherein the non-target cell is a Kupffer cell or a blood cell, e.g., an immune cell.

144. The system, method, kit, template RNA, or reaction mixture of any of the preceding embodiments, wherein the miRNA is miR-182 or miR-183, and/or wherein the non-target cell is a dorsal root ganglion neuron.

145. The system, method, kit, template RNA, or reaction mixture of any of the preceding embodiments, wherein the system comprises a first miRNA binding site that is recognized by a first miRNA (e.g., miR-142) and the system further comprises a second miRNA binding site that is recognized by a second miRNA (e.g., miR-182 or miR-183), wherein the first miRNA binding site and the second miRNA binding site are situated on the same RNA or on different RNAs of the system.

146. The system, method, kit, template RNA, or reaction mixture of any of the preceding embodiments, wherein the template RNA comprises at least 2, 3, or 4 miRNA binding sites, e.g., wherein the miRNA binding sites are recognized by the same or different miRNAs.

147. The system, method, kit, template RNA, or reaction mixture of any of the preceding embodiments, wherein the RNA encoding the polypeptide of (a) comprises at least 2, 3, or 4 miRNA binding sites, e.g., wherein the miRNA binding sites are recognized by the same or different miRNAs.

148. The system, method, kit, template RNA, or reaction mixture of any of the preceding embodiments, wherein the RNA expressed from a heterologous object sequence integrated into a target DNA comprises at least 2, 3, or 4 miRNA binding sites, e.g., wherein the miRNA binding sites are recognized by the same or different miRNAs.

149. A system comprising:
  an mRNA encoding the polypeptide or system of any of the preceding embodiments, and
  a template RNA of any preceding embodiment.

150. The system of any of the preceding embodiments, wherein the mRNA encoding the polypeptide or system of any preceding embodiment and the template RNA of any preceding embodiment are disposed on different nucleic acid molecules.

151. A system comprising an RNA molecule comprising:
  a template RNA (or RNA encoding the template RNA) of any preceding embodiment, and
  a sequence encoding the system or polypeptide of any preceding embodiment.

152. The system of any of the preceding embodiments, wherein the RNA molecule comprises an internal ribosome entry site, e.g., operably linked to the sequence encoding the system or polypeptide.

153. The system of any of the preceding embodiments, wherein the RNA molecule comprises a cleavage site, e.g., situated between the template RNA (or RNA encoding the template RNA) and the sequence encoding the system or polypeptide.

154. The system or polypeptide of any of the preceding embodiments, wherein the polypeptide comprises a split intein, e.g., two or more (e.g., all) of the RT domain, DBD, endonuclease (e.g., nickase) domain, or combinations thereof are translated as separate proteins which combine into a single polypeptide by protein splicing.

155. The system, kit, polypeptide, or reaction mixture of any of the preceding embodiments, wherein the system comprises one or more circular RNA molecules (circRNAs).

156. The system, kit, polypeptide, or reaction mixture of any of the preceding embodiments, wherein the circRNA encodes the GENE WRITER™ polypeptide.

157. The system of any of the preceding embodiments, wherein the circRNA comprises a template RNA.

158. The system, kit, polypeptide, or reaction mixture of any of the preceding embodiments, wherein circRNA is delivered to a host cell.

159. The system, kit, polypeptide, or reaction mixture of any of the preceding embodiments, wherein the circRNA is capable of being linearized, e.g., in a host cell, e.g., in the nucleus of the host cell.

160. The system, kit, polypeptide, or reaction mixture of any of the preceding embodiments, wherein the circRNA comprises a cleavage site.

161. The system, kit, polypeptide, or reaction mixture of any of the preceding embodiments, wherein the circRNA further comprises a second cleavage site.

162. The system, kit, polypeptide, or reaction mixture of any of the preceding embodiments, wherein the cleavage site can be cleaved by a ribozyme, e.g., a ribozyme comprised in the circRNA (e.g., by autocleavage).

163. The system, kit, polypeptide, or reaction mixture of any of the preceding embodiments, wherein the circRNA comprises a ribozyme sequence.

164. The system, kit, polypeptide, or reaction mixture of any of the preceding embodiments, wherein the ribozyme sequence is capable of autocleavage, e.g., in a host cell, e.g., in the nucleus of the host cell.

165. The system, kit, polypeptide, or reaction mixture of any of the preceding embodiments, wherein the ribozyme is an inducible ribozyme.

166. The system, kit, polypeptide, or reaction mixture of any of the preceding embodiments, wherein the ribozyme is a protein-responsive ribozyme, e.g., a ribozyme responsive to a nuclear protein, e.g., a genome-interacting protein, e.g., an epigenetic modifier, e.g., EZH2.

167. The system, kit, polypeptide, or reaction mixture of any of the preceding embodiments, wherein the ribozyme is a nucleic acid-responsive ribozyme.

168. The system, kit, polypeptide, or reaction mixture of any of the preceding embodiments, wherein the catalytic activity (e.g., autocatalytic activity) of the ribozyme is activated in the presence of a target nucleic acid molecule (e.g., an RNA molecule, e.g., an mRNA, miRNA, ncRNA, lncRNA, tRNA, snRNA, or mtRNA).

169. The system, kit, polypeptide, or reaction mixture of any of the preceding embodiments, wherein the ribozyme is responsive to a target protein (e.g., an MS2 coat protein).

170. The system, kit, polypeptide, or reaction mixture of any of the preceding embodiments, wherein the target protein localized to the cytoplasm or localized to the nucleus (e.g., an epigenetic modifier or a transcription factor).

171. The system, kit, polypeptide, or reaction mixture of any of the preceding embodiments, wherein the ribozyme comprises the ribozyme sequence of a B2 or ALU retrotransposon, or a nucleic acid sequence having at least 85%, 90%, 95%, 96%, 97%, 98%, or 99% sequence identity thereto.

172. The system, kit, polypeptide, or reaction mixture of any of the preceding embodiments, wherein the ribozyme comprises the sequence of a tobacco ringspot virus hammerhead ribozyme, or a nucleic acid sequence having at least 85%, 90%, 95%, 96%, 97%, 98%, or 99% sequence identity thereto.

173. The system, kit, polypeptide, or reaction mixture of any of the preceding embodiments, wherein the ribozyme comprises the sequence of a hepatitis delta virus (HDV) ribozyme, or a nucleic acid sequence having at least 85%, 90%, 95%, 96%, 97%, 98%, or 99% sequence identity thereto.

174. The system, kit, polypeptide, or reaction mixture of any of the preceding embodiments, wherein the ribozyme is activated by a moiety expressed in a target cell or target tissue.

175. The system, kit, polypeptide, or reaction mixture of any of the preceding embodiments, wherein the ribozyme is activated by a moiety expressed in a target subcellular compartment (e.g., a nucleus, nucleolus, cytoplasm, or mitochondria).

176. The system, kit, polypeptide, or reaction mixture of any of the preceding embodiments, wherein the ribozyme is comprised in a circular RNA or a linear RNA.

177. A system comprising a first circular RNA encoding the polypeptide of a GENE WRITING™ system; and a second circular RNA comprising the template RNA of a GENE WRITING™ system.

178. The system of any of the preceding embodiments, wherein the nucleic encoding the polypeptide of (a) comprises a coding sequence that is codon-optimized for expression in human cells.

179. The system of any of the preceding embodiments, wherein the template RNA comprises a coding sequence that is codon-optimized for expression in human cells.

180. A lipid nanoparticle (LNP) comprising the system, template RNA, polypeptide (or RNA encoding the same), or DNA encoding the system, template RNA, or polypeptide, of any preceding embodiment.

181. A system comprising a first lipid nanoparticle comprising the polypeptide (or DNA or RNA encoding the same) of a GENE WRITING™ system (e.g., as described herein); and
 a second lipid nanoparticle comprising a nucleic acid molecule of a GENE WRITING™ System (e.g., as described herein).

182. The system, kit, polypeptide, or reaction mixture of any preceding embodiments, wherein the system, nucleic acid molecule, polypeptide, and/or DNA encoding the same, is formulated as a lipid nanoparticle (LNP).

183. The LNP of any of the preceding embodiments, comprising a cationic lipid.

184. The LNP of any of the preceding embodiments, wherein the cationic lipid having a following structure:

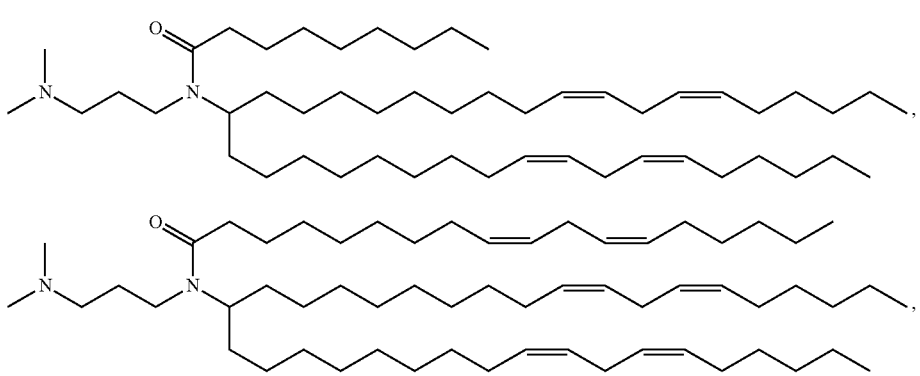

-continued

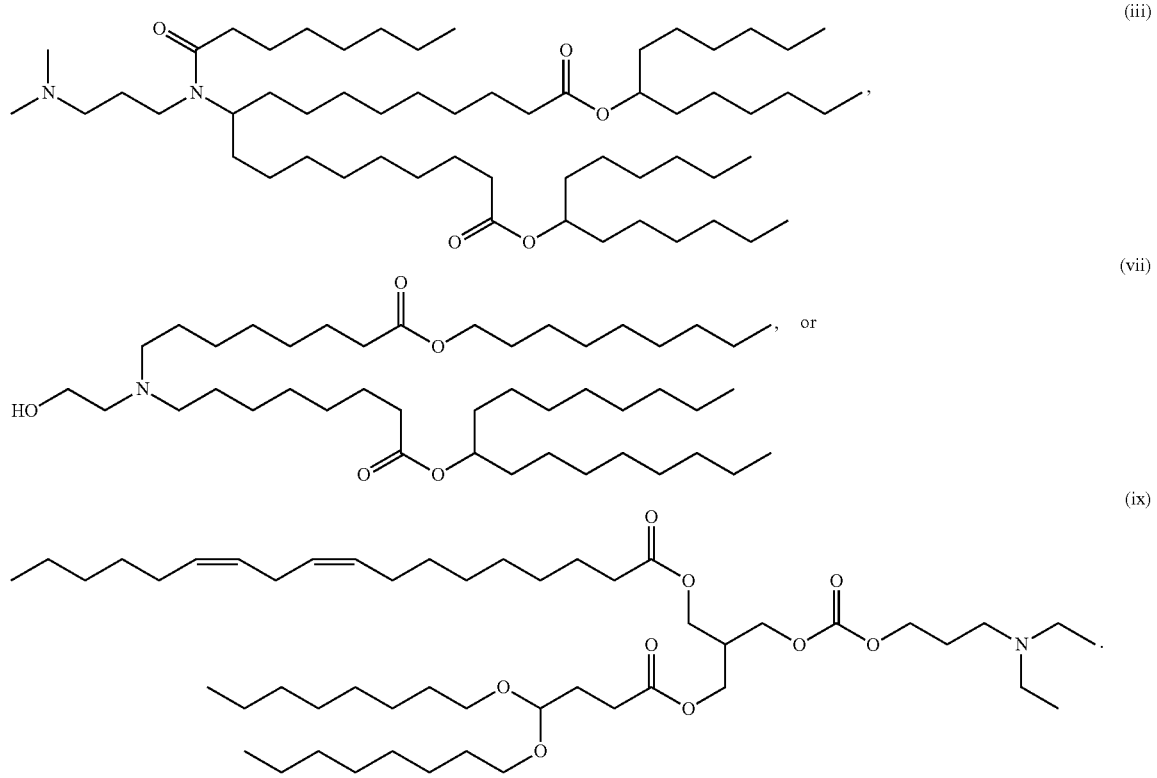

185. The LNP of any of the preceding embodiments, further comprising one or more neutral lipid, e.g., DSPC, DPPC, DMPC, DOPC, POPC, DOPE, SM, a steroid, e.g., cholesterol, and/or one or more polymer conjugated lipid, e.g., a pegylated lipid, e.g., PEG-DAG, PEG-PE, PEG-S-DAG, PEG-cer or a PEG dialkyoxypropylcarbamate.

186. The system, kit, polypeptide, or reaction mixture of any of the preceding embodiments, wherein the system, polypeptide, and/or DNA encoding the same, is formulated as a lipid nanoparticle (LNP).

187. The system, kit, polypeptide, or reaction mixture of any of the preceding embodiments, wherein the lipid nanoparticle (or a formulation comprising a plurality of the lipid nanoparticles) lacks reactive impurities (e.g., aldehydes), or comprises less than a preselected level of reactive impurities (e.g., aldehydes).

188. The system, kit, polypeptide, or reaction mixture of any of the preceding embodiments, wherein the lipid nanoparticle (or a formulation comprising a plurality of the lipid nanoparticles) lacks aldehydes, or comprises less than a preselected level of aldehydes.

189. The system, kit, polypeptide, or reaction mixture of any of the preceding embodiments, wherein the lipid nanoparticle is comprised in a formulation comprising a plurality of the lipid nanoparticles.

190. The system, kit, polypeptide, or reaction mixture of any of the preceding embodiments, wherein the lipid nanoparticle formulation is produced using one or more lipid reagents comprising less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content.

191. The system, kit, polypeptide, or reaction mixture of any of the preceding embodiments, wherein the lipid nanoparticle formulation is produced using one or more lipid reagents comprising less than 3% total reactive impurity (e.g., aldehyde) content.

192. The system, kit, polypeptide, or reaction mixture of any of the preceding embodiments, wherein the lipid nanoparticle formulation is produced using one or more lipid reagents comprising less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

193. The system, kit, polypeptide, or reaction mixture of any of the preceding embodiments, wherein the lipid nanoparticle formulation is produced using one or more lipid reagent comprising less than 0.3% of any single reactive impurity (e.g., aldehyde) species.

194. The system, kit, polypeptide, or reaction mixture of any of the preceding embodiments, wherein the lipid nanoparticle formulation is produced using one or more lipid reagents comprising less than 0.1% of any single reactive impurity (e.g., aldehyde) species.

195. The system, kit, polypeptide, or reaction mixture of any of the preceding embodiments, wherein the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content.

196. The system, kit, polypeptide, or reaction mixture of any of the preceding embodiments, wherein the lipid nanoparticle formulation comprises less than 3% total reactive impurity (e.g., aldehyde) content.

197. The system, kit, polypeptide, or reaction mixture of any of the preceding embodiments, wherein the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

198. The system, kit, polypeptide, or reaction mixture of any of the preceding embodiments, wherein the lipid nanoparticle formulation comprises less than 0.3% of any single reactive impurity (e.g., aldehyde) species.

199. The system, kit, polypeptide, or reaction mixture of any of the preceding embodiments, wherein the lipid nanoparticle formulation comprises less than 0.1% of any single reactive impurity (e.g., aldehyde) species.

200. The system, kit, polypeptide, or reaction mixture of any of the preceding embodiments, wherein one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content.

201. The system, kit, polypeptide, or reaction mixture of any of the preceding embodiments, wherein one or more, or optionally all, of the lipid reagents used for a lipid nanoparticle as described herein or a formulation thereof comprise less than 3% total reactive impurity (e.g., aldehyde) content.

202. The system, kit, polypeptide, or reaction mixture of any of the preceding embodiments, wherein one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

203. The system, kit, polypeptide, or reaction mixture of any of the preceding embodiments, wherein one or more, or optionally all, of the lipid reagents used for a lipid nanoparticle as described herein or a formulation thereof comprise less than 0.3% of any single reactive impurity (e.g., aldehyde) species.

204. The system, kit, polypeptide, or reaction mixture of any of the preceding embodiments, wherein one or more, or optionally all, of the lipid reagents used for a lipid nanoparticle as described herein or a formulation thereof comprise less than 0.1% of any single reactive impurity (e.g., aldehyde) species.

205. The system, kit, polypeptide, or reaction mixture of any of the preceding embodiments, wherein the total aldehyde content and/or quantity of any single reactive impurity (e.g., aldehyde) species is determined by liquid chromatography (LC), e.g., coupled with tandem mass spectrometry (MS/MS), e.g., according to the method described in Example 26.

206. The system, kit, polypeptide, or reaction mixture of any of the preceding embodiments, wherein the total aldehyde content and/or quantity of reactive impurity (e.g., aldehyde) species is determined by detecting one or more chemical modifications of a nucleic acid molecule (e.g., as described herein) associated with the presence of reactive impurities (e.g., aldehydes), e.g., in the lipid reagents.

207. The system, kit, polypeptide, or reaction mixture of any of the preceding embodiments, wherein the total aldehyde content and/or quantity of aldehyde species is determined by detecting one or more chemical modifications of a nucleotide or nucleoside (e.g., a ribonucleotide or ribonucleoside, e.g., comprised in or isolated from a nucleic acid molecule, e.g., as described herein) associated with the presence of reactive impurities (e.g., aldehydes), e.g., in the lipid reagents, e.g., as described in Example 41.

208. The system, kit, polypeptide, or reaction mixture of any of the preceding embodiments, wherein the chemical modifications of a nucleic acid molecule, nucleotide, or nucleoside are detected by determining the presence of one or more modified nucleotides or nucleosides, e.g., using LC-MS/MS analysis, e.g., as described in Example 41.

209. A lipid nanoparticle (LNP) comprising the system, polypeptide (or RNA encoding the same), nucleic acid molecule, or DNA encoding the system or polypeptide, of any preceding embodiment.

210. A system comprising a first lipid nanoparticle comprising the polypeptide (or DNA or RNA encoding the same) of a GENE WRITING™ system (e.g., as described herein); and a second lipid nanoparticle comprising a nucleic acid molecule of a GENE WRITING™ System (e.g., as described herein).

211. The system, kit, polypeptide, or reaction mixture of any preceding embodiment, wherein the system, nucleic acid molecule, polypeptide, and/or DNA encoding the same, is formulated as a lipid nanoparticle (LNP).

212. A system comprising:
a first lipid nanoparticle comprising the polypeptide (or DNA or RNA encoding the same) of a system or polypeptide of any preceding embodiment; and
a second lipid nanoparticle comprising the template RNA (or DNA encoding the same) of a system or template RNA of any preceding embodiment.

213. A virus, viral-like particle, fusosome, or virosome comprising the system, template RNA, polypeptide (or RNA encoding the same), or DNA encoding the system, template RNA, or polypeptide, of any preceding embodiment.

214. A system comprising:
a first virus, viral-like particle, fusosome, or virosome comprising the polypeptide (or DNA or RNA encoding the same) of a system or polypeptide of any preceding embodiment; and
a second virus, viral-like particle, or virosome comprising the template RNA (or DNA encoding the same) of a system or template RNA of any preceding embodiment.

215. The system, kit, template RNA, or reaction mixture of any of the preceding embodiments, wherein at least 80, 85, 90, 95, 96, 97, 98, or 99% of the template RNA present is greater than 100, 125, 150, 175, or 200 nucleotides long, or at least 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases long (and optionally less than 15, 10, 5, or 20 kilobases long, or less than 500, 400, 300, or 200 nucleotides long).

216. The system, kit, template RNA, or reaction mixture of any of the preceding embodiments, wherein at least 80, 85, 90, 95, 96, 97, 98, or 99% of the template RNA present contains a polyA tail (e.g., a polyA tail that is at least 5, 10, 20, 30, 40, 50, 60, 70, 80, 90, or 100 nucleotides in length (SEQ ID NO: 3663)).

217. The system, kit, template RNA, or reaction mixture of any of the preceding embodiments, wherein at least 80, 85, 90, 95, 96, 97, 98, or 99% of the template RNA present contains:
a 5' cap, e.g.: a 7-methylguanosine cap (e.g., a O-Me-m7G cap); a hypermethylated cap analog; an NAD+-derived cap analog (e.g., as described in Kiledjian, Trends in Cell Biology 28, 454-464 (2018)); or a modified, e.g., biotinylated, cap analog (e.g., as described in Bednarek et al., Phil Trans R Soc B 373, 20180167 (2018)), and/or
a 3' feature selected from one or more of: a polyA tail; a 16-nucleotide long stem-loop structure flanked by unpaired 5 nucleotides (e.g., as described by Mannironi et al., Nucleic Acid Research 17, 9113-9126 (1989)); a triple-helical structure (e.g., as described by Brown et al., PNAS 109, 19202-19207 (2012)); a tRNA, Y RNA, or vault RNA structure (e.g., as described by Labno et al., Biochemica et Biophysica Acta 1863, 3125-3147 (2016)); incorporation of one or more deoxyribonucleotide triphosphates (dNTPs), 2'O-Methylated NTPs, or phosphorothioate-NTPs; a single nucleotide chemical modification (e.g., oxidation of the 3' terminal ribose to a reactive aldehyde followed by conjugation of the aldehyde-reactive modified nucleotide); or chemical ligation to another nucleic acid molecule.

218. The system, kit, template RNA, or reaction mixture of aany of the preceding embodiments, wherein the template RNA comprises one or more modified nucleotides, e.g., selected from dihydrouridine, inosine, 7-methylguanosine, 5-methylcytidine (5mC), 5' Phosphate ribothymidine, 2'-O-methyl ribothymidine, 2'-O-ethyl ribothymidine, 2'-fluoro ribothymidine, C-5 propynyl-deoxycytidine (pdC), C-5 propynyl-deoxyuridine (pdU), C-5 propynyl-cytidine (pC), C-5 propynyl-uridine (pU), 5-methyl cytidine, 5-methyl uridine, 5-methyl deoxycytidine, 5-methyl deoxyuridine methoxy, 2,6-diaminopurine, 5'-Dimethoxytrityl-N4-ethyl-2'-deoxycytidine, C-5 propynyl-f-cytidine (pfC), C-5 propynyl-f-uridine (pfU), 5-methyl f-cytidine, 5-methyl f-uridine, C-5 propynyl-m-cytidine (pmC), C-5 propynyl-f-uridine (pmU), 5-methyl m-cytidine, 5-methyl m-uridine, LNA (locked nucleic acid), MGB (minor groove binder) pseudouridine (Y), 1-N-methylpseudouridine (1-Me-Ψ), or 5-methoxyuridine (5-MO-U).

219. The system, kit, template RNA, or reaction mixture of any of the preceding embodiments, wherein at least 80, 85, 90, 95, 96, 97, 98, or 99% of the template RNA present contains one or more modified nucleotides.

220. The system, kit, template RNA, or reaction mixture of any of the preceding embodiments, wherein at least 80, 85, 90, 95, 96, 97, 98, or 99% of the template RNA remains intact (e.g., greater than 100, 125, 150, 175, or 200 nucleotides long, or at least 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases long) after a stability test.

221. The system, kit, or reaction mixture of any of the preceding embodiments, wherein at least 1% of target sites are modified after the system is assayed for potency.

222. The system, kit, template RNA, polypeptide, or reaction mixture of any of the preceding embodiments, wherein the system, polypeptide, template RNA, and/or DNA encoding the same, is formulated as a lipid nanoparticle (LNP).

223. The system, kit, template RNA, polypeptide, or reaction mixture of any of the preceding embodiments, wherein the DNA encoding the system, polypeptide, and/or template RNA are packaged into a virus, viral-like particle, virosome, liposome, vesicle, exosome, or LNP.

224 The system, kit, template RNA, polypeptide, or reaction mixture of any of the preceding embodiments, wherein the DNA encoding the system, template RNA, or polypeptide is packaged into an adeno-associated virus (AAV).

225. The system, kit, template RNA, polypeptide, or reaction mixture of any of the preceding embodiments, wherein the system, template RNA, polypeptide, lipid nanoparticle (LNP), virus, viral-like particle, or virosome is free or substantially free of pyrogen, virus, fungus, bacterial pathogen, and/or host cell protein contamination.

226. A virus, viral-like particle, or virosome comprising:
the system, template RNA, or polypeptide of any of the preceding embodiments, or DNA encoding any of the same, and
an adeno-associated virus (AAV) capsid protein.

227. The system, kit, template RNA, polypeptide, virus, viral-like particle, or virosome of any of the preceding embodiments, wherein the system, template RNA, and/or polypeptide is active in a target tissue and less active (e.g., not active) in a non-target tissue.

228. The system, kit, template RNA, polypeptide, virus, viral-like particle, or virosome of any of the preceding embodiments, further comprising one or more first tissue-specific expression-control sequences specific to the target tissue, wherein the one or more first tissue-specific expression-control sequences specific to the target tissue are in operative association with the template RNA, the polypeptide or nucleic acid encoding the same, or both.

229. The system, kit, template RNA, or reaction mixture of any of the preceding embodiments, wherein the endonuclease domain, e.g., nickase domain, nicks the first strand of the target site DNA and nicks the second strand at a site a distance from the first nick.

230. The system, kit, template RNA, or reaction mixture of any of the preceding embodiments, wherein the nicks are made in an outward orientation.

231. The system, kit, template RNA, or reaction mixture of any of the preceding embodiments, wherein the nicks are made in an outward orientation.

232. The system, kit, template RNA, or reaction mixture of any of embany of the preceding embodiments,
wherein the sequence that binds a target site specifies the location of the nick to the first strand,
wherein the system further comprises an additional nucleic acid comprising a sequence that binds a site a distance from the target site, and wherein the sequence that binds a site a distance from the target site specifies the location of the nick to the second strand.

233. The system, kit, template RNA, or reaction mixture of any of the preceding embodiments, wherein the additional nucleic acid further comprises a sequence that binds the polypeptide (e.g., that binds the endonuclease domain and/or DBD), e.g., wherein the additional nucleic acid comprises a gRNA.

234. The system, kit, template RNA, or reaction mixture of any of the preceding embodiments, wherein the sequence that binds a site a distance from the target site (e.g., binds to the first strand of a site in a target genome) is at least 15, 16, 17, 18, 19, 20, 21, 22, 23, 24, 25, 30, 35, 40, 45, 50, 55, 60, 65, 70, 75, 80, 85, 90, 95, 100, 110, 120, or 130 nucleotides long (and optionally no more than 150, 140, 130, 120, 110, 100, 90, 80, 70, 60, 50, 40, 30, 29, 28, 27, 26, 25, 24, 23, 22, 21, or 20 nucleotides long), e.g., is 17, 18, 19, 20, 21, 22, 23, or 24 nucleotides long.

235. The system, kit, template RNA, or reaction mixture of any of the preceding embodiments, wherein the sequence that binds a site a distance from the target site is complementary to the first strand of the target site, or comprises no more than 1, 2, 3, 4, or 5 mismatches to the first strand of the target site.

236. The system, kit, template RNA, or reaction mixture of any of the preceding embodiments, wherein the DBD and/or endonuclease domain comprise a CRISPR/Cas domain.

237. The system, kit, template RNA, or reaction mixture of any of the preceding embodiments, wherein the CRISPR/Cas domain and the template RNA bind to the target site, and wherein the first strand of the target site comprises a first PAM site.

238. The system, kit, template RNA, or reaction mixture of any of the preceding embodiments, wherein the CRISPR/Cas domain and the additional nucleic acid bind to the site a distance from the target site, and wherein the second strand of the site a distance from the target site comprises a second PAM site.

239. The system, kit, template RNA, or reaction mixture of any of the preceding embodiments, wherein the first PAM site and second PAM site are positioned between the location of the nick to the first strand and the location of the nick to the second strand.

240. The system, kit, template RNA, or reaction mixture of any of the preceding embodiments, wherein the location of the nick to the first strand and the location of the nick to the second strand are positioned between the first PAM site and second PAM site.

241. The system, kit, template RNA, or reaction mixture of any of the preceding embodiments, further comprising an additional polypeptide comprising an additional DNA-binding domain (DBD) and an additional endonuclease domain, e.g., an additional nickase domain.

242. The system, kit, template RNA, or reaction mixture of any of the preceding embodiments, wherein the additional endonuclease domain, e.g., the additional nickase domain, comprises an endonuclease or nickase domain described herein, e.g., a CRISPR/Cas domain, a type IIs nuclease (e.g., FokI), a Holliday Junction resolvase, a meganuclease, or a double-stranded DNA nuclease comprising an alteration that abrogates its ability to nick one strand (e.g., transforming the double-stranded DNA nuclease into a nickase).

243. The system, kit, template RNA, or reaction mixture of any of the preceding embodiments, wherein the additional DBD binds a site a distance from the target site.

244. The system, kit, template RNA, or reaction mixture of any of the preceding embodiments, wherein the endonuclease domain of (a) or (b) nicks the first strand and the additional endonuclease domain (e.g., additional nickase domain) nicks the second strand.

245. The system, kit, template RNA, or reaction mixture of any of the preceding embodiments, wherein the nicks are made in an outward orientation.

246. The system, kit, template RNA, or reaction mixture of any of the preceding embodiments, wherein the nicks are made in an inward orientation.

247. The system, kit, template RNA, or reaction mixture of any of the preceding embodiments, wherein the DBD and optionally the template RNA (e.g., the sequence that binds the polypeptide) specifies the location of the nick to the first strand, and the additional DBD specifies the location of the nick to the second strand.

248. The system, kit, template RNA, or reaction mixture of any of the preceding embodiments, wherein the polypeptide (e.g., the DBD) comprises a TAL effector molecule.

249. The system, kit, template RNA, or reaction mixture of any of the preceding embodiments, wherein the polypeptide (e.g., the DBD) comprises a zinc finger molecule.

250. The system, kit, template RNA, or reaction mixture of any of the preceding embodiments, wherein the polypeptide (e.g., the DBD) comprises a CRISPR/Cas domain.

251. The system, kit, template RNA, or reaction mixture of any of the preceding embodiments, wherein the additional polypeptide (e.g., the additional DBD) comprises a TAL effector molecule.

252. The system, kit, template RNA, or reaction mixture of anany of the preceding embodiments, wherein the additional polypeptide (e.g., the additional DBD) comprises a zinc finger molecule.

253. The system, kit, template RNA, or reaction mixture of any of the preceding embodiments, wherein the additional polypeptide (e.g., the additional DBD) comprises a CRISPR/Cas domain.

254. The system, kit, template RNA, or reaction mixture of any of the preceding embodiments, wherein the polypeptide and the additional polypeptide bind to sites on the target DNA between the location of the nick to the first strand and the location of the nick to the second.

255. The system, kit, template RNA, or reaction mixture of any of the preceding embodiments, wherein the location of the nick to the first strand and the location of the nick to the second strand are between the sites where the polypeptide and the additional polypeptide bind to the target DNA.

256. The system, kit, template RNA, or reaction mixture of any of the preceding embodiments, wherein, on the target DNA, the location of the nick to the second strand is positioned on the opposite side of the binding sites of the polypeptide and additional polypeptide relative to the location of the nick to the first strand.

257. The system, kit, template RNA, or reaction mixture of any of the preceding embodiments, wherein, on the target DNA, the location of the nick to the second strand is positioned on the same side of the binding sites of the polypeptide and additional polypeptide relative to the location of the nick to the first strand.

258. The system, kit, template RNA, or reaction mixture of any of the preceding embodiments, wherein the CRISPR/Cas domain of the polypeptide and the template RNA bind to the target site, and wherein the first strand of the target site comprises a PAM site.

259. The system, kit, template RNA, or reaction mixture of any of the preceding embodiments, wherein the PAM site and the site at a distance from the target site are positioned between the location of the nick to the first strand and the location of the nick to the second strand.

260. The system, kit, template RNA, or reaction mixture of any of the preceding embodiments, wherein the location of the nick to the first strand and the location of the nick to the second strand are positioned between the PAM site and the site at a distance from the target site.

261. The system, kit, template RNA, or reaction mixture of any of the preceding embodiments, further comprising an additional nucleic acid (e.g., a gRNA) comprising a sequence that binds a site a distance from the target site, and wherein the sequence that binds a site a distance from the target site specifies the location of the nick to the second strand.

262. The system, kit, template RNA, or reaction mixture of any of the preceding embodiments, wherein the additional nucleic acid further comprises a sequence that binds the additional polypeptide (e.g., the CRISPR/Cas domain), e.g., wherein the additional nucleic acid comprises a gRNA.

263. The system, kit, template RNA, or reaction mixture of any of the preceding embodiments, wherein the sequence that binds a site a distance from the target site (e.g., to the first strand of a site in a target genome) is at least 15, 16, 17, 18, 19, 20, 21, 22, 23, 24, 25, 30, 35, 40, 45, 50, 55, 60, 65, 70, 75, 80, 85, 90, 95, 100, 110, 120, or 130 nucleotides long (and optionally no more than 150, 140, 130, 120, 110, 100, 90, 80, 70, 60, 50, 40, 30, 29, 28, 27, 26, 25, 24, 23, 22, 21, or 20 nucleotides long), e.g., is 17, 18, 19, 20, 21, 22, 23, or 24 nucleotides long.

264. The system, kit, template RNA, or reaction mixture of any of the preceding embodiments, wherein the sequence that binds a site a distance from the target site is complementary to the first strand of the target site, or comprises no more than 1, 2, 3, 4, or 5 mismatches to the first strand of the target site.

265. The system, kit, template RNA, or reaction mixture of any of the preceding embodiments, wherein the site a distance from the target site comprises a PAM site.

266. The system, kit, template RNA, or reaction mixture of any of the preceding embodiments, wherein the PAM site and the target site are positioned between the location of the nick to the first strand and the location of the nick to the second strand.

267. The system, kit, template RNA, or reaction mixture of any of the preceding embodiments, wherein the location of the nick to the second strand (e.g., relative to the nick to the first strand) is such that DNA polymerization by the RT domain proceeds toward the location of the nick to the second strand.

268. The system, kit, template RNA, or reaction mixture of any of the preceding embodiments, wherein the location of the nick to the second strand (e.g., relative to the nick to the first strand) is such that DNA polymerization by the RT domain proceeds away from the location of the nick to the second strand.

269. The system, kit, template RNA, or reaction mixture of any of the preceding embodiments, wherein the first nick and the second nick are at least 20, 25, 30, 35, 40, 45, 50, 55, 60, 65, 70, 75, 80, 85, 90, 95, 100, 110, 120, 130, 140, 150, 160, 170, 180, 190, or 200 nucleotides apart.

270. The system, kit, template RNA, or reaction mixture of any of the preceding embodiments, wherein the first nick and the second nick are no more than 25, 30, 35, 40, 45, 50, 55, 60, 65, 70, 75, 80, 85, 90, 95, 100, 110, 120, 130, 140, 150, 160, 170, 180, 190, 200, or 250 nucleotides apart.

271. The system, kit, template RNA, or reaction mixture of any of the preceding embodiments, wherein the first nick and the second nick are 20-200, 30-200, 40-200, 50-200, 60-200, 70-200, 80-200, 90-200, 100-200, 110-200, 120-200, 130-200, 140-200, 150-200, 160-200, 170-200, 180-200, 190-200, 20-190, 30-190, 40-190, 50-190, 60-190, 70-190, 80-190, 90-190, 100-190, 110-190, 120-190, 130-190, 140-190, 150-190, 160-190, 170-190, 180-190, 20-180, 30-180, 40-180, 50-180, 60-180, 70-180, 80-180, 90-180, 100-180, 110-180, 120-180, 130-180, 140-180, 150-180, 160-180, 170-180, 20-170, 30-170, 40-170, 50-170, 60-170, 70-170, 80-170, 90-170, 100-170, 110-170, 120-170, 130-170, 140-170, 150-170, 160-170, 20-160, 30-160, 40-160, 50-160, 60-160, 70-160, 80-160, 90-160, 100-160, 110-160, 120-160, 130-160, 140-160, 150-160, 20-150, 30-150, 40-150, 50-150, 60-150, 70-150, 80-150, 90-150, 100-150, 110-150, 120-150, 130-150, 140-150, 20-140, 30-140, 40-140, 50-140, 60-140, 70-140, 80-140, 90-140, 100-140, 110-140, 120-140, 130-140, 20-130, 30-130, 40-130, 50-130, 60-130, 70-130, 80-130, 90-130, 100-130, 110-130, 120-130, 20-120, 30-120, 40-120, 50-120, 60-120, 70-120, 80-120, 90-120, 100-120, 110-120, 20-110, 30-110, 40-110, 50-110, 60-110, 70-110, 80-110, 90-110, 100-110, 20-100, 30-100, 40-100, 50-100, 60-100, 70-100, 80-100, 90-100, 20-90, 30-90, 40-90, 50-90, 60-90, 70-90, 80-90, 20-80, 30-80, 40-80, 50-80, 60-80, 70-80, 20-70, 30-70, 40-70, 50-70, 60-70, 20-60, 30-60, 40-60, 50-60, 20-50, 30-50, 40-50, 20-40, 30-40, or 20-30 nucleotides apart.

272. The system, kit, template RNA, or reaction mixture of any of the preceding embodiments, wherein the system produces fewer double-stranded breaks (e.g., at least 100, 90, 80, 70, 60, 50, 40, 30, 20, 10, 9, 8, 7, 6, 5, 4, 3, 2, or 1% fewer) when modifying DNA than an otherwise similar system wherein one or more of a PAM site, target site, or site a distance from the target site is not situated between the location of the first strand nick and the location of the second strand nick.

273. The system, kit, template RNA, or reaction mixture of any of the preceding embodiments, wherein the system produces fewer double-stranded breaks (e.g., at least 100, 90, 80, 70, 60, 50, 40, 30, 20, 10, 9, 8, 7, 6, 5, 4, 3, 2, or 1% fewer) when modifying DNA than an otherwise similar system wherein the polypeptide and the additional polypeptide bind to sites on the target DNA not between the location of the nick to the first strand and the location of the nick to the second.

274. The system, kit, template RNA, or reaction mixture of any of the preceding embodiments, wherein the system produces fewer double-stranded breaks (e.g., at least 100, 90, 80, 70, 60, 50, 40, 30, 20, 10, 9, 8, 7, 6, 5, 4, 3, 2, or 1% fewer) when modifying DNA than an otherwise similar system wherein, on the target DNA, the location of the nick to the second strand and the location of the nick to the first strand are located between the binding sites of the polypeptide and additional polypeptide.

275. The system, kit, template RNA, or reaction mixture of any of the preceding embodiments, wherein the system produces fewer double-stranded breaks (e.g., at least 100, 90, 80, 70, 60, 50, 40, 30, 20, 10, 9, 8, 7, 6, 5, 4, 3, 2, or 1% fewer) when modifying DNA than an otherwise similar system wherein the location of the nick to the second strand (e.g., relative to the nick to the first strand) is such that the RT domain initiates reverse transcription away from the location of the nick to the second strand.

276. The system, kit, template RNA, or reaction mixture of any of the preceding embodiments, wherein the system produces fewer deletions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein one or more of a PAM site, target site, or site a distance from the target site is not situated between the location of the first strand nick and the location of the second strand nick, e.g., as measured by PacBio long read sequencing, e.g., as described in Example 29.

277. The system, kit, template RNA, or reaction mixture of any of the preceding embodiments, wherein the system produces fewer deletions (e.g., at least 100, 90, 80, 70, 60, 50, 40, 30, 20, 10, 9, 8, 7, 6, 5, 4, 3, 2, or 1% fewer) when modifying DNA than an otherwise similar system wherein the polypeptide and the additional polypeptide bind to sites on the target DNA not between the location of the nick to the first strand and the location of the nick to the second, e.g., as measured by PacBio long read sequencing, e.g., as described in Example 29.

278. The system, kit, template RNA, or reaction mixture of any of the preceding embodiments, wherein the system produces fewer deletions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein, on the target DNA, the location of the nick to the second strand and the location of the nick to the first strand are located between the binding sites of the polypeptide and additional polypeptide, e.g., as measured by PacBio long read sequencing, e.g., as described in Example 29.

279. The system, kit, template RNA, or reaction mixture of any of the preceding embodiments, wherein the system produces fewer deletions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein the location of the nick to the second strand (e.g., relative to the nick to the first strand) is such that the RT domain initiates reverse transcription away from the location of the nick to the second strand, e.g., as measured by PacBio long read sequencing, e.g., as described in Example 29.

280. The system, kit, template RNA, or reaction mixture of any of the preceding embodiments, wherein the system produces fewer insertions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein one or more of a PAM site, target site, or site a distance from the target site is not situated between the location of the first strand nick and the location of the second strand nick, e.g., as measured by PacBio long read sequencing, e.g., as described in Example 29.

281. The system, kit, template RNA, or reaction mixture of any of the preceding embodiments, wherein the system produces fewer insertions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein the polypeptide and the additional polypeptide bind to sites on the target DNA not between the location of the nick to the first strand and the location of the nick to the second, e.g., as measured by PacBio long read sequencing, e.g., as described in Example 29.

282. The system, kit, template RNA, or reaction mixture of any of the preceding embodiments, wherein the system produces fewer insertions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein, on the target DNA, the location of the nick to the second strand and the location of the nick to the first strand are located between the binding sites of the polypeptide and additional polypeptide, e.g., as measured by PacBio long read sequencing, e.g., as described in Example 29.

283. The system, kit, template RNA, or reaction mixture of any of the preceding embodiments, wherein the system produces fewer insertions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein the location of the nick to the second strand (e.g., relative to the nick to the first strand) is such that the RT domain initiates reverse transcription away from the location of the nick to the second strand, e.g., as measured by PacBio long read sequencing, e.g., as described in Example 29.

284. The system, kit, template RNA, or reaction mixture of any of the preceding embodiments, wherein the system produces more desired GENE WRITING™ modifications (e.g., at least 500, 400, 300, 200, 100, 90, 80, 70, 60, 50, 40, 30, 20, 10, 9, 8, 7, 6, 5, 4, 3, 2, or 1% more) when modifying DNA than an otherwise similar system wherein one or more of a PAM site, target site, or site a distance from the target site is not situated between the location of the first strand nick and the location of the second strand nick, e.g., as measured by PacBio long read sequencing, e.g., as described in Example 29.

285. The system, kit, template RNA, or reaction mixture of any of the preceding embodiments, wherein the system produces more desired GENE WRITING™ modifications (e.g., at least 500, 400, 300, 200, 100, 90, 80, 70, 60, 50, 40, 30, 20, 10, 9, 8, 7, 6, 5, 4, 3, 2, or 1% more) when modifying DNA than an otherwise similar system wherein the polypeptide and the additional polypeptide bind to sites on the target DNA not between the location of the nick to the first strand and the location of the nick to the second, e.g., as measured by PacBio long read sequencing, e.g., as described in Example 29.

286. The system, kit, template RNA, or reaction mixture of any of the preceding embodiments, wherein the system produces more desired GENE WRITING™ modifications (e.g., at least 500, 400, 300, 200, 100, 90, 80, 70, 60, 50, 40, 30, 20, 10, 9, 8, 7, 6, 5, 4, 3, 2, or 1% more) when modifying DNA than an otherwise similar system wherein, on the target DNA, the location of the nick to the second strand and the location of the nick to the first strand are located between the binding sites of the polypeptide and additional polypeptide, e.g., as measured by PacBio long read sequencing, e.g., as described in Example 29.

287. The system, kit, template RNA, or reaction mixture of any of the preceding embodiments, wherein the system produces more desired GENE WRITING™ modifications (e.g., at least 500, 400, 300, 200, 100, 90, 80, 70, 60, 50, 40, 30, 20, 10, 9, 8, 7, 6, 5, 4, 3, 2, or 1% more) when modifying DNA than an otherwise similar system wherein the location of the nick to the second strand (e.g., relative to the nick to the first strand) is such that the RT domain initiates reverse transcription away from the location of the nick to the second strand, e.g., as measured by PacBio long read sequencing, e.g., as described in Example 29.

288. The system, kit, template RNA, or reaction mixture of any of the preceding embodiments, wherein the first nick and the second nick are at least 100, 110, 120, 130, 140, 150, 160, 170, 180, 190, 200, 220, 240, 260, 280, 300, 350, 400, 450, or 500 nucleotides apart, e.g., at least 100 nucleotides apart, (and optionally no more than 500, 400, 300, 200, 190, 180, 170, 160, 150, 140, 130, or 120 nucleotides apart).

289. The system, kit, template RNA, or reaction mixture of any of the preceding embodiments, wherein the first nick and the second nick are 100-200, 110-200, 120-200, 130-200, 140-200, 150-200, 160-200, 170-200, 180-200, 190-200, 100-190, 110-190, 120-190, 130-190, 140-190, 150-190, 160-190, 170-190, 180-190, 100-180, 110-180, 120-180, 130-180, 140-180, 150-180, 160-180, 170-180, 100-170, 110-170, 120-170, 130-170, 140-170, 150-170, 160-170, 100-160, 110-160, 120-160, 130-160, 140-160, 150-160, 100-150, 110-150, 120-150, 130-150, 140-150, 100-140, 110-140, 120-140, 130-140, 100-130, 110-130, 120-130, 100-120, 110-120, or 100-110 nucleotides apart.

290. The system, kit, template RNA, or reaction mixture of any of the preceding embodiments, wherein the system produces fewer insertions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein the location of the nick to the second strand is less than 100 nucleotides away from the location of the nick to the first strand (and optionally at least 20, 30, 40, 50, 60, 70, 80, or 90 nucleotides away), e.g., as measured by PacBio long read sequencing, e.g., as described in Example 29.

291. The system, kit, template RNA, or reaction mixture of any of the preceding embodiments, wherein the system produces fewer deletions not encoded by the heterologous object sequence (e.g., at least 100, 90, 80, 70, 60, 50, 40, 30, 20, 10, 9, 8, 7, 6, 5, 4, 3, 2, or 1% fewer) when modifying DNA than an otherwise similar system wherein the location of the nick to the second strand is less than 100 nucleotides away from the location of the nick to the first strand (and optionally at least 20, 30, 40, 50, 60, 70, 80, or 90 nucleotides away), e.g., as measured by PacBio long read sequencing, e.g., as described in Example 29.

292. Any above-numbered system, which does not comprise DNA, or which does not comprise more than 10%, 5%, 4%, 3%, 2%, or 1% DNA by mass or by molar amount.

293. A method of making a system for modifying DNA (e.g., as described herein), the method comprising:
  (a) providing a template nucleic acid (e.g., a template RNA or DNA) comprising a heterologous homology sequence having at least 85%, 90%, 95%, 96%, 97%, 98%, 99%, or 100% homology to a sequence comprised in a target DNA molecule, and/or
  (b) providing a polypeptide of the system (e.g., comprising a DNA-binding domain (DBD) and/or an endonuclease domain) comprising a heterologous targeting domain that binds specifically to a sequence comprised in the target DNA molecule.

294. The method of any of the preceding embodiments, wherein:
  (a) comprises introducing into the template nucleic acid (e.g., a template RNA or DNA) a heterologous homology sequence having at least 85%, 90%, 95%, 96%, 97%, 98%, 99%, or 100% homology to the sequence comprised in a target DNA molecule, and/or
  (b) comprises introducing into the polypeptide of the system (e.g., comprising a DNA-binding domain (DBD) and/or an endonuclease domain) the heterologous targeting domain that binds specifically to a sequence comprised in the target DNA molecule.

295. The method of any of the preceding embodiments, wherein the introducing of (a) comprises inserting the homology sequence into the template nucleic acid.

296. The method of any of the preceding embodiments, wherein the introducing of (a) comprises replacing a segment of the template nucleic acid with the homology sequence.

297. The method of any of the preceding embodiments, wherein the introducing of (a) comprises mutating one or more nucleotides (e.g., at least 2, 3, 4, 5, 10, 15, 20, 25, 30, 35, 40, 50, 60, 70, 80, 90, or 100 nucleotides) of the template nucleic acid, thereby producing a segment of the template nucleic acid having the sequence of the homology sequence.

298. The method of any of the preceding embodiments, wherein the introducing of (b) comprises inserting the amino acid sequence of the targeting domain into the amino acid sequence of the polypeptide.

299. The method of any of the preceding embodiments, wherein the introducing of (b) comprises inserting a nucleic acid sequence encoding the targeting domain into a coding sequence of the polypeptide comprised in a nucleic acid molecule.

300. The method of any of the preceding embodiments, wherein the introducing of (b) comprises replacing at least a portion of the polypeptide with the targeting domain.

301. The method of any of the preceding embodiments, wherein the introducing of (a) comprises mutating one or more amino acids (e.g., at least 1, 2, 3, 4, 5, 6, 7, 8, 9, 10, 15, 20, 25, 30, 40, 50, 60, 70, 80, 90, 100, 150, 200, 250, 300, 400, 500, or more amino acids) of the polypeptide.

302. A method for modifying a target site in genomic DNA in a cell, the method comprising contacting the cell with:
  (a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
  (b) a template RNA (or DNA encoding the template RNA) comprising (e.g., from 5' to 3') (i) optionally a sequence that binds the target site (e.g., a second strand of a site in a target genome), (ii) optionally a sequence that binds the polypeptide, (iii) a heterologous object sequence, and (iv) a 3' target homology domain, wherein:
  (i) the polypeptide comprises a heterologous targeting domain (e.g., in the DBD or the endonuclease domain) that binds specifically to a sequence comprised in or adjacent to the target site of the genomic DNA; and/or
  (ii) the template RNA comprises a heterologous homology sequence having at least 85%, 90%, 95%, 96%, 97%, 98%, 99%, or 100% homology to a sequence comprised in or adjacent to the target site of the genomic DNA;
  thereby modifying the target site in genomic DNA in a cell.

303. A method for manufacturing an template RNA, comprising:
  (a) providing an template RNA of any preceding embodiment, and
  (b) assaying one or more of:
    (i) the length of the template RNA, e.g., whether the template RNA has a length that is above a reference length or within a reference length range, e.g., whether at least 80, 85, 90, 95, 96, 97, 98, or 99% of the template RNA present is greater than 100, 125, 150, 175, or 200 nucleotides long;
    (ii) the presence, absence, and/or length of a polyA tail on the template RNA, e.g., whether at least 80, 85, 90, 95, 96, 97, 98, or 99% of the template RNA present contains a polyA tail (e.g., a polyA tail that is at least 5, 10, 20, or 30 nucleotides in length (SEQ ID NO: 3664));
    (iii) the presence, absence, and/or type of a 5' cap on the template RNA, e.g., whether at least 80, 85, 90, 95, 96, 97, 98, or 99% of the template RNA present contains a 5' cap, e.g., whether that cap is a 7-methylguanosine cap, e.g., a O-Me-m7G cap;
    (iv) the presence, absence, and/or type of one or more modified nucleotides (e.g., selected from dihydrouridine, inosine, 7-methylguanosine, 5-methylcytidine (5mC), 5' Phosphate ribothymidine, 2'-O-methyl ribothymidine, 2'-O-ethyl ribothymidine, 2'-fluoro ribothymidine, C-5 propynyl-deoxycytidine (pdC), C-5 propynyl-deoxyuridine (pdU), C-5 propynyl-cytidine (pC), C-5 propynyl-uridine (pU), 5-methyl cytidine, 5-methyl uridine, 5-methyl deoxycytidine, 5-methyl deoxyuridine methoxy, 2,6-diaminopurine, 5'-Dimethoxytrityl-N4-ethyl-2'-deoxycytidine, C-5 propynyl-f-cytidine (pfC), C-5 propynyl-f-uridine (pfU), 5-methyl f-cytidine, 5-methyl f-uridine, C-5 propynyl-m-cytidine (pmC), C-5 propynyl-f-uridine (pmU), 5-methyl m-cytidine, 5-methyl m-uridine, LNA (locked nucleic acid), MGB (minor groove binder) pseudouridine (Ψ), 1-N-methylpseudouridine (1-Me-Ψ), or 5-methoxyuridine (5-MO-U)) in the template RNA, e.g., whether at least 80, 85, 90, 95, 96, 97, 98, or 99% of the template RNA present contains one or more modified nucleotides;
    (v) the stability of the template RNA (e.g., over time and/or under a pre-selected condition), e.g., whether at least 80, 85, 90, 95, 96, 97, 98, or 99% of the template RNA remains intact (e.g., greater than 100, 125, 150, 175, or 200 nucleotides long) after a stability test;
(vi) the potency of the template RNA in a system for modifying DNA, e.g., whether at least 1% of target sites are modified after a system comprising the template RNA is assayed for potency; or
(vii) the presence, absence, and/or level of one or more of a pyrogen, virus, fungus, bacterial pathogen, or host cell protein, e.g., whether the template RNA is free or substantially free of pyrogen, virus, fungus, bacterial pathogen, or host cell protein contamination.

304. A method for manufacturing a system for modifying DNA, comprising:
(a) providing a system for modifying DNA of any preceding embodiment, and
(b) assaying one or more of:
(i) the length of the template RNA, e.g., whether the template RNA has a length that is above a reference length or within a reference length range, e.g., whether at least 80, 85, 90, 95, 96, 97, 98, or 99% of the template RNA present is greater than 100, 125, 150, 175, or 200 nucleotides long;
(ii) the presence, absence, and/or length of a polyA tail on the template RNA, e.g., whether at least 80, 85, 90, 95, 96, 97, 98, or 99% of the template RNA present contains a polyA tail (e.g., a polyA tail that is at least 5, 10, 20, or 30 nucleotides in length (SEQ ID NO: 3664));
(iii) the presence, absence, and/or type of a 5' cap on the template RNA, e.g., whether at least 80, 85, 90, 95, 96, 97, 98, or 99% of the template RNA present contains a 5' cap, e.g., whether that cap is a 7-methylguanosine cap, e.g., a O-Me-m7G cap;
(iv) the presence, absence, and/or type of one or more modified nucleotides (e.g., selected from pseudouridine, dihydrouridine, inosine, 7-methylguanosine, 1-N-methylpseudouridine (1-Me-Ψ), 5-methoxyuridine (5-MO-U), 5-methylcytidine (5mC), or a locked nucleotide in the template RNA, e.g., whether at least 80, 85, 90, 95, 96, 97, 98, or 99% of the template RNA present contains one or more modified nucleotides;
(v) the stability of the template RNA (e.g., over time and/or under a pre-selected condition), e.g., whether at least 80, 85, 90, 95, 96, 97, 98, or 99% of the template RNA remains intact (e.g., greater than 100, 125, 150, 175, or 200 nucleotides long) after a stability test;
(vi) the potency of the template RNA in a system for modifying DNA, e.g., whether at least 1% of target sites are modified after a system comprising the template RNA is assayed for potency;
(vii) the length of the polypeptide, first polypeptide, or second polypeptide, e.g., whether the polypeptide, first polypeptide, or second polypeptide has a length that is above a reference length or within a reference length range, e.g., whether at least 80, 85, 90, 95, 96, 97, 98, or 99% of the polypeptide, first polypeptide, or second polypeptide present is greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long);
(viii) the presence, absence, and/or type of post-translational modification on the polypeptide, first polypeptide, or second polypeptide, e.g., whether at least 80, 85, 90, 95, 96, 97, 98, or 99% of the polypeptide, first polypeptide, or second polypeptide contains phosphorylation, methylation, acetylation, myristoylation, palmitoylation, isoprenylation, glipyatyon, or lipoylation;
(ix) the presence, absence, and/or type of one or more artificial, synthetic, or non-canonical amino acids (e.g., selected from ornithine, β-alanine, GABA, δ-Aminolevulinic acid, PABA, a D-amino acid (e.g., D-alanine or D-glutamate), aminoisobutyric acid, dehydroalanine, cystathionine, lanthionine, Djenkolic acid, Diaminopimelic acid, Homoalanine, Norvaline, Norleucine, Homonorleucine, homoserine, O-methyl-homoserine and O-ethyl-homoserine, ethionine, selenocysteine, selenohomocysteine, selenomethionine, selenoethionine, tellurocysteine, or telluromethionine) in the polypeptide, first polypeptide, or second polypeptide, e.g., whether at least 80, 85, 90, 95, 96, 97, 98, or 99% of the polypeptide, first polypeptide, or second polypeptide present contains one or more artificial, synthetic, or non-canonical amino acids;
(x) the stability of the polypeptide, first polypeptide, or second polypeptide (e.g., over time and/or under a pre-selected condition), e.g., whether at least 80, 85, 90, 95, 96, 97, 98, or 99% of the polypeptide, first polypeptide, or second polypeptide remains intact (e.g., greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long)) after a stability test;
(xi) the potency of the polypeptide, first polypeptide, or second polypeptide in a system for modifying DNA, e.g., whether at least 1% of target sites are modified after a system comprising the polypeptide, first polypeptide, or second polypeptide is assayed for potency; or
(xii) the presence, absence, and/or level of one or more of a pyrogen, virus, fungus, bacterial pathogen, or host cell protein, e.g., whether the system is free or substantially free of pyrogen, virus, fungus, bacterial pathogen, or host cell protein contamination.

305. A method for modifying a target site in genomic DNA in a cell, the method comprising:
contacting the cell with:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds the target site (e.g., a second strand of a site in a target genome), (ii) optionally a sequence that binds the polypeptide, (iii) a heterologous object sequence, and (iv) a 3' target homology domain,
thereby modifying the target site in genomic DNA in a cell.

306. A method for modifying a target site in genomic DNA in a cell, the method comprising:
contacting the cell with a system, polypeptide, template RNA, or DNA encoding the same of any preceding embodiment,
thereby modifying the target site in genomic DNA in a cell.

307. The method of any of the preceding embodiments, wherein a system, polypeptide, template RNA, or DNA are delivered to the target site by electroporation, e.g., nucleofection.

308. The method of any of the preceding embodiments, which does not comprise contacting the cell with DNA, e.g., or which comprises contacting the cell with a composition that not comprise more than 10%, 5%, 4%, 3%, 2%, or 1% DNA by mass or by molar amount.

309. The method of any of the preceding embodiments, which does not comprise contacting the cell with protein, e.g., or which comprises contacting the cell with a composition that not comprise more than 10%, 5%, 4%, 3%, 2%, or 1% protein by mass or by molar amount.

310. The method of any of the preceding embodiments, which comprises contacting a target cell or population of target cells with at least two template RNAs and/or at least two GeneWriter polypeptides, such that at least two target sites (a first target site and a second target site) are modified in a target cell.

311. The method of any of the preceding embodiments, wherein the first target site and the second site are each independently edited at a frequency of at least 5%, 10%, or 15% of copies of the site in a cell population.

312. The method of any of the preceding embodiments, wherein the first target site and the second site are each independently edited at a frequency of at least 50%, 60%, 70%, or 80% of the level of editing obtained in an otherwise similar cell population contacted with an otherwise similar system targeting only one of the target sites.

313. The method of any of the preceding embodiments, wherein the resulting cell population comprises no more than 5%, 10%, or 20% unwanted indels compared to the unwanted indels obtained in an otherwise similar cell population contacted with an otherwise similar system targeting only one of the target sites.

314. The method of any of the preceding embodiments, wherein the cell is a primary cell.

315. The method of any of the preceding embodiments, wherein the cell is a T cell.

316. A method for modifying a target site in genomic DNA in a cell, the method comprising:
contacting the cell, e.g., by nucleofection or lipid particle delivery, with:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds the target site (e.g., a second strand of a site in a target genome), (ii) optionally a sequence that binds the polypeptide, (iii) a heterologous object sequence, and (iv) a 3' target homology domain,
thereby modifying the target site in genomic DNA in a cell,
wherein the cell is euploid, is not immortalized, is part of a tissue, is part of an organism, is a primary cell, is non-dividing, is haploid (e.g., a germline cell), is a non-cancerous polyploid cell, or is from a subject having a genetic disease.

317. The method of any of the preceding embodiments, wherein the template RNA comprises (i).

318. The method of any of the preceding embodiments, wherein the template RNA comprises (ii).

319. The method of any of the preceding embodiments, wherein the template RNA comprises (i) and (ii).

320. A method for treating a subject having a disease or condition associated with a genetic defect, the method comprising:
administering to the subject:
(a) a polypeptide or a nucleic acid encoding the polypeptide, wherein the polypeptide comprises (i) a reverse transcriptase (RT) domain, (ii) a DNA-binding domain (DBD); and (iii) an endonuclease domain, e.g., a nickase domain; and
(b) a template RNA (or DNA encoding the template RNA) comprising (e.g., from 5' to 3') (i) optionally a sequence that binds the target site (e.g., a second strand of a site in a target genome), (ii) optionally a sequence that binds the polypeptide, (iii) a heterologous object sequence, and (iv) a 3' target homology domain,
thereby treating the subject having a disease or condition associated with a genetic defect.

321. The method of any of the preceding embodiments, wherein the template RNA comprises (i).

322. The method of any of the preceding embodiments, wherein the template RNA comprises (ii).

323. The method of any of the preceding embodiments, wherein the template RNA comprises (i) and (ii).

324. A method for treating a subject having a disease or condition associated with a genetic defect, the method comprising:
administering to the subject a system, polypeptide, template RNA, or DNA encoding the same of any preceding embodiment,
thereby treating the subject having a disease or condition associated with a genetic defect.

325. The method of any of the preceding embodiments, wherein the disease or condition associated with a genetic defect is an indication listed in any of Tables 27-30, and/or wherein the genetic defect is a defect in a gene listed in any of Tables 27-30.

326. The method of any of the preceding embodiments, wherein the subject is a human patient.

Definitions

Domain: The term "domain" as used herein refers to a structure of a biomolecule that contributes to a specified function of the biomolecule. A domain may comprise a contiguous region (e.g., a contiguous sequence) or distinct, non-contiguous regions (e.g., non-contiguous sequences) of a biomolecule. Examples of protein domains include, but are not limited to, an endonuclease domain, a DNA binding domain, a reverse transcription domain; an example of a domain of a nucleic acid is a regulatory domain, such as a transcription factor binding domain.

Exogenous: As used herein, the term exogenous, when used with reference to a biomolecule (such as a nucleic acid sequence or polypeptide) means that the biomolecule was introduced into a host genome, cell or organism by the hand of man. For example, a nucleic acid that is as added into an existing genome, cell, tissue or subject using recombinant DNA techniques or other methods is exogenous to the existing nucleic acid sequence, cell, tissue or subject.

First/Second Strand: As used herein, first strand and second strand, as used to describe the individual DNA strands of target DNA, distinguish the two DNA strands based upon which strand the reverse transcriptase domain initiates polymerization, e.g., based upon where target primed synthesis initiates. The first strand refers to the strand of the target DNA upon which the reverse transcriptase domain initiates polymerization, e.g., where target primed synthesis initiates. The second strand refers to the other strand of the target DNA. First and second strand designations do not describe the target site DNA strands in other respects; for example, in some embodiments the first and second strands are nicked by a polypeptide described herein, but the designations 'first' and 'second' strand have no bearing on the order in which such nicks occur.

Genomic safe harbor site (GSH site): A genomic safe harbor site is a site in a host genome that is able to accommodate the integration of new genetic material, e.g., such that the inserted genetic element does not cause significant alterations of the host genome posing a risk to the host cell or organism. A GSH site generally meets 1, 2, 3, 4, 5, 6, 7, 8 or 9 of the following criteria: (i) is located >300 kb from a cancer-related gene; (ii) is >300 kb from a miRNA/other functional small RNA; (iii) is >50 kb from a 5' gene end; (iv) is >50 kb from a replication origin; (v) is >50 kb away from any ultraconservered element; (vi) has low transcriptional activity (i.e. no mRNA+/−25 kb); (vii) is not in copy number variable region; (viii) is in open chromatin; and/or (ix) is unique, with 1 copy in the human genome. Examples of GSH sites in the human genome that meet some or all of these criteria include (i) the adeno-associated virus site 1 (AAVS1), a naturally occurring site of integration of AAV virus on chromosome 19; (ii) the chemokine (C-C motif) receptor 5 (CCR5) gene, a chemokine receptor gene known as an HIV-1 coreceptor; (iii) the human ortholog of the mouse Rosa26 locus; (iv) the rDNA locus. Additional GSH sites are known and described, e.g., in Pellenz et al. epub Aug. 20, 2018 (doi.org/10.1101/396390).

Heterologous: The term heterologous, when used to describe a first element in reference to a second element means that the first element and second element do not exist in nature disposed as described. For example, a heterologous polypeptide, nucleic acid molecule, construct or sequence refers to (a) a polypeptide, nucleic acid molecule or portion of a polypeptide or nucleic acid molecule sequence that is not native to a cell in which it is expressed, (b) a polypeptide or nucleic acid molecule or portion of a polypeptide or nucleic acid molecule that has been altered or mutated relative to its native state, or (c) a polypeptide or nucleic acid molecule with an altered expression as compared to the native expression levels under similar conditions. For example, a heterologous regulatory sequence (e.g., promoter, enhancer) may be used to regulate expression of a gene or a nucleic acid molecule in a way that is different than the gene or a nucleic acid molecule is normally expressed in nature. In another example, a heterologous domain of a polypeptide or nucleic acid sequence (e.g., a DNA binding domain of a polypeptide or nucleic acid encoding a DNA binding domain of a polypeptide) may be disposed relative to other domains or may be a different sequence or from a different source, relative to other domains or portions of a polypeptide or its encoding nucleic acid. In certain embodiments, a heterologous nucleic acid molecule may exist in a native host cell genome, but may have an altered expression level or have a different sequence or both. In other embodiments, heterologous nucleic acid molecules may not be endogenous to a host cell or host genome but instead may have been introduced into a host cell by transformation (e.g., transfection, electroporation), wherein the added molecule may integrate into the host genome or can exist as extra-chromosomal genetic material either transiently (e.g., mRNA) or semi-stably for more than one generation (e.g., episomal viral vector, plasmid or other self-replicating vector).

Inverted Terminal Repeats: The term "inverted terminal repeats" or "ITRs" as used herein refers to AAV viral cis-elements named so because of their symmetry. These elements promote efficient multiplication of an AAV genome. It is hypothesized that the minimal elements for ITR function are a Rep-binding site (RBS; 5'-GCGCGCTCGCTCGCTC-3' (SEQ ID NO: 1538) for AAV2) and a terminal resolution site (TRS; 5'-AGTTGG-3' for AAV2) plus a variable palindromic sequence allowing for hairpin formation. According to the present invention, an ITR comprises at least these three elements (RBS, TRS and sequences allowing the formation of an hairpin). In addition, in the present invention, the term "ITR" refers to ITRs of known natural AAV serotypes (e.g. ITR of a serotype 1, 2, 3, 4, 5, 6, 7, 8, 9, 10 or 11 AAV), to chimeric ITRs formed by the fusion of ITR elements derived from different serotypes, and to functional variant thereof. By functional variant of an ITR, it is referred to a sequence presenting a sequence identity of at least 80%, 85%, 90%, preferably of at least 95% with a known ITR, allowing multiplication of the sequence that includes said ITR in the presence of Rep proteins.

Mutation or Mutated: The term "mutated" when applied to nucleic acid sequences means that nucleotides in a nucleic acid sequence may be inserted, deleted or changed compared to a reference (e.g., native) nucleic acid sequence. A single alteration may be made at a locus (a point mutation) or multiple nucleotides may be inserted, deleted or changed at a single locus. In addition, one or more alterations may be made at any number of loci within a nucleic acid sequence. A nucleic acid sequence may be mutated by any method known in the art.

Nucleic acid molecule: Nucleic acid molecule refers to both RNA and DNA molecules including, without limitation, cDNA, genomic DNA and mRNA, and also includes synthetic nucleic acid molecules, such as those that are chemically synthesized or recombinantly produced, such as RNA templates, as described herein. The nucleic acid molecule can be double-stranded or single-stranded, circular or linear. If single-stranded, the nucleic acid molecule can be the sense strand or the antisense strand. Unless otherwise indicated, and as an example for all sequences described herein under the general format "SEQ. ID NO:," "nucleic acid comprising SEQ. ID NO: 1" refers to a nucleic acid, at least a portion which has either (i) the sequence of SEQ. ID NO: 1, or (ii) a sequence complimentary to SEQ. ID NO: 1. The choice between the two is dictated by the context in which SEQ. ID NO: 1 is used. For instance, if the nucleic acid is used as a probe, the choice between the two is dictated by the requirement that the probe be complimentary to the desired target. Nucleic acid sequences of the present disclosure may be modified chemically or biochemically or may contain non-natural or derivatized nucleotide bases, as will be readily appreciated by those of skill in the art. Such modifications include, for example, labels, methylation, substitution of one or more naturally occurring nucleotides with an analog, inter-nucleotide modifications such as uncharged linkages (for example, methyl phosphonates, phosphotriesters, phosphoramidates, carbamates, etc.), charged linkages (for example, phosphorothioates, phosphorodithioates, etc.), pendant moieties, (for example, polypeptides), intercalators (for example, acridine, psoralen, etc.), chelators, alkylators, and modified linkages (for example, alpha anomeric nucleic acids, etc.). Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of a molecule. Other modifications can include, for example, analogs in which the ribose ring contains a bridging moiety or other structure such as modifications found in "locked" nucleic acids. In various embodiments, the nucleic acids are in operative association with additional genetic elements, such as tissue-specific expression-control sequence(s) (e.g., tissue-specific promoters and tissue-specific microRNA recognition sequences), as well as additional elements, such as inverted repeats (e.g., inverted terminal repeats, such as elements from or derived from viruses, e.g., AAV ITRs) and tandem repeats, inverted repeats/direct repeats (e.g., transposon inverted repeats, e.g., transposon inverted repeats also containing direct repeats, e.g., inverted repeats also containing direct repeats), homology regions (segments with various degrees of homology to a target DNA), UTRs (5', 3', or both 5' and 3' UTRs), and various combinations of the foregoing. The nucleic acid elements of the systems provided by the invention can be provided in a variety of topologies, including single-stranded, double-stranded, circular, linear, linear with open ends, linear with closed ends, and particular versions of these, such as doggybone DNA (dbDNA), close-ended DNA (ceDNA).

Gene expression unit: a gene expression unit is a nucleic acid sequence comprising at least one regulatory nucleic acid sequence operably linked to at least one effector sequence. A first nucleic acid sequence is operably linked with a second nucleic acid sequence when the first nucleic acid sequence is placed in a functional relationship with the second nucleic acid sequence. For instance, a promoter or enhancer is operably linked to a coding sequence if the promoter or enhancer affects the transcription or expression of the coding sequence. Operably linked DNA sequences may be contiguous or non-contiguous. Where necessary to join two protein-coding regions, operably linked sequences may be in the same reading frame.

Host: The terms host genome or host cell, as used herein, refer to a cell and/or its genome into which protein and/or genetic material has been introduced. It should be understood that such terms are intended to refer not only to the particular subject cell and/or genome, but to the progeny of such a cell and/or the genome of the progeny of such a cell. Because certain modifications may occur in succeeding generations due to either mutation or environmental influences, such progeny may not, in fact, be identical to the parent cell, but are still included within the scope of the term "host cell" as used herein. A host genome or host cell may be an isolated cell or cell line grown in culture, or genomic material isolated from such a cell or cell line, or may be a host cell or host genome which composing living tissue or an organism. In some instances, a host cell may be an animal cell or a plant cell, e.g., as described herein. In certain instances, a host cell may be a bovine cell, horse cell, pig cell, goat cell, sheep cell, chicken cell, or turkey cell. In certain instances, a host cell may be a corn cell, soy cell, wheat cell, or rice cell.

Operative association: As used herein, "operative association" describes a functional relationship between two nucleic acid sequences, such as a 1) promoter and 2) a heterologous object sequence, and means, in such example, the promoter and heterologous object sequence (e.g., a gene of interest) are oriented such that, under suitable conditions, the promoter drives expression of the heterologous object sequence. For instance, the template nucleic acid may be single-stranded, e.g., either the (+) or (−) orientation but an operative association between promoter and heterologous object sequence means whether or not the template nucleic acid will transcribe in a particular state, when it is in the suitable state (e.g., is in the (+) orientation, in the presence of required catalytic factors, and NTPs, etc.), it does accurately transcribe. Operative association applies analogously to other pairs of nucleic acids, including other tissue-specific expression control sequences (such as enhancers, repressors and microRNA recognition sequences), IR/DR, ITRs, UTRs, or homology regions and heterologous object sequences or sequences encoding a transposase.

Pseudoknot: A "pseudoknot sequence" sequence, as used herein, refers to a nucleic acid (e.g., RNA) having a sequence with suitable self-complementarity to form a pseudoknot structure, e.g., having: a first segment, a second segment between the first segment and a third segment, wherein the third segment is complementary to the first segment, and a fourth segment, wherein the fourth segment is complementary to the second segment. The pseudoknot may optionally have additional secondary structure, e.g., a stem loop disposed in the second segment, a stem-loop disposed between the second segment and third segment, sequence before the first segment, or sequence after the fourth segment. The pseudoknot may have additional sequence between the first and second segments, between the second and third segments, or between the third and fourth segments. In some embodiments, the segments are arranged, from 5' to 3': first, second, third, and fourth. In some embodiments, the first and third segments comprise five base pairs of perfect complementarity. In some embodiments, the second and fourth segments comprise 10 base pairs, optionally with one or more (e.g., two) bulges. In some embodiments, the second segment comprises one or more unpaired nucleotides, e.g., forming a loop. In some embodiments, the third segment comprises one or more unpaired nucleotides, e.g., forming a loop.

Stem-loop sequence: As used herein, a "stem-loop sequence" refers to a nucleic acid sequence (e.g., RNA sequence) with sufficient self-complementarity to form a stem-loop, e.g., having a stem comprising at least two (e.g., 3, 4, 5, 6, 7, 8, 9, or 10) base pairs, and a loop with at least three (e.g., four) base pairs. The stem may comprise mismatches or bulges.

Tissue-specific expression-control sequence(s): As used herein, a "tissue-specific expression-control sequence" means nucleic acid elements that increase or decrease the level of a transcript comprising the heterologous object sequence in the target tissue in a tissue-specific manner, e.g., preferentially in an on-target tissue(s), relative to an off-target tissue(s). In some embodiments, a tissue-specific expression-control sequence preferentially drives or represses transcription, activity, or the half-life of a transcript comprising the heterologous object sequence in the target tissue in a tissue-specific manner, e.g., preferentially in an on-target tissue(s), relative to an off-target tissue(s). Exemplary tissue-specific expression-control sequences include tissue-specific promoters, repressors, enhancers, or combinations thereof, as well as tissue-specific microRNA recognition sequences. Tissue specificity refers to on-target (tissue(s) where expression or activity of the template nucleic acid is desired or tolerable) and off-target (tissue(s) where expression or activity of the template nucleic acid is not desired or is not tolerable). For example, a tissue-specific promoter (such as a promoter in a template nucleic acid or controlling expression of a transposase) drives expression preferentially in on-target tissues, relative to off-target tissues. In contrast, a micro-RNA that binds the tissue-specific microRNA recognition sequences (either on a nucleic acid encoding the transposase or on the template nucleic acid, or both) is preferentially expressed in off-target tissues, relative to on-target tissues, thereby reducing expression of a template nucleic acid (or transposase) in off-target tissues. Accordingly, a promoter and a microRNA recognition sequence that are specific for the same tissue, such as the target tissue, have contrasting functions (promote and repress, respectively, with concordant expression levels, i.e., high levels of the microRNA in off-target tissues and low levels in on-target tissues, while promoters drive high expression in on-target tissues and low expression in off-target tissues) with regard to the transcription, activity, or half-life of an associated sequence in that tissue.

The patent or application file contains at least one drawing executed in color. Copies of this patent or patent application publication with color drawing(s) will be provided by the Office upon request and payment of the necessary fee.

BRIEF DESCRIPTION OF THE DRAWINGS

FIG. 6 is a table listing the modules of an exemplary GENE WRITER™ RNA template. Individual modules can be combined, re-arranged, and/or omitted, e.g., to produce a GENE WRITER™ template. A=5' homology arm; B=Ribozyme; C=5' UTR; D=heterologous object sequence; E=3' UTR; F=3' homology arm.

(FIG. 7A) A Cas9 nickase is fused to a GENE WRITER™ protein. The GENE WRITER™ protein introduces a nick in a DNA strand through its EN domain (shown as *), and the fused Cas9 nickase introduces a nicks on either top or bottom DNA strands (shown as X). (FIG. 7B) A GENE WRITER™ is targeted to DNA through its DNA biding domain and introduces a DNA nick with its EN domain (*). A Cas9 nickase is then used the generate a second nick (X) at the top or bottom strand, upstream or downstream of the EN introduced nick.

FIG. 10A. ddPCR assay measuring percentage of integrations from all lentiviral integrated landing pads per cell.

FIGS. 14A and 14B. Schematic of Cas9 nickase GENE WRITER™ fusions. (FIG. 14A) Schematic of nickaseCas9 fused to GENE WRITER™ protein. (FIG. 14B) Schematic of 3' extended gRNA.

FIGS. 15A and 15B. Schematic of Cas9 nickase GENE WRITER™ fusions. (FIG. 15A) Schematic of nickaseCas9 fused to GENE WRITER™ protein. (FIG. 15B) Schematic of donor transgene flanked by UTRs and homology to the cut site.

(FIG. 16A) Schematic of GENE WRITER™ protein. (FIG. 16B) Schematic of donor transgene flanked by UTRs and homology to the cut site. (FIG. 16C) Schematic of Cas9 constructs used.

FIGS. 25A-25C. (FIG. 25A) Timeline of experiment. (FIG. 25B) Schematic of R2Tg and transgene construct configurations. (FIG. 25C) Western Blot against Rad51 shows loss of Rad51 protein expression at day 3.

(FIG. 27A) Sequence map of Ribozyme of R2 element from *Taeniopygia guttata* (R2Tg) in context of modules of GENE WRITER™ transgene molecule RNA. The Ribozyme features are denoted as: P, based paired region; P', based pair region complement strand; L, loop at end of P region; J, nucleotides joining base paired regions. Figure discloses SEQ ID NO: 1734. (FIG. 27B) Prediction of ribozyme secondary structure of R2Tg. Shaded box indicates a predicted catalytic position that could be used to inactivate the ribozyme. Figure discloses SEQ ID NO: 1734.

FIG. 30. GENE WRITING™ system for treating an exemplary repeat expansion disorder. Figure discloses SEQ ID NOS 1645, 1599, 1645, 1635-1636, 1645 and 1686-1688, respectively, in order of appearance.

FIG. 31. An illustration of two orientations of second strand nicking in an exemplary GENE WRITING™ system.

FIGS. 36A and 36B Disclose application of mutations improving reverse transcriptase domains. Conserved reverse transcriptase domains from the retrovirus genera Betaretrovirus, Deltaretrovirus, Gammaretrovirus, Epsilonretrovirus, and Spumavirus were aligned and compared to mutations previously shown to improve RT activity (Anzalone et al Nat Biotechnol 38 (7): 824-844 (2020); Baranauskas et al Protein Eng Des Sel 25 (10): 657-668 (2012); Arczi and Hogrefe Nucleic Acids Res 37 (2): 473-481 (2009)). FIG. 36A shows a set of 3 core mutations was identified and applied to RTs from these genera as indicated in. FIG. 36B discloses additional mutations were applied with first priority from the set of T306K/W313F, or alternately from L139P/E607K where neither of the first set were deemed transferrable. Selected mutations are shown in Table 18. FIGS. 36A and 36B disclose SEQ ID NOS 3610, 3623, 3637, 3611, 3624, 3638, 3611, 3624, 3639, 3612, 3625, 3640, 3613, 3626, 3641, 3611, 3627, 3642, 3614, 3628, 3643, 3615, 3629, 3644, 3616, 3630, 3645, 3617, 3630, 3645, 3618, 3631, 3646, 3619, 3632, 3647, 3620, 3633, 3648, 3621, 3634, 3649, 3622, 3635, 3650, 3622, 3636, 3651, 3652, 2060, 2738, 3653, 2086, 2758, 3653, 2086, 2759, 3654, 2087, 2773, 3655, 2088, 2775, 3653, 2086, 2863, 3656, 2103, 3046, 3657, 2104, 3080, 3658, 2120, 3081, 3658, 2175, 3081, 3659, 2221, 3082, 3660, 2279, 3102, 3661, 2525, 3103, 3662, 2704, 3122, 1850, 2736, 3125, 1905, 2737, and 2123, respectively, in order of appearance.

FIG. 43A shows all-RNA lipofection of various Cas9-RT (MMLV) mRNAs into HEK293T was performed using Template 1 (Table 59) and delivering via LIPOFECTAMINE™ 3000. FIG. 43B shows all-RNA lipofection of various Cas9-RT (MMLV) mRNAs into HEK293T was performed using Template 1 (Table 59) and delivering via MESSENGERMAX™ reagent. These data indicated higher precise editing efficiencies with the MESSENGERMAX™ reagent. FIG. 43C shows assay of two Templates differing in total length using MESSENGERMAX™ reagent. No major changes in efficiency of editing were found to be associated with the template change in this experiment. Where included head-to-head, the addition of the second-nick gRNA resulted in an increase in efficiency of the system.

FIG. 45A shows GENE WRITER™ protein expression from mRNAs with varying doses delivered into primary human CD4+ T cells at day 1 post-nucleofection. GENE WRITER™ was detected by an antibody targeting a Cas9 part of the polypeptide. GAPDH, a housekeeping gene, was detected by an antibody against GAPDH. Increasing expression levels were observed with increasing doses of nucleofected mRNA encoding the polypeptide were delivered, e.g., 0, 2.5, 5, and 10 µg GENE WRITER™ mRNAs. Data for the detection of protein expression shown comprised 2 replicate.
FIG. 45B shows Cell viability after nucleofection of 6 Template RNAs. Viability of primary CD4+ T cells after RNA delivery of the Gene Rewriter system at day 3 post nucleofection. Cell viability was assessed by flow cytometry after live/dead staining of harvested T cells (mean±s.d., n=2 replicates).
[Gate: Live Cells in a Singlet Population of Cell Population Selected by FSC/SSC Size Plot]

FIG. 46A shows precise editing of the HEK3 genomic locus by a GENE WRITER™ system in primary human CD4+ T cells, without addition of second-nick gRNA. FIG. 46B shows precise editing of the HEK3 genomic locus by a GENE WRITER™ system in primary human CD4+ T cells. Genomic DNA was extracted from cells at day 3 post-nucleofection. Genome editing of HEK3 was examined by PCR-based amplicon-sequencing assay. DNA amplicons containing the expected genomic alteration were identified as Precise Write events, whereas amplicons with unintended editing (e.g. insertion, deletion) were counted as Indels. The percentage of each was calculated based on total reads per condition (mean±s.d., n=2 replicates).

FIG. 47A shows in this experiment, the addition of a second-nick gRNA did not result in an enhanced precise writing signal. FIG. 47B shows rather, the use of a second-nick gRNA may have increased the frequency of indels.

Figure 47A:
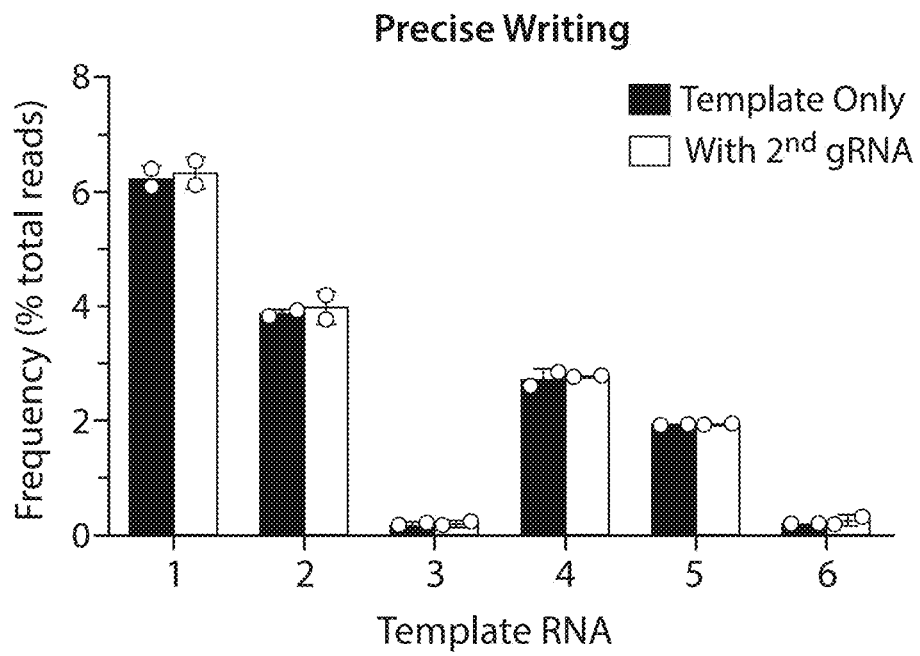
FIGS. 47A and 47B show use of a second-nick gRNA for GENE WRITING™ in primary human CD4+ T cells. The data generated in FIG. 46 are shown here for a direct comparison of potential effects of second-nick gRNA on efficiency.
Figure 47B:
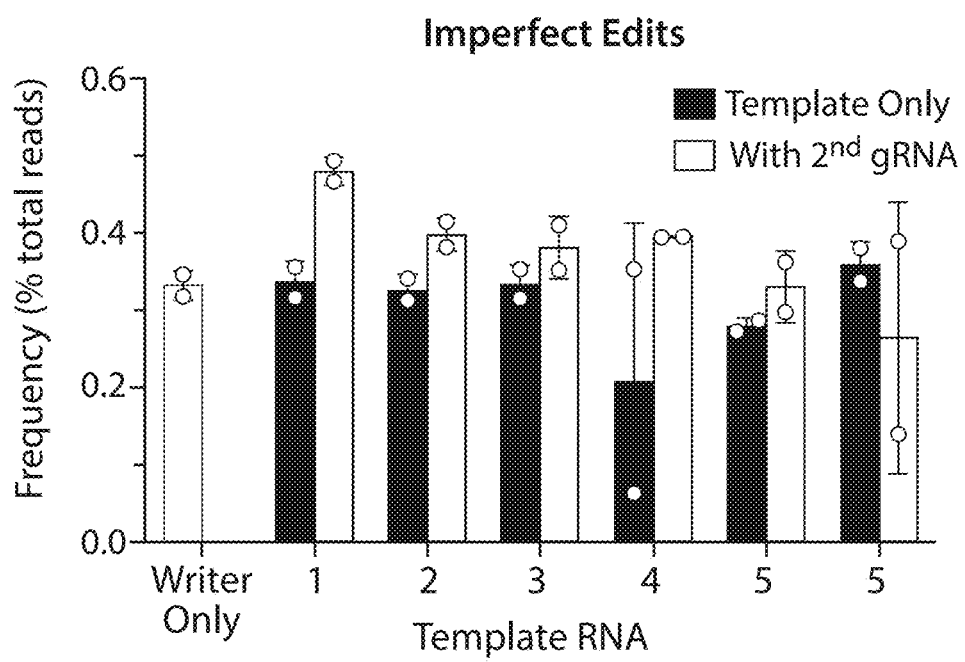

Thus, in some embodiments, a second nick gRNA sequence may be absent from a system described herein. Precise editing of HEK3 genomic site by the GENE WRITER™ system in primary human CD4+ T cells, without (FIG. 47A) or with addition of second-nick gRNA (FIG. 47B). Genomic DNA was extracted from cells at day 3 post-nucleofection. Genome editing of HEK3 was examined by PCR-based amplicon-sequencing assay. DNA amplicons containing the expected genomic alteration by GENE WRITER™ system were identified as Precise Write events, whereas amplicons with unintended editing (e.g. insertion, deletion) were counted as Indels. The percentage of each was calculated based on total reads per condition (mean±s.d., n=2 replicates).

Figure 48:
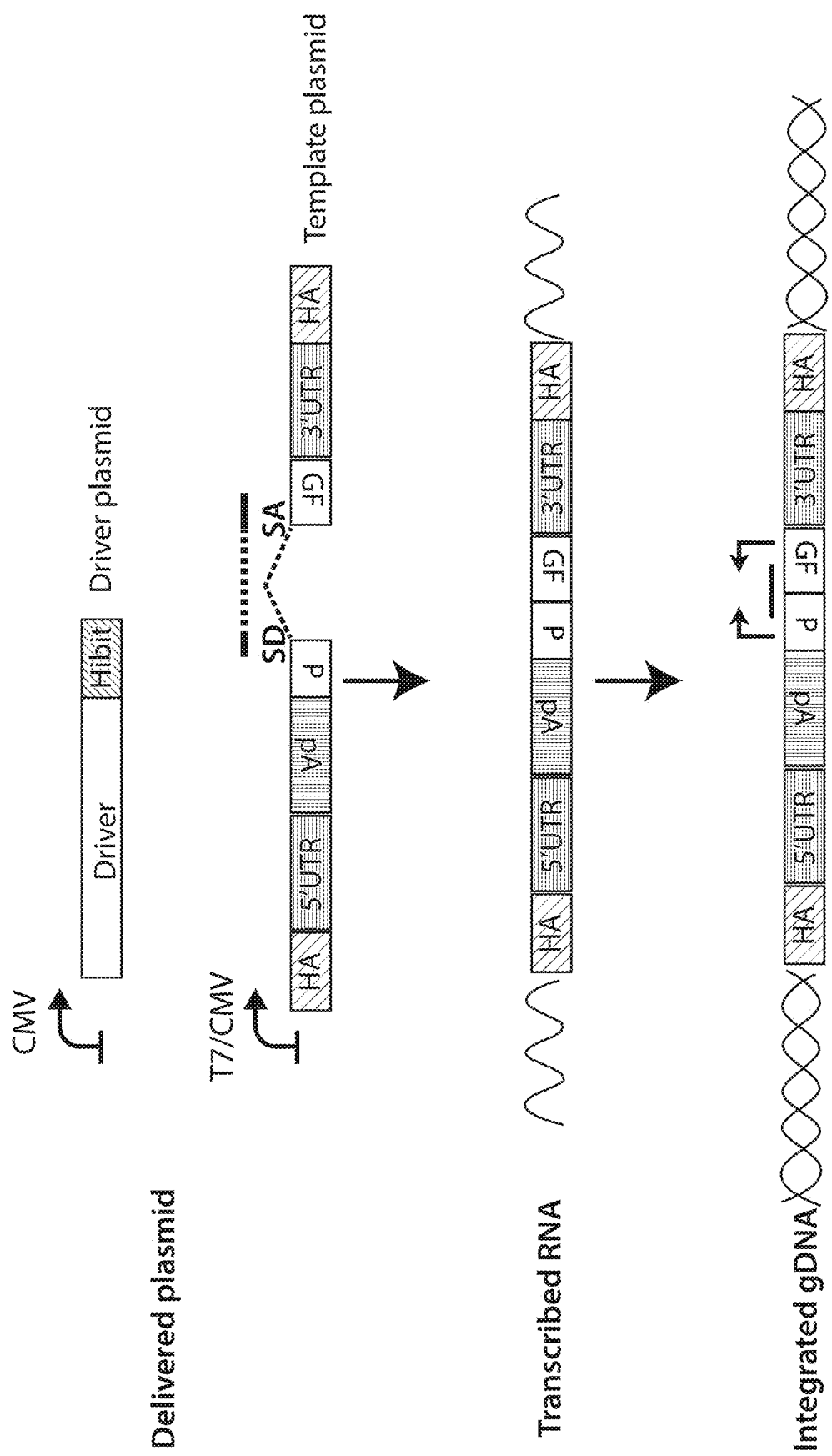

FIG. 48. shows screening construct design for retrotransposon-mediated integration in human cells. A driver plasmid comprising a retrotransposase (Driver) expression cassette is transfected together with a template plasmid comprising a retrotransposon-dependent reporter cassette. Whereas expression from the template plasmid results in a non-functional GFP because of an interrupting antisense intron, transcription of the template molecule from the template plasmid results in the generation of an RNA with the intron removed by splicing that can then be reverse transcribed and integrated by the system. Expression of the reporter cassette will thus only occur from the integrated reporter cassette (Integrated gDNA, bottom) and not from the template plasmid. HA=homology arm, where applicable; CMV=mammalian CMV promoter; HiBit=HiBit tag for quantification of protein expression; T7=T7 RNA polymerase promoter; UTR=untranslated sequence, e.g., native retrotransposon UTRs; pA=poly A signal; SD-SA is used to indicate the splice-donor and splice-acceptor sites of an antisense intron in the GFP coding sequence.

Figure 49:
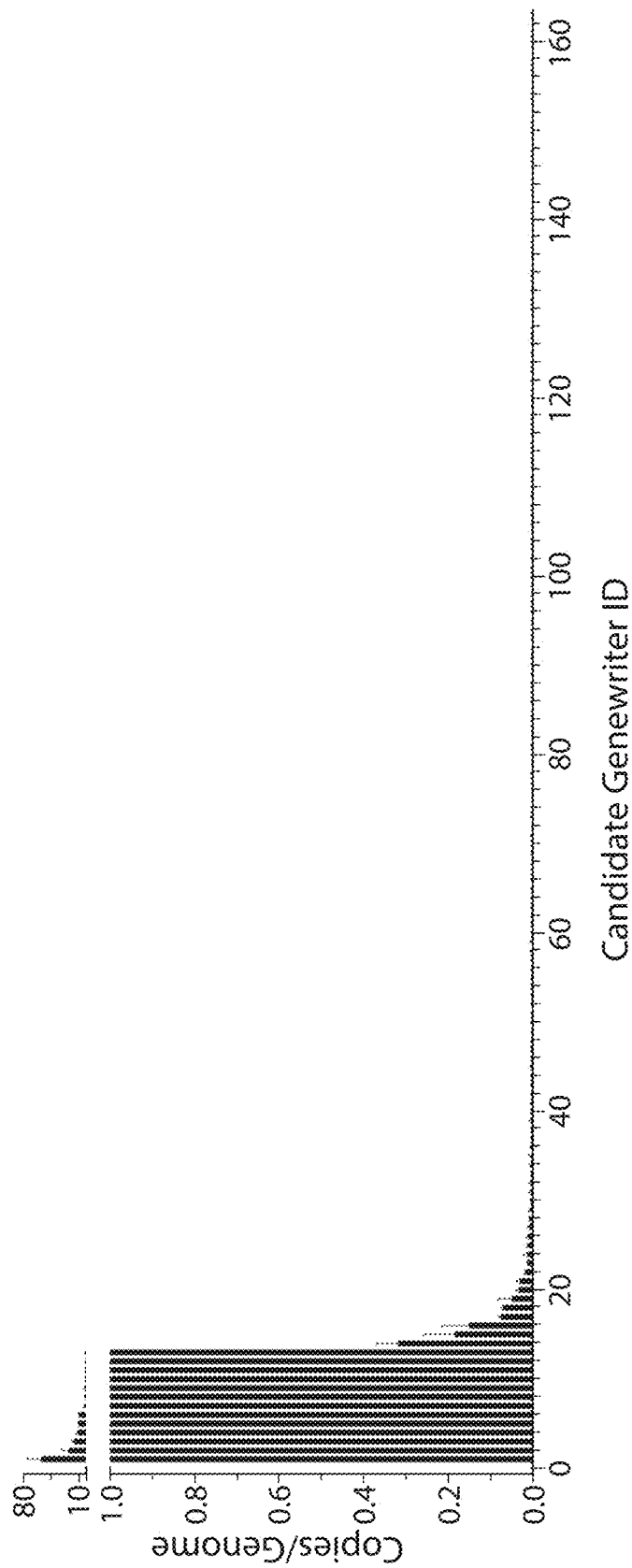

FIG. 49. Screening of candidate retrotransposons identifies 25 candidates working to integrate a trans payload in human cells. A total of 163 retrotransposon systems were assayed for activity in human cells as described in Example 39. Integration as measured by ddPCR is shown as copies/genome for each retrotransposon driver/template system. The height of each bar indicates the average value of two replicates.

Figure 50A:
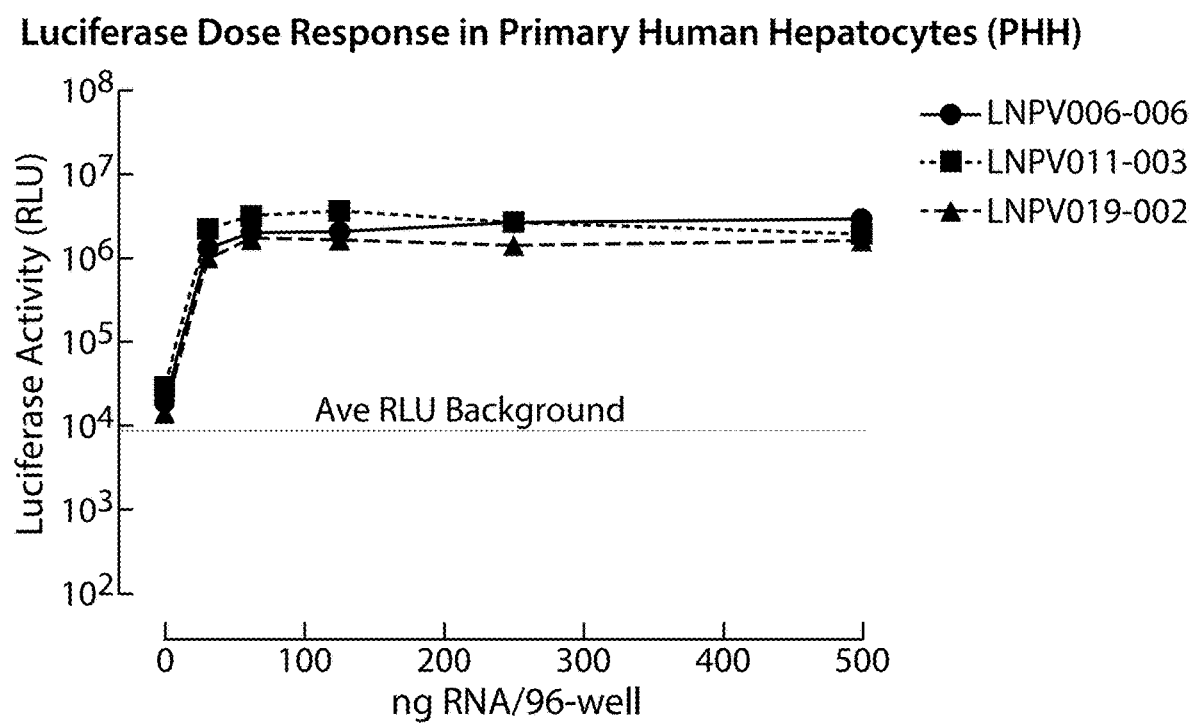
Figure 50B:
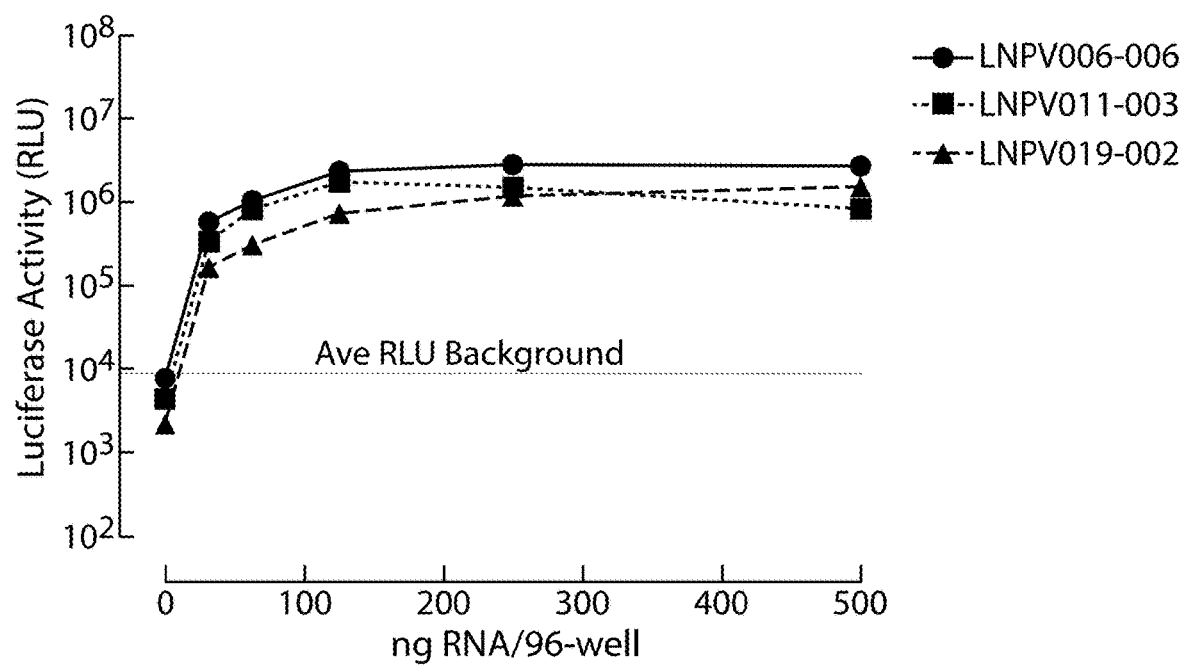

FIGS. 50A and 50B show luciferase activity assay for primary cells. LNPs formulated as according to Example 44 were analyzed for delivery of cargo to primary human (A) and mouse (B) hepatocytes, as according to Example 45. The luciferase assay revealed dose-responsive luciferase activity from cell lysates, indicating successful delivery of RNA to the cells and expression of Firefly luciferase from the mRNA cargo.

Figure 51:
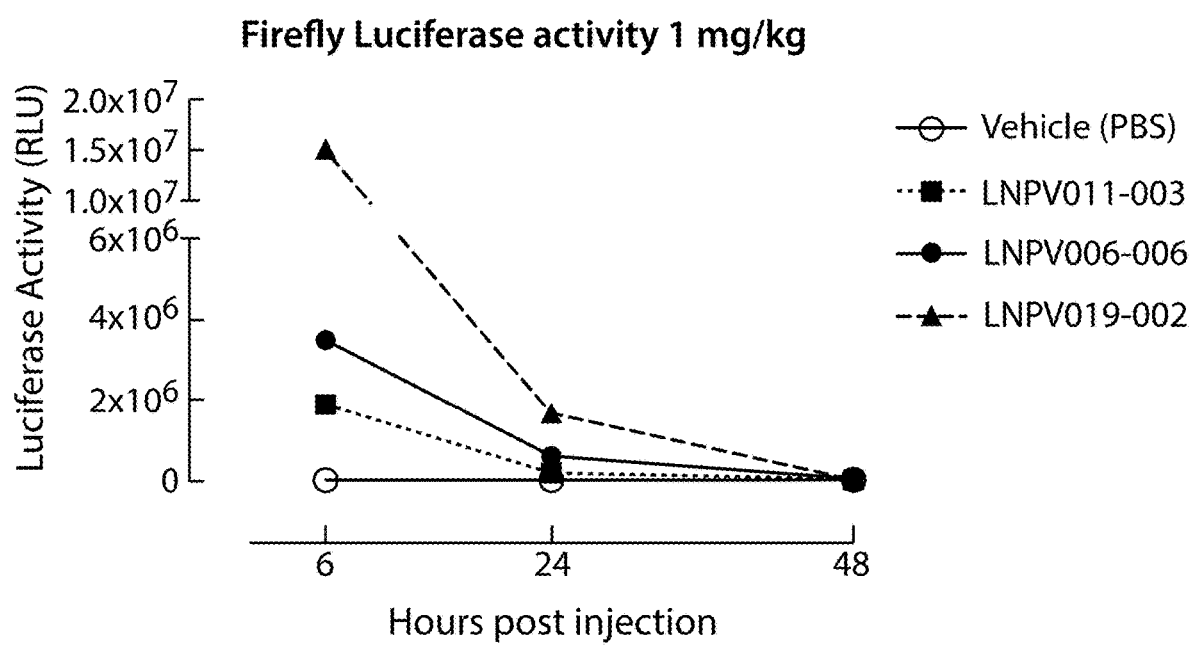

FIG. 51 discloses LNP-mediated delivery of RNA cargo to the murine liver. Firefly luciferase mRNA-containing LNPs were formulated and delivered to mice by iv, and liver samples were harvested and assayed for luciferase activity at 6, 24, and 48 hours post administration. Reporter activity by the various formulations followed the ranking LIPIDV005>LIPIDV004>LIPIDV003. RNA expression was transient and enzyme levels returned near vehicle background by 48 hours. Post-administration.

DETAILED DESCRIPTION

This disclosure relates to compositions, systems and methods for targeting, editing, modifying or manipulating a DNA sequence (e.g., inserting a heterologous object sequence into a target site of a mammalian genome) at one or more locations in a DNA sequence in a cell, tissue or subject, e.g., in vivo or in vitro. The heterologous object DNA sequence may include, e.g., a substitution, a deletion, an insertion, e.g., a coding sequence, a regulatory sequence, or a gene expression unit.

More specifically, the disclosure provides reverse transcriptase-based systems for altering a genomic DNA sequence of interest, e.g., by inserting, deleting, or substituting one or more nucleotides into/from the sequence of interest. This disclosure is based, in part, on a bioinformatic analysis to identify reverse transcriptase sequences, for example in retrotransposons from a variety of organisms (see Table 2 or 4).

The disclosure provides, in part, GENE WRITER™ genome editors comprising a polypeptide component and a template nucleic acid (e.g., template RNA) component. In some embodiments, a GENE WRITER™ genome editor can be used to introduce an alteration into a target site in a genome. In some embodiments, the polypeptide component comprises a writing domain (e.g., a reverse transcriptase domain), a DNA-binding domain, and an endonuclease domain (e.g., nickase domain). In some embodiments, the template nucleic acid (e.g., template RNA) comprises a sequence that binds a target site in the genome (e.g., that binds to a second strand of the target site), a sequence that binds the polypeptide component, a heterologous object sequence, and a 3' target homology domain. Without wishing to be bound by theory, it is thought that the template nucleic acid (e.g., template RNA) binds to the second strand of a target site in the genome, and binds to the polypeptide component (e.g., localizing the polypeptide component to the target site in the genome). It is thought that the endonuclease (e.g., nickase) of the polypeptide component cuts the target site (e.g., the first strand of the target site), e.g., allowing the 3'homology domain to bind to a sequence adjacent to the site to be altered on the first strand of the target site. It is thought that the writing domain (e.g., reverse transcriptase domain) of the polypeptide component uses the 3' target homology domain as a primer and the heterologous object sequence as a template to, e.g., polymerize a sequence complementary to the heterologous object sequence. Without wishing to be bound by theory, it is thought that selection of an appropriate heterologous object sequence can result in substitution, deletion, or insertion of one or more nucleotides at the target site.

In embodiments, the disclosure provides a nucleic acid molecule or a system for retargeting, e.g., of a GENE WRITER™ polypeptide or nucleic acid molecule, or of a system as described herein. Retargeting (e.g., of a GENE WRITER™ polypeptide or nucleic acid molecule, or of a system as described herein) generally comprises: (i) directing the polypeptide to bind and cleave at the target site; and/or (ii) designing the template RNA to have complementarity to the target sequence. In some embodiments, the template RNA has complementarity to the target sequence 5' of the first-strand nick, e.g., such that the 3' end of the template RNA anneals and the 5' end of the target site serves as the primer, e.g., for target-primed reverse transcription (TPRT). In some embodiments, the endonuclease domain of the polypeptide and the 5' end of the RNA template are also modified as described.

GENE WRITER™ Genome Editors

GENE WRITER™ genome editors are systems that are capable of modifying a host cell's genome and can be applied for the mutation, deletion, or other modification of a genomic target sequence, including the insertion of heterologous payloads. In some embodiments, these systems take inspiration from a group of naturally evolved mobile genetic elements known as retrotransposons. GENE WRITER™ polypeptides can also comprise RT domains derived from sources other than retrotransposons, e.g., from viruses.

Non-long terminal repeat (LTR) retrotransposons are a type of mobile genetic elements that are widespread in eukaryotic genomes. They include two classes: the apurinic/apyrimidinic endonuclease (APE)-type and the restriction enzyme-like endonuclease (RLE)-type. The APE class retrotransposons are comprised of two functional domains: an endonuclease/DNA binding domain, and a reverse transcriptase domain. The RLE class are comprised of three functional domains: a DNA binding domain, a reverse transcription domain, and an endonuclease domain. The reverse transcriptase domain of non-LTR retrotransposon functions by binding an RNA sequence template and reverse transcribing it into the host genome's target DNA. The RNA sequence template has a 3' untranslated region which is specifically bound to the transposase, and a variable 5' region generally having Open Reading Frame(s) ("ORF") encoding transposase proteins. The RNA sequence template may also comprise a 5' untranslated region which specifically binds the retrotransposase.

In some embodiments, as described herein, the elements of such non-LTR retrotransposons can be functionally modularized and/or modified to target, edit, modify or manipulate a target DNA sequence, e.g., to insert an object (e.g., heterologous) nucleic acid sequence into a target genome, e.g., a mammalian genome, by reverse transcription. Such modularized and modified nucleic acids, polypeptide compositions and systems are described herein and are referred to as GENE WRITER™ gene editors. A GENE WRITER™ gene editor system comprises: (A) a polypeptide or a nucleic acid encoding a polypeptide, wherein the polypeptide comprises (i) a reverse transcriptase domain, and either (x) an endonuclease domain that contains DNA binding functionality or (y) an endonuclease domain and separate DNA binding domain; and (B) a template RNA comprising (i) a sequence that binds the polypeptide and (ii) a heterologous insert sequence. For example, the GENE WRITER™ genome editor protein may comprise a DNA-binding domain, a reverse transcriptase domain, and an endonuclease domain. In some embodiments, the DNA-binding function may involve an RNA component that directs the protein to a DNA sequence, e.g, a gRNA. In other embodiments, the GENE WRITER™ genome editor protein may comprise a reverse transcriptase domain and an endonuclease domain. In certain embodiments, the elements of the GENE WRITER™ gene editor polypeptide can be derived from sequences of non-LTR retrotransposons, e.g., APE-type or RLE-type retrotransposons or portions or domains thereof. In some embodiments the RLE-type non-LTR retrotransposon is from the R2, NeSL, HERO, R4, or CRE clade. In some embodiments the GENE WRITER™ genome editor is derived from R4 element X4_Line, which is found in the human genome. In some embodiments the APE-type non-LTR retrotransposon is from the R1, or Tx1 clade. In some embodiments the GENE WRITER™ genome editor is derived from Tx1 element Mare6, which is found in the human genome. The RNA template element of a GENE WRITER™ gene editor system is typically heterologous to the polypeptide element and provides an object sequence to be inserted (reverse transcribed) into the host genome. In some embodiments the GENE WRITER™ genome editor protein is capable of target primed reverse transcription. In some embodiments, the GENE WRITER™ genome editor protein is capable of second strand synthesis. Table 1 shows exemplary GENE WRITER™ proteins and associated sequences from a variety of retrotransposases, identified using data mining. Column 1 indicates the family to which the retrotransposon belongs. Column 2 lists the element name. Column 3 indicates an accession number, if any. Column 4 lists an organism in which the retrotransposase is found. Column 5 lists the predicted 5' untranslated region, and column 6 lists the predicted 3' untranslated region; both are segments that are predicted to allow the template RNA to bind the retrotransposase of column 7. (It is understood that columns 5-6 show the DNA sequence, and that an RNA sequence according to any of columns 5-6 would typically include uracil rather than thymidine.) Column 7 lists the predicted retrotransposase amino acid sequence. Column 8 lists the predicted RT domain present based on sequence analysis, column 9 lists the start codon position, and column 10 lists the stop codon position.

Lengthy table referenced here

US12157898-20241203-T00001

Please refer to the end of the specification for access instructions.

In some embodiments the GENE WRITER™ genome editor is combined with a second polypeptide. In some embodiments the second polypeptide is derived from an APE-type non-LTR retrotransposon. In some embodiments the second polypeptide has a zinc knuckle-like motif. In some embodiments the second polypeptide is a homolog of Gag proteins.

Inspired by the success of retrotransposons in nature, it is further discussed here that the natural function of a retrotransposon can be recapitulated using functional parts derived from completely independent systems. For example, a functional GENE WRITER™ can be made up of unrelated DNA binding, reverse transcription, and endonuclease domains. This modular structure allows combining of functional domains, e.g., dCas9 (DNA binding), MMLV reverse transcriptase (reverse transcription), FokI (endonuclease). In some embodiments, multiple functional domains may arise from a single protein, e.g., Cas9 nickase (DNA binding, endonuclease), R2 retrotransposon (DNA binding, reverse transcription, endonuclease).

In some embodiments, a GENE WRITER™ system is capable of producing an insertion into the target site of at least 45, 50, 55, 60, 65, 70, 75, 80, 85, 90, 95, or 100 nucleotides (and optionally no more than 500, 400, 300, 200, or 100 nucleotides). In some embodiments, a GENE WRITER™ system is capable of producing an insertion into the target site of at least 1, 2, 3, 4, 5, 6, 7, 8, 9, 10, 15, 20, 25, 30, 35, 40, 45, 50, 55, 60, 65, 70, 75, 80, 85, 90, 95, or 100 nucleotides (and optionally no more than 500, 400, 300, 200, or 100 nucleotides). In some embodiments, a GENE WRITER™ system is capable of producing an insertion into the target site of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a GENE WRITER™ system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a GENE WRITER™ system is capable of producing a deletion of at least 81, 85, 90, 95, 100, 110, 120, 130, 140, 150, 160, 170, 180, 190, or 200 nucleotides (and optionally no more than 500, 400, 300, or 200 nucleotides). In some embodiments, a GENE WRITER™ system is capable of producing a deletion of at least 1, 2, 3, 4, 5, 6, 7, 8, 9, 10, 15, 20, 25, 30, 35, 40, 45, 50, 55, 60, 65, 70, 75, 80, 85, 90, 95, 100, 110, 120, 130, 140, 150, 160, 170, 180, 190, or 200 nucleotides (and optionally no more than 500, 400, 300, or 200 nucleotides). In some embodiments, a GENE WRITER™ system is capable of producing a deletion of at least 0.2, 0.3, 0.4, 0.5, 0.6, 0.7, 0.8, 0.9, 1, 1.5, 2, 2.5, 3, 3.5, 4, 4.5, 5, 5.5, 6, 6.5, 7, 7.5, 8, 8.5, 9, 9.5 or 10 kilobases (and optionally no more than 1, 5, 10, or 20 kilobases). In some embodiments, a GENE WRITER™ system is capable of producing a substitution into the target site of at least 1, 2, 3, 4, 5, 6, 7, 8, 9, 10, 15, 20, 25, 30, 35, 40, 45, 50, 60, 70, 80, 90, or 100 or more nucleotides. In some embodiments, the substitution is a transition mutation. In some embodiments, the substitution is a transversion mutation. In some embodiments, the substitution converts an adenine to a thymine, an adenine to a guanine, an adenine to a cytosine, a guanine to a thymine, a guanine to a cytosine, a guanine to an adenine, a thymine to a cytosine, a thymine to an adenine, a thymine to a guanine, a cytosine to an adenine, a cytosine to a guanine, or a cytosine to a thymine.

Polypeptide Component of GENE WRITER™ Gene Editor System

Domains and Functions:

In some embodiments, the GENE WRITER™ polypeptide possesses the functions of DNA target site binding, template nucleic acid (e.g., RNA) binding, DNA target site cleavage, and template nucleic acid (e.g., RNA) writing, e.g., reverse transcription. In some embodiments, each functions is contained within a distinct domain. In some embodiments, a function may be attributed to two or more domains (e.g., two or more domains, together, exhibit the functionality). In some embodiments, two or more domains may have the same or similar function (e.g., two or more domains each independently have DNA-binding functionality, e.g., for two different DNA sequences). In other embodiments, one or more domains may be capable of enabling one or more functions, e.g., a Cas9 domain enabling both DNA binding and target site cleavage. In some embodiments, the domains are all located within a single polypeptide. In some embodiments, a first domain is in one polypeptide and a second domain is in a second polypeptide. For example, in some embodiments, the GENE WRITER™ polypeptide may be split between a first polypeptide and a second polypeptide, e.g., wherein the first polypeptide comprises a reverse transcriptase (RT) domain and wherein the second polypeptide comprises a DNA-binding domain and an endonuclease domain, e.g., a nickase domain. As a further example, in some embodiments, the first polypeptide and the second polypeptide each comprise a DNA binding domain (e.g., a first DNA binding domain and a second DNA binding domain). In some embodiments, the first and second polypeptide may be brought together post-translationally via a split-intein.

Writing Domain:

In certain aspects of the present invention, the writing domain of the GENE WRITER™ system possesses reverse transcriptase activity and is also referred to as a reverse transcriptase domain (a RT domain). In some embodiments, the RT domain comprises an RT catalytic portion and and RNA-binding region (e.g., a region that binds the template RNA).

In certain aspects of the present invention, the writing domain is based on a reverse transcriptase domain of an APE-type or RLE-type non-LTR retrotransposon. A wild-type reverse transcriptase domain of an APE-type or RLE-type non-LTR retrotransposon can be used in a GENE WRITER™ system or can be modified (e.g., by insertion, deletion, or substitution of one or more residues) to alter the reverse transcriptase activity for target DNA sequences. In some embodiments the reverse transcriptase is altered from its natural sequence to have altered codon usage, e.g. improved for human cells. In some embodiments the reverse transcriptase domain is a heterologous reverse transcriptase from a different retrovirus, LTR-retrotransposon, or non-LTR retrotransposon. In certain embodiments, a GENE WRITER™ system includes a polypeptide that comprises a reverse transcriptase domain of an RLE-type non-LTR retrotransposon from the R2, NeSL, HERO, R4, or CRE clade, or of an APE-type non-LTR retrotransposon from the R1, or Tx1 clade. In certain embodiments, a GENE WRITER™ system includes a polypeptide that comprises a reverse transcriptase domain of a non-LTR retrotransposon, LTR retrotransposon, group II intron, diversity-generating element, retron, telomerase, retroplasmid, retrovirus, or an engineered polymerase listed in Table 2 or Table 4. In some embodiments, a GENE WRITER™ system includes a polypeptide that comprises a reverse transcriptase domain listed in Table 3. In embodiments, the amino acid sequence of the reverse transcriptase domain of a GENE WRITER™ system is at least about 50%, at least about 60%, at least about 70%, at least about 80%, at least about 85%, at least about 90%, at least about 95%, at least about 96%, at least about 97%, at least about 98%, at least about 99% identical to the amino acid sequence of a reverse transcriptase domain of a non-LTR retrotransposon, LTR retrotransposon, group II intron, diversity-generating element, retron, telomerase, retroplasmid, retrovirus, or an engineered polymerase whose DNA sequence is referenced in Table 2 or Table 4, or of a peptide comprising an RT domain referenced in Table 3. In some embodiments, the RT domain has a sequence selected from Table 2 or 4, or a sequence of a peptide comprising an RT domain selected from Table 3, or a sequence having at least 70%, 75%, 80%, 85%, 90%, 95%, 96%, 97%, 98%, or 99% identity thereto. In some embodiments, the RT domain comprising a GENE WRITER™ polypeptide has been mutated from its original amino acid sequence, e.g., has at least 1, 2, 3, 4, 5, 6, 7, 8, 9, 10, 20, 30, 40, 50, 60, 70, 80, 90, or 100 substitutions. In some embodiments, the RT domain is derived from the RT of a retrovirus, e.g., HIV-1 RT, Moloney Murine Leukemia Virus (MMLV) RT, avian myeloblastosis virus (AMV) RT, Rous Sarcoma Virus (RSV) RT. In some embodiments, the RT domain is derived from the RT of a Group II intron, e.g., the group II intron maturase RT from *Eubacterium rectale* (MarathonRT) (Zhao et al. RNA 24:2 2018), the RT domain from LtrA, the RT TGIRT (or trt). In some embodiments, the RT domain is derived from the RT of a retron, e.g., the reverse transcriptase from Ec86 (RT86). In some embodiments, the RT domain is derived from a diversity-generating retroelement, e.g., from the RT of Brt. In some embodiments, the RT domain is derived from the RT of a retroplasmid, e.g., the RT from the Mauriceville plasmid. In some embodiments, the RT domain is derived from a non-LTR retrotransposon, e.g., the RT from R2Bm, the RT from R2Tg, the RT from LINE-1, the RT from Penelope or a Penelope-like element (PLE). In some embodiments, the RT domain is derived from an LTR retrotransposon, e.g., the reverse transcriptase from Ty1. In some embodiments, the RT domain is derived from a telomerase, e.g., TERT. A person having ordinary skill in the art is capable of identifying reverse transcription domains based upon homology to other known reverse transcription domains using routine tools as Basic Local Alignment Search Tool (BLAST). In some embodiments, the reverse transcriptase contains the InterPro domain IPR000477. In some embodiments, the reverse transcriptase contains the pfam domain PF00078. In some embodiments, the RT contains the InterPro domain IPR013103. In some embodiments, the RT contains the pfam domain PF07727. In some embodiments, the reverse transcriptase contains a conserved protein domain of the cd00304 RT_like family, e.g., cd01644 (RT_pepA17), cd01645 (RT_Rtv), cd01646 (RT_Bac_retron_I), cd01647 (RT_LTR), cd01648 (TERT), cd01650 (RT_nLTR_like), cd01651 (RT_G2_intron), cd01699 (RNA_dep_RNAP), cd01709 (RT_like_1), cd03487 (RT_Bac_retron_II), cd03714 (RT_DIRS1), cd03715 (RT_ZFREV_like). Proteins containing these domains can additionally be found by searching the domains on protein databases, such as InterPro (Mitchell et al. Nucleic Acids Res 47, D351-360 (2019)), UniProt (The UniProt Consortium Nucleic Acids Res 47, D506-515 (2019)), or the conserved domain database (Lu et al. Nucleic Acids Res 48, D265-268 (2020)), or by scanning open reading frames for reverse transcriptase domains using prediction tools, for example InterProScan. The diversity of reverse transcriptases has been described in, but not limited to, those used by prokaryotes (Zimmerly et al. *Microbiol Spectr* 3 (2): MDNA3-0058-2014 (2015); Lampson B. C. (2007) Prokaryotic Reverse Transcriptases. In: Polaina J., MacCabe A. P. (eds) Industrial Enzymes. Springer, Dordrecht), viruses (Herschhorn et al. *Cell Mol Life Sci* 67 (16): 2717-2747 (2010); Menéndez-Arias et al. *Virus Res* 234: 153-176 (2017)), and mobile elements (Eickbush et al. Virus Res 134 (1-2): 221-234 (2008); Craig et al. *Mobile DNA III* 3rd Ed. DOI: 10.1128/9781555819217 (2015)), each of which is incorporated herein by reference.

In some embodiments, the reverse transcriptase (RT) domain exhibits enhanced stringency of target-primed reverse transcription (TPRT) initiation, e.g., relative to an endogenous RT domain. In some embodiments, the RT domain initiates TPRT when the 3 nt in the target site immediately upstream of the first strand nick, e.g., the genomic DNA priming the RNA template, have at least 66% or 100% complementarity to the 3 nt of homology in the RNA template. In some embodiments, the RT domain initiates TPRT when there are less than 5 nt mismatched (e.g., less than 1, 2, 3, 4, or 5 nt mismatched) between the template RNA homology and the target DNA priming reverse transcription. In some embodiments, the RT domain is modified such that the stringency for mismatches in priming the TPRT reaction is increased, e.g., wherein the RT domain does not tolerate any mismatches or tolerates fewer mismatches in the priming region relative to a wild-type (e.g., unmodified) RT domain. In some embodiments, the RT domain comprises a HIV-1 RT domain. In embodiments, the HIV-1 RT domain initiates lower levels of synthesis even with three nucleotide mismatches relative to an alternative RT domain (e.g., as described by Jamburuthugoda and Eickbush J Mol Biol 407 (5): 661-672 (2011); incorporated herein by reference in its entirety).

In some embodiments, the RT domain forms a dimer (e.g., a heterodimer or homodimer). In some embodiments, the RT domain is monomeric. In some embodiments, an RT domain, e.g., a retroviral RT domain, naturally functions as a monomer or as a dimer (e.g., heterodimer or homodimer). In some embodiments, an RT domain naturally functions as a monomer, e.g., is derived from a virus wherein it functions as a monomer. Exemplary monomeric RT domains, their viral sources, and the RT signatures associated with them can be found in Table 5 with descriptions of domain signatures in Table 7. In some embodiments, the RT domain of a system described herein comprises an amino acid sequence of Table 5, or a functional fragment or variant thereof, or a sequence having at least 70%, 80%, 90%, 95%, or 99% identity thereto. In embodiments, the RT domain is selected from an RT domain from murine leukemia virus (MLV; sometimes referred to as MoMLV) (e.g., P03355), porcine endogenous retrovirus (PERV) (e.g., UniProt Q4VFZ2), mouse mammary tumor virus (MMTV) (e.g., UniProt P03365), Mason-Pfizer monkey virus (MPMV) (e.g., UniProt P07572), bovine leukemia virus (BLV) (e.g., UniProt P03361), human T-cell leukemia virus-1 (HTLV-1) (e.g., UniProt P03362), human foamy virus (HFV) (e.g., UniProt P14350), simian foamy virus (SFV) (e.g., UniProt P23074), or bovine foamy/syncytial virus (BFV/BSV) (e.g., UniProt 041894), or a functional fragment or variant thereof (e.g., an amino acid sequence having at least 70%, 80%, 90%, 95%, or 99% identity thereto). In some embodiments, an RT domain is dimeric in its natural functioning. Exemplary dimeric RT domains, their viral sources, and the RT signatures associated with them can be found in Table 6 with descriptions of domain signatures in Table 7. In some embodiments, the RT domain of a system described herein comprises an amino acid sequence of Table 6, or a functional fragment or variant thereof, or a sequence having at least 70%, 80%, 90%, 95%, or 99% identity thereto. In some embodiments, the RT domain is derived from a virus wherein it functions as a dimer. In embodiments, the RT domain is selected from an RT domain from avian sarcoma/leukemia virus (ASLV) (e.g., UniProt A0A142BKH1), Rous sarcoma virus (RSV) (e.g., UniProt P03354), avian myeloblastosis virus (AMV) (e.g., UniProt Q83133), human immunodeficiency virus type I (HIV-1) (e.g., UniProt P03369), human immunodeficiency virus type II (HIV-2) (e.g., UniProt P15833), simian immunodeficiency virus (SIV) (e.g., UniProt P05896), bovine immunodeficiency virus (BIV) (e.g., UniProt P19560), equine infectious anemia virus (EIAV) (e.g., UniProt P03371), or feline immunodeficiency virus (FIV) (e.g., UniProt P16088) (Herschhorn and Hizi Cell Mol Life Sci 67 (16): 2717-2747 (2010)), or a functional fragment or variant thereof (e.g., an amino acid sequence having at least 70%, 80%, 90%, 95%, or 99% identity thereto). Naturally heterodimeric RT domains may, in some embodiments, also be functional as homodimers. In some embodiments, dimeric RT domains are expressed as fusion proteins, e.g., as homodimeric fusion proteins or heterodimeric fusion proteins. In some embodiments, the RT function of the system is fulfilled by multiple RT domains (e.g., as described herein). In further embodiments, the multiple RT domains are fused or separate, e.g., may be on the same polypeptide or on different polypeptides.

In some embodiment, a GENE WRITER™ described herein comprises an integrase domain, e.g., wherein the integrase domain may be part of the RT domain. In some embodiments, an RT domain (e.g., as described herein) comprises an integrase domain. In some embodiments, an RT domain (e.g., as described herein) lacks an integrase domain, or comprises an integrase domain that has been inactivated by mutation or deleted. In some embodiment, a GENE WRITER™ described herein comprises an RNase H domain, e.g., wherein the RNase H domain may be part of the RT domain. In some embodiments, an RT domain (e.g., as described herein) comprises an RNase H domain, e.g., an endogenous RNAse H domain or a heterologous RNase H domain. In some embodiments, an RT domain (e.g., as described herein) lacks an RNase H domain. In some embodiments, an RT domain (e.g., as described herein)

comprises an RNase H domain that has been added, deleted, mutated, or swapped for a heterologous RNase H domain. In some embodiments, mutation of an RNase H domain yields a polypeptide exhibiting lower RNase activity, e.g., as determined by the methods described in Kotewicz et al. Nucleic Acids Res 16 (1): 265-277 (1988) (incorporated herein by reference in its entirety), e.g., lower by at least 10%, 20%, 30%, 40%, 50%, 60%, 70%, 80%, or 90% compared to an otherwise similar domain without the mutation. In some embodiments, RNase H activity is abolished.

In some embodiments, an RT domain is mutated to increase fidelity compared to to an otherwise similar domain without the mutation. For instance, in some embodiments, a YADD (SEQ ID NO: 1539) or YMDD (SEQ ID NO: 1540) motif in an RT domain (e.g., in a reverse transcriptase) is replaced with YVDD (SEQ ID NO: 1541). In embodiments, replacement of the YADD (SEQ ID NO: 1539) or YMDD (SEQ ID NO: 1540) or YVDD (SEQ ID NO: 1541) results in higher fidelity in retroviral reverse transcriptase activity (e.g., as described in Jamburuthugoda and Eickbush J Mol Biol 2011; incorporated herein by reference in its entirety).

In some embodiments, the reverse transcriptase domain is one selected from an element of Table 2 or Table 4.

Table 2: Exemplary reverse transcriptase domains from different types of sources. Sources include Group II intron, non-LTR retrotransposon, retrovirus, LTR retrotransposon, diversity-generating retroelement, retron, telomerase, retroplasmid, and evolved DNA polymerase. Also included are the associated RT signatures from the InterPro, pfam, and cd databases. Although the evolved polymerase RTX can perform RNA-dependent DNA polymerization, no RT signatures were identified by InterProScan, so polymerase signatures are included instead.

TABLE 2

| | | | | | |
|---|---|---|---|---|---|
| InterPro descriptions of signatures present in reverse transcriptases in | | | | | |
| Protein | Type | Accession | UniProt | Sequence | RT signatures |
| MarathonRT | Group II intron | CBK92290.1 | D4JMT6 | MDTSNLMEQILSSDNLNRAYLQVVR NKGAEGVDGMKYTELKEHLAKNGET IKGQLRTRKYKPQPARRVEIPKPDG GVRNLGVPTVTDRFIQQAIAQVLTP IYEEQFHDHSYGFRPNRCAQQAILT ALNIMNDGNDWIVDIDLEKFFDTVN HDKLMTLIGRTIKDGDVISIVRKYL VSGIMIDDEYEDSIVGTPQGGNLSP LLANIMLNELDKEMEKRGLNFVRYA DDCIIMVGSEMSANRVMRNISRFIE EKLGLKVNMTKSKVDRPSGLKYLGF GFYFDPRAHQFKAKPHAKSVAKFKK RMKELTCRSWGVSNSYKVEKLNQLI RGWINYFKIGSMKTLCKELDSRIRY RLRMCIWKQWKTPQNQEKNLVKLGI DRNTARRVAYTGKRIAYVCNKGAVN VAISNKRLASFGLISMLDYYIEKCV TC (SEQ ID NO: 1542) | IPR000477 PF00078, cd01651 |
| TGIRT, trt | Group II intron | AAT72329.1 | Q6DKY2 | MALLERILADRNLITALKRVEANQG APGIGDVSTDQLRDIYRAHWSTIRA QLLAGTYRPAPVRRVGIPKGPGGTR QLGITPVVDRLIQQIALQELTPIFD PDFSPSSFGFRPGRNAHDAVRQAQG YIQEYGRYVVDMDLKEFFDRVNHDL IMSRVARKVDKKRVLKLIRYALQAG VMIEGVKVQTEEGTQPGGPLSPLLA NILLDDLDKELEKRGLKFCYRADDC NIYVSKLRAGQRVKQSIQRFLEKTL KLKVNEEKSVADRPWKRAFGLFSFT PERKARIRLAPRSIQRLKQRIRQLT NPNWSISMPREIHRVNQYVGMWIGY FRLVTEPSVLQTIEGWIRRRLRLCW QLQWKRVRTRIRELRALGLKETAVM EIANRTKGAWRTTKPQTLHQALGKY TWTAQGLKTSLQRYFELRQG (SEQ ID NO: 1543) | IPR000477 PF00078, cd01651 |
| LtrA | Group II intron | AAB06503.1 | P0A3U0 | MKPTMAILERISKNSQENIDEVFTR LYRYLLRPDIYYVAYQNLYSNKGAS TKGILDDTADGFSEEKIKKIIQSLK DGTYYPQPVRRMYIAKKNSKKMRPL GIPTFTDKLIQEAVRIILESIYEPV FEDVSHGFRPQRSCHTALKTIKREF GGARWFVEGDIKGCFDNIDHVTLIG LINLKIKDMKMSQLIYKFLKAGYLE NWQYHKTYSGTPQGGILSPLLANIY LHELDKFVLQLKMKFDRESPERITP EYRELHNEIKRISHRLKKLEGEEKA KVLLEYQEKRKRLPTLPCTSQTNKV LKYVRYADDFIISVKGSKEDCQWIK EQLKLFIHNKLKMELSEEKTLITHS | IPR000477, PF00078, cd01651 |

TABLE 2-continued

InterPro descriptions of signatures present in reverse transcriptases in

| Protein | Type | Accession | UniProt | Sequence | RT signatures |
|---|---|---|---|---|---|
| | | | | SQPARFLGYDIRVRRSGTIKRSGKV<br>KKRTLNGSVELLIPLQDKIRQFIFD<br>KKIAIQKKDSSWFPVHRKYLIRSTD<br>LEIITIYNSELRGICNYYGLASNFN<br>QLNYFAYLMEYSCLKTIASKHKGTL<br>SKTISMFKDGSGSWGIPYEIKQGKQ<br>RRYFANFSECKSPYQFTDEISQAPV<br>LYGYARNTLENRLKAKCCELCGTSD<br>ENTSYEIHHVNKVKNLKGKEKWEMA<br>MIAKQRKTLVVCFHCHRHVIHKHK<br>(SEQ ID NO: 1544) | |
| R2Bm | non-LTR retro-transposon | AAB59214.1 | V9H052 | MMASTALSLMGRCNPDGCTRGKHVT<br>AAPMDGPRGPSSLAGTFGWGLAIPA<br>GEPCGRVCSPATVGFFPVAKKSNKE<br>NRPEASGLPLESERTGDNPTVRGSA<br>GADPVGQDAPGWTCQFCERTFSTNR<br>GLGVHKRRAHPVETNTDAAPMMVKR<br>RWHGEEIDLLARTEARLLAERGQCS<br>GGDLFGALPGFGRTLEAIKGQRRRE<br>PYRALVQAHLARFGSQPGPSSGGCS<br>AEPDFRRASGAEEAGEERCAEDAAA<br>YDPSAVGQMSPDAARVLSELLEGAG<br>RRRACRAMRPKTAGRRNDLHDDRTA<br>SAHKTSRQKRRAEYARVQELYKKCR<br>SRAAAEVIDGACGGVGHSLEEMETY<br>WRPILERVSDAPGPTPEALHALGRA<br>EWHGGNRDYTQLWKPISVEEIKASR<br>FDWRTSPGPDGIRSGQWRAVPVHLK<br>AEMFNAWMARGEIPEILRQCRTVFV<br>PKVERPGGPGEYRPISIASIPLRHF<br>HSILARRLLACCPPDARQRGFICAD<br>GTLENSAVLDAVLGDSRKKLRECHV<br>AVLDFAKAFDTVSHEALVELLRLRG<br>MPEQFCGYIAHLYDTASTTLAVNNE<br>MSSPVKVGRGVRQGDPLSPILFNVV<br>MDLILASLPERVGYRLEMELVSALA<br>YADDLVLLAGSKVGMQESISAVDCV<br>GRQMGLRLNCRKSAVLSMIPDGHRK<br>KHHYLTERTFNIGGKPLRQVSCVER<br>WRYLGVDFEASGCVTLEHSISSALN<br>NISRAPLKPQQRLEILRAHLIPRFQ<br>HGFVLGNISDDRLRMLDVQIRKAVG<br>QWLRLPADVPKAYYHAAVQDGGLAI<br>PSVRATIPDLIVRRFGGLDSSPWSV<br>ARAAAKSDKIRKKLRWAWKQLRRFS<br>RVDSTTORPSVRLFWREHLHASVDG<br>RELRESRTPTSTKWIRERCAQITG<br>RDFVQFVHTHINALPSRIRGSRGRR<br>GGGESSLTCRAGCKVRETTAHILQQ<br>CHRTHGGRILRHNKIVSFVAKAMEE<br>NKWTVELEPRLRTSVGLRKPDIIAS<br>RDGVGVIVDVQVVSGQRSLDELHRE<br>KRNKYGNHGELVELVAGRLGLPKAE<br>CVRATSCTISWRGVWSLTSYKELRS<br>IIGLREPTLQIVPILALRGSHMNWT<br>RFNQMTSVMGGGVG<br>(SEQ ID NO: 1545) | IPR000477<br>PF00078,<br>cd01650 |
| LINE-1 | non-LTR retro-transposon | AAC51271.1 | O00370 | MTGSNSHITILTLNVNGLNSPIKRH<br>RLASWIKSQDPSVCCIQETHLTCRD<br>THRLKIKGWRKIYQANGKQKKAGVA<br>ILVSDKTDFKPTKIKRDKEGHYIMV<br>KGSIQQEELTILNIYAPNTGAPRFI<br>KQVLSDLQRDLDSHTLIMGDFNTPL<br>SILDRSTRQKVNKDTQELNSALHQT<br>DLIDIYRTLHPKSTEYTFFSAPHHT<br>YSKIDHIVGSKALLSKCKRTEIITN<br>YLSDHSAIKLELRIKNLTQSRSTTW<br>KLNNLLLNDYWVHNEMKAEIKMFFE<br>TNENKDTTYQNLWDAFKAVCRGKFI<br>ALNAYKRKQERSKIDTLTSQLKELE<br>KQEQTHSKASRRQEITKIRAELKEI<br>ETQKTLQKINESRSWFFERINKIDR<br>PLARLIKKKREKNQIDTIKNDKGDI | IPR000477<br>PF00078,<br>cd01650 |

TABLE 2-continued

InterPro descriptions of signatures present in reverse transcriptases in

| Protein | Type | Accession | UniProt | Sequence | RT signatures |
|---|---|---|---|---|---|
| | | | | TTDPTEIQTTIREYYKHLYANKLEN LEEMDTFLDTYTLPRLNQEEVESLN RPITGSEIVAIINSLPTKKSPGPDG FTAEFYQRYKEELVPFLLKLFQSIE KEGILPNSFYEASIILIPKPGRDTT KKENFRPISLMNIDAKILNKILANR IQQHIKKLIHHDQVGFIPGMQGWFN IRKSINVIQHINRAKDKNHVIISID AEKAFDKIQQPFMLKTLNKLGIDGM YLKIIRAIYDKPTANIILNGQKLEA FPLKTGTRQGCPLSPLLFNIVLEVL ARAIRQEKEIKGIQLGKEEVKLSLF ADDMIVYLENPIVSAQNLLKLISNF SKVSGYKINVQKSQAFLYNNNRQTE SQIMGELPFTIASKRIKYLGIQLTR DVKDLFKENYKPLLKEIKEDTNKWK NIPCSWVGRINIVKMAILPKVIYRF NAIPIKLPMTFFTELEKTTLKFIWN QKRARIAKSILSQKNKAGGITLPDF KLYYKATVTKTAWYWYQNRDIDQWN RTEPSEIMPHIYNYLIFDKPEKNKQ WGKDSLLNKWCWENWLAICRKLKLD PFLTPYTKINSRWIKDLNVKPKTIK TLEENLGITIQDIGVGKDFMSKTPK AMATKDKIDKWDLIKLKSFCTAKET TIRVNRQPTTWEKIFATYSSDKGLI SRIYNELKQIYKKKTNNPIKKWAKD MNRHFSKEDIYAAKKHMKKCSSSLA IREMQIKTTMRYHLTPVRMAIIKKS GNNRCWRGCGEIGTLVHCWWDCKLV QPLWKSVWRFLRDLELEIPFDPAIP LLGIYPKDYKSCCYKDTCTRMFIAA LFTIAKTWNQPNCPTMIDWIKKMWH IYTMEYYAAIKNDEFISFVGTWMKL ETIILSKLSQEQKTKHRIFSLIGGN (SEQ ID NO: 1546) | |
| Penelope | non-LTR Retro-transposon | AAL14979.1 | Q95VB5 | MERSPEPSININGRHAVCTATNMSY AKIKTKYKDSKRTINKFQLTLVKLT KLKSSLKFLLKCRKSNLIPNFIKNL TQHLTILTTDNKTHPDITRTLTRHT HFYHTKILNLLIKHKHNLLQEQTKH MQKAKTNIEQLMTTDDAKAFFESER NIENKITTTLKKRQETKHDKLRDQR NLALADNNTQREWFVNKTKIEFPPN VVALLAKGPKFALPISKRDFPLLKY IADGEELVQTIKEKETQESARTKFS LLVKEHKTKNNQNSRDRAILDTVEQ TRKLLKENINIKILSSDKGNKTVAM DEDEYKNKMTNILDDLCAYRTLRLD PTSRLQTKNNTFVAQLFKMGLISKD ERNKMTTTTAVPPRIYGLPKIHKEG TPLRPICSSIGSPSYGLCKYIIQIL KNLTMDSRYNIKNAVDFKDRVNNSQ IREEETLVSFDVVSLFPSIPIELAL DTIRQKWTKLEEHTNIPKQLFMDIV RFCIEENRYFKYEDKIYTQLKGMPM GSPASPVIADILMEELLDKITDKLK IKPRLLTKYVDDLFAITNKIDVENI LKELNSFHKQIKFTMELEKDGKLPF LDSIVSRMDNTLKIKWYRKPIASGR ILNFNSNHPKSMIINTALGCMNRMM KISDTIYHKEIEHEIKELLTKNDFP PNIIKTLLKRRQIERKKPTEPAKIY KSLIYVPRLSERLTNSDCYNKQDIK VAHKPTNTLQKFFNKIKSKIPMIEK SNVVYQIPCGGDNNNKCNSVYIGTT KSKLKTRISQHKSDFKLRHQNNIQK TALMTHCIRSNHTPNFDETTILQQE QHYNKRHTLEMLHIINTPTYKRLNY KTDTENCAHLYRHLLNSQTTSVTIS TSKSADV (SEQ ID NO: 1547) | IPR000477, PF00078, cd00304 |

TABLE 2-continued

InterPro descriptions of signatures present in reverse transcriptases in

| Protein | Type | Accession | UniProt | Sequence | RT signatures |
|---|---|---|---|---|---|
| M-MLV RT | Retro virus | ADS42990.1 | P03355 [660-1330] | TLNIEDEHRLHETSKEPDVSLGSTW LSDFPQAWAETGGMGLAVRQAPLII PLKATSTPVSIKQYPMSQEARLGIK PHIQRLLDQGILVPCQSPWNTPLLP VKKPGTNDYRPVQDLREVNKRVEDI HPTVPNPYNLLSGLPPSHQWYTVLD LKDAFFCLRLHPTSQPLFAFEWRDP EMGISGQLTWTRLPQGFKNSPTLFD EALHRDLADFRIQHPDLILLQYVDD LLLAATSELDCQQGTRALLQTLGNL GYRASAKKAQICQKQVKYLGYLLKE GQRWLTEARKETVMGQPTPKTPRQL REFLGTAGFCRLWIPGFAEMAAPLY PLTKTGTLFNWGPDQQKAYQEIKQA LLTAPALGLPDLTKPFELFVDEKQG YAKGVLTQKLGPWRRPVAYLSKKLD PVAAGWPPCLRMVAAIAVLTKDAGK LTMGQPLVILAPHAVEALVKQPPDR WLSNARMTHYQALLLDTDRVQFGPV VALNPATLLPLPEEGLQHNCLDILA EAHGTRPDLTDQPLPDADHTWYTDG SSLLQEGQRKAGAAVTTETEVIWAK ALPAGTSAQRAELIALTQALKMAEG KKLNVYTDSRYAFATAHIHGEIYRR RGLLTSEGKEIKNKDEILALLKALF LPKRLSIIHCPGHQKGHSAEARGNR MADQAARKAAITETPDTSTLL (SEQ ID NO: 1548) | IPR000477 PF00078, cd03715 |
| RSV RT | Retro virus | AAC82561.1 | P03354 [709-1567] | TVALHLAIPLKWKPDHTPVWIDQWP LPEGKLVALTQLVEKELQLGHIEPS LSCWNTPVFVIRKASGSYRLLHDLR AVNAKLVPFGAVQQGAPVLSALPRG WPLMVLDLKDCFFSIPLAEQDREAF AFTLPSVNNQAPARRFQWKVLPQGM TCSPTICQLVVGQVLEPLRLKHPSL CMLHYMDDLLLAASSHDGLEAAGEE VISTLERAGFTISPDKVQREPGVQY LGYKLGSTYVAPVGLVAEPRIATLW DVQKLVGSLQWLRPALGIPPRLMGP FYEQLRGSDPNEAREWNLDMKMAWR EIVRLSTTAALERWDPALPLEGAVA RCEQGAIGVLGQGLSTHPRPCLWLF STQPTKAFTAWLEVLTLLITKLRAS AVRTFGKEVDILLLPACFREDLPLP EGILLALKGFAGKIRSSDTPSIFDI ARPLHVSLKVRVTDHPVPGPTVFTD ASSSTHKGVVVWREGPRWEIKEIAD LGASVQQLEARAVAMALLLWPTTPT NVVTDSAFVAKMLLKMGQEGVPSTA AAFILEDALSQRSAMAAVLHVRSHS EVPGFFTEGNDVADSQATFQAYPLR EAKDLHTALHIGPRALSKACNISMQ QAREVVQTCPHCNSAPALEAGVNPR GLGPLQIWQTDFTLEPRMAPRSWLA VTVDTASSAIVVTQHGRVTSVAVQH HWATAIAVLGRPKAIKTDNGSCFTS KSTREWLARWGIAHTTGIPGNSQGQ AMVERANRLLKDRIRVLAEGDGFMK RIPTSKQGELLAKAMYALNHFERGE NTKTPIQKHWRPTVLTEGPPVKIRI ETGEWEKGWNVLVWGRGYAAVKNRD TDKVIWVPSRKVKPDITQKDEVTKK DEASPLFAG(SEQ ID NO: 1549) | IPR000477 PF00078, cd01645 |
| AMV RT | Retro virus | HW606680.1 | — | TVALHLAIPLKWKPNHTPVWIDQWP LPEGKLVALTQLVEKELQLGHIEPS LSCWNTPVFVIRKASGSYRLLHDLR AVNAKLVPFGAVQQGAPVLSALPRG WPLMVLDLKDCFFSIPLAEQDREAF AFTLPSVNNQAPARRFQWKVLPQGM TCSPTICQLIVGQILEPLRLKHPSL RMLHYMDDLLLAASSHDGLEAAGEE VISTLERAGFTISPDKVQREPGVQY | IPR000477, PF00078, cd01645 |

TABLE 2-continued

InterPro descriptions of signatures present in reverse transcriptases in

| Protein | Type | Accession | UniProt | Sequence | RT signatures |
|---|---|---|---|---|---|
| | | | | LGYKLGSTYVAPVGLVAEPRIATLW DVQKLVGSLQWLRPALGIPPRLMGP FYEQLRGSDPNEAREWNLDMKMAWR EIVQLSTTAALERWDPALPLEGAVA RCEQGAIGVLGQGLSTHPRPCLWLF STQPTKAFTAWLEVLTLLITKLRAS AVRTFGKEVDILLLPACFREDLPLP EGILLALRGFAGKIRSSDTPSIFDI ARPLHVSLKVRVTDHPVPGPTVFTD ASSSTHKGVVVWREGPRWEIKEIAD LGASVQQLEARAVAMALLLWPTTPT NVVTDSAFVAKMLLKMGQEGVPSTA AAFILEDALSQRSAMAAVLHVRSHS EVPGFFTEGNDVADSQATFQAY (SEQ ID NO: 1550) | |
| HIV RT | Retro virus | AAB50259.1 | P04585 [588-1147] | PISPIETVPVKLKPGMDGPKVKQWP LTEEKIKALVEICTEMEKEGKISKI GPENPYNTPVFAIKKKDSTKWRKLV DFRELNKRTQDFWEVQLGIPHPAGL KKKKSVTVLDVGDAYFSVPLDEDFR KYTAFTIPSINNETPGIRYQYNVLP QGWKGSPAIFQSSMTKILEPFRKQN PDIVIYQYMDDLYVGSDLEIGQHRT KIEELRQHLLRWGLTTPDKKHQKEP PFLWMGYELHPDKWTVQPIVLPEKD SWTVNDIQKLVGKLNWASQIYPGIK VRQLCKLLRGTKALTEVIPLTEEAE LELAENREILKEPVHGVYYDPSKDL IAEIQKQGQGQWTYQIYQEPFKNLK TGKYARMRGAHTNDVKQLTEAVQKI TTESIVIWGKTPKFKLPIQKETWET WWTEYWQATWIPEWEFVNTPPLVKL WYQLEKEPIVGAETFYVDGAANRET KLGKAGYVTNRGRQKVVTLTDTTNQ KTELQAIYLALQDSGLEVNIVTDSQ YALGIIQAQPDQSESELVNQHIEQL IKKEKVYLAWVPAHKGIGGNEQVDK LVSAGIRKVL (SEQ ID NO: 1551) | IPR000477, PF00078, cd01645 |
| Ty1 | LTR Retro-transposon | AAA66938.1 | Q07163-1 [1218-1755] | AVKAVKSIKPIRTTLRYDEAITYNK DIKEKEKYIEAYHKEVNQLLKMKTW DTDEYYDRKEIDPKRVINSMFIFNK KRDGTHKARFVARGDIQHPDTYDSG MQSNTVHHYALMTSLSLALDNNYYI TQLDISSAYLYADIKEELYIRPPPH LGMNDKLIRLKKSLYGLKQSGANWY ETIKSYLIQQCGMEEVRGWSCVFKN SQVTICLFVDDMVLFSKNLNSNKRI IEKLKMQYDTKIINLGESDEEIQYD ILGLEIKYQRGKYMKLGMENSLTEK IPKLNVPLNPKGRKLSAPGQPGLYI DQDELEIDEDEYKEKVHEMQKLIGL ASYVGYKFRFDLLYYINTLAQHILF PSRQVLDMTYELIQFMWDTRDKQLI WHKNKPTEPDNKLVAISDASYGNQP YYKSQIGNIYLLNGKVIGGKSTKAS LTCTSTTEAEIHAISESVPLLNNLS YLIQELNKKPIIKGLLTDSRSTISI IKSTNEEKFRNRFFGTKAMRLRDEV SGNNLYVYYIETKKNIADVMTKPLP IKTFKLLTNKWIH (SEQ ID NO: 1552) | IPR013103 PF07727 |
| Brt | Diversity-Generating retro-element | NP_958675.1 | Q775D8 | MGKRHRNLIDQITTWENLLDAYRKT SHGKRRTWGYLEFKEYDLANLLALQ AELKAGNYERGPYREFLVYEPKPRL ISALEFKDRLVQHALCNIVAPIFEA GLLPYTYACRPDKGTHAGVCHVQAE LRRTRATHFLKSDFSKFFPSIDRAA LYAMIDKKIHCAATRRLLRVVLPDE GVGIPIGSLTSQLFANVYGGAVDRL LHDELKQRHWARYMDDIVVLGDDPE ELRAVFYRLRDFASERLGLKISHWQ | IPR000477, PF00078, cd01646 |

TABLE 2-continued

InterPro descriptions of signatures present in reverse transcriptases in

| Protein | Type | Accession | UniProt | Sequence | RT signatures |
|---|---|---|---|---|---|
| | | | | VAPVSRGINFLGYRIWPTHKLLRKS SVKRAKRKVANFIKHGEDESLQRFL ASWSGHAQWADTHNLFTWMEEQYGI ACH (SEQ ID NO: 1553) | |
| Ty1 | LTR Retro-transposon | AAA66938.1 | Q07163-1[1218-1755] | AVKAVKSIKPIRTTLRYDEAITYNK DIKEKEKYIEAYHKEVNQLLKMKTW DTDEYYDRKEIDPKRVINSMFIFNK KRDGTHKARFVARGDIQHPDTYDSG MQSNTVHHYALMTSLSLALDNNYYI TQLDISSAYLYADIKEELYIRPPPH LGMNDKLIRLKKSLYGLKQSGANWY ETIKSYLIQQCGMEEVRGWSCVFKN SQVTICLFVDDMVLFSKNLNSNKRI IEKLKMQYDTKIINLGESDEEIQYD ILGLEIKYQRGKYMKLGMENSLTEK IPKLNVPLNPKGRKLSAPGQPGLYI DQDELEIDEDEYKEKVHEMQKLIGL ASYVGYKFRFDLLYYINTLAQHILF PSRQVLDMTYELIQFMWDTRDKQLI WHKNKPTEPDNKLVAISDASYGNQP YYKSQIGNIYLLNGKVIGGKSTKAS LTCTSTTEAEIHAISESVPLLNNLS YLIQELNKKPIIKGLLTDSRSTISI IKSTNEEKFRNRFFGTKAMRLRDEV SGNNLYVYYIETKKNIADVMTKPLP IKTFKLLTNKWIH (SEQ ID NO: 1552) | IPR013103 PF07727 |
| Brt | Diversity-Generating retro-element | NP_958675.1 | Q775D8 | MGKRHRNLIDQITTWENLLDAYRKT SHGKRRTWGYLEFKEYDLANLLALQ AELKAGNYERGPYREFLVYEPKPRL ISALEFKDRLVQHALCNIVAPIFEA GLLPYTYACRPDKGTHAGVCHVQAE LRRTRATHFLKSDFSKFFPSIDRAA LYAMIDKKIHCAATRRLLRVVLPDE GVGIPIGSLTSQLFANVYGGAVDRL LHDELKQRHWARYMDDIVVLGDDPE ELRAVFYRLRDFASERLGLKISHWQ VAPVSRGINFLGYRIWPTHKLLRKS SVKRAKRKVANFIKHGEDESLQRFL ASWSGHAQWADTHNLFTWMEEQYGI ACH (SEQ ID NO: 1553) | IPR000477, PF00078, cd01646 |
| RT86 | Retron | AAA61471.1 | P23070 | MKSAEYLNTFRLRNLGLPVMNNLHD MSKATRISVETLRLLIYTADFRYRI YTVEKKGPEKRMRTIYQPSRELKAL QGWVLRNILDKLSSSPFSIGFEKHQ SILNNATPHIGANFILNIDLEDFFP SLTANKVFGVFHSLGYNRLISSVLT KICCYKNLLPQGAPSSPKLANLICS KLDYRIQGYAGSRGLIYTRYADDLT LSAQSMKKVVKARDFLFSIIPSEGL VINSKKTCISGPRSQRKVTGLVISQ EKVGIGREKYKEIRAKIHHIFCGKS SEIEHVRGWLSFILSVDSKSHRRLI TYISKLEKKYGKNPLNKAKT (SEQ ID NO: 1554) | IPR000477, PF00078, cd03487 |
| TERT | Telomerase | AAG23289.1 | O14746 | MPRAPRCRAVRSLLRSHYREVLPLA TFVRRLGPQGWRLVQRGDPAAFRAL VAQCLVCVPWDARPPPAAPSFRQVS CLKELVARVLQRLCERGAKNVLAFG FALLDGARGGPPEAFTTSVRSYLPN TVTDALRGSGAWGLLLRRVGDDVLV HLLARCALFVLVAPSCAYQVCGPPL YQLGAATQARPPPHASGPRRRLGCE RAWNHSVREAGVPLGLPAPGARRRG GSASRSLPLPKRPRPPRGAAPEPERTP VGQGSWAHPGRTRGPSDRGFCVVSP ARPAEEATSLEGALSGTRHSHPSVG RQHHAGPPSTSRPPRPWDTPCPPVY AETKHFLYSSGDKEQLRPSFLLSSL | IPR000477 PF00078, cd01648 |

TABLE 2-continued

InterPro descriptions of signatures present in reverse transcriptases in

| Protein | Type | Accession | UniProt | Sequence | RT signatures |
|---|---|---|---|---|---|
| | | | | RPSLTGARRLVETIFLGSRPWMPGT PRRLPRLPQRYWQMRPLFLELLGNH AQCPYGVLLKTHCPLRAAVTPAAGV CAREKPQGSVAAPEEEDTDPRRLVQ LLRQHSSPWQVYGFVRACLRRLVPP GLWGSRHNERRFLRNTKKFISLGKH AKLSLQELTWKMSVRDCAWLRRSPG VGCVPAAEHRLREEILAKFLHWLMS VYVVELLRSFFYVTETTFQKNRLFF YRKSVWSKLQSIGIRQHLKRVQLRE LSEAEVRQHREARPALLTSRLRFIP KPDGLRPIVNMDYVVGARTFRREKR AERLTSRVKALFSVLNYERARRPGL LGASVLGLDDIHRAWRTFVLRVRAQ DPPPELYFVKVDVTGAYDTIPQDRL TEVIASIIKPQNTYCVRRYAVVQKA AHGHVRKAFKSHVSTLTDLQPYMRQ FVAHLQETSPLRDAVVIEQSSSLNE ASSGLFDVFLRFMCHHAVRIRGKSY VQCQGIPQGSILSTLLCSLCYGDME NKLFAGIRRDGLLLRLVDDFLLVTP HLTHAKTFLRTLVRGVPEYGCVVNL RKTVVNFPVEDEALGGTAFVQMPAH GLFPWCGLLLDTRTLEVQSDYSSYA RTSIRASLTFNRGFKAGRNMRRKLF GVLRLKCHSLFLDLQVNSLQTVCTN IYKILLLQAYRFHACVLQLPFHQQV WKNPTFFLRVISDTASLCYSILKAK NAGMSLGAKGAAGPLPSEAVQWLCH QAFLLKLTRHRVTYVPLLGSLRTAQ TQLSRKLPGTTLTALEAAANPALPS DFKTILD (SEQ ID NO: 1555) | |
| Mauriceville RT | Retro plasmid | NC_0015 70.1 | Q36578 | MPNHRLPNCVSYLGENHELSWLHGM FGLLKRSNPQTGGILGWLNTGPNGF VKYMMNLMGHARDKGDAKEYWRLGR SLMKNEAFQVQAFNHVCKHWYLDYK PHKIAKLLKEVREMVEIQPVCIDYK RVYIPKANGKORPLGVPTVPWRVYL HMWNVLLVWYRIPEQDNQHAYFPKR GVFTAWRALWPKLDSQNIYEFDLKN FFPSVDLAYLKDKLMESGIPQDISE YLTVLNRSLVVLTSEDKIPEPHRDV IFNSDGTPNPNLPKDVQGRILKDPD FVEILRRGFTDIATNGVPQGASTS CGLATYNVKELFKRYDELIMYADDG ILCRQDPSTPDFSVEEAGVVQEPAK SGWIKQNGEFKKSVKFLGLEFIPAN IPPLGEGEVKDYPRLRGATRNGSKM ELSTELQFLCYLSYKLRIKVLRDLY IQVLGYLPSVPLLRYRSLAEAINEL SPKRITIGQFITSSFEEFTAWSPLK RMGFFFSSPAGPTILSSIFNNSTNL QEPSDSRLLYRKGSWVNIRFAAYLY SKLSEEKHGLVPKFLEKLREINFAL DKVDVTEIDSKLSRLMKFSVSAAYD EVGTLALKSLFKFRNSERESIKASF KQLRENGKIAEFSEARRLWFEILKL IRLDLFNASSLACDDLLSHLQDRRS IKKWGSSDVLYLKSQRLMRTNKKQL QLDFEKKKNSLKKKLIKRRAKELRD TFKGKENKEA (SEQ ID NO: 1556) | cd00304 |
| RTX | Engineered polymerase | QFN49000.1 | — | MILDTDYITEDGKPVIRIFKKENGE FKIEYDRTFEPYLYALLKDDSAIEE VKKITAERHGTVVTVKRVEKVQKKF LGRPVEVWKLYFTHPQDVPAIMDKI REHPAVIDIYEYDIPFAIRYLIDKG LVPMEGDEELKLLAFDIETLYHEGE EFAEGPILMISYADEEGARVITWKN VDLPYVDVVSTEREMIKRFLRVVKE KDPDVLITYNGDNFDFAYLKKRCEK LGINFALGRDGSEPKIQRMGDRFAV | IPR006134 PF00136, cd05536 |

TABLE 2-continued

InterPro descriptions of signatures present in reverse transcriptases in

| Protein | Type | Accession | UniProt | Sequence | RT signatures |
|---|---|---|---|---|---|
| | | | | EVKGRIHFDLYPVIRRTINLPTYTL EAVYEAVFGQPKEKVYAEEITTAWE TGENLERVARYSMEDAKVTYELGKE FLPMEAQLSRLIGQSLWDVSRSSTG NLVEWFLLRKAYERNELAPNKPDEK ELARRHQSHEGGYIKEPERGLWENI VYLDFRSLYPSIIITHNVSPDTLNR EGCKEYDVAPQVGHRFCKDFPGFIP SLLGDLLEERQKIKKRMKATIDPIE RKLLDYRQRAIKILANSLYGYYGYA RARWYCKECAESVIAWGREYLTMTI KEIEEKYGFKVIYSDTDGFFATIPG ADAETVKKKAMEFLKYINAKLPGAL ELEYEGFYKRGLFVTKKKYAVIDEE GKITTRGLEIVRRDWSEIAKETQAR VLEALLKDGDVEKAVRIVKEVTEKL SKYEVPPEKLVIHKQITRDLKDYKA TGPHVAVAKRLAARGVKIRPGTVIS YIVLKGSGRIVDRAIPFDEFDPTKH KYDAEYYIEKQVLPAVERILRAFGY RKEDLRYQKTRQVGLSARLKPKGTL EGSSHHHHHH (SEQ ID NO: 1557) | |

TABLE 3

InterPro descriptions of signatures present in reverse transcriptases in Table 2.

| Signature | Database | Short Name | Description |
|---|---|---|---|
| cd00304 | CDD | RT like | RT_like: Reverse transcriptase (RT, RNA-dependent DNA polymerase)_like family. An RT gene is usually indicative of a mobile element such as a retrotransposon or retrovirus. RTs occur in a variety of mobile elements, including retrotransposons, retroviruses, group II introns, bacterial msDNAs, hepadnaviruses, and caulimoviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. [PMID: 1698615, PMID: 8828137, PMID: 10669612, PMID: 9878607, PMID: 7540934, PMID: 7523679, PMID: 8648598] |
| cd01645 | CDD | RT_Rtv | RT_Rtv: Reverse transcriptases (RTs) from retroviruses (Rtvs). RTs catalyze the conversion of single-stranded RNA into double-stranded viral DNA for integration into host chromosomes. Proteins in this subfamily contain long terminal repeats (LTRs) and are multifunctional enzymes with RNA-directed DNA polymerase, DNA directed DNA polymerase, and ribonuclease hybrid (RNase H) activities. The viral RNA genome enters the cytoplasm as part of a nucleoprotein complex, and the process of reverse transcription generates in the cytoplasm forming a linear DNA duplex via an intricate series of steps. This duplex DNA is colinear with its RNA template, but contains terminal duplications known as LTRs that are not present in viral RNA. It has been proposed that two specialized template switches, known as strand-transfer reactions or "jumps", are required to generate the LTRs. [PMID: 9831551, PMID: 15107837, PMID: 11080630, PMID: 10799511, PMID: 7523679, PMID: 7540934, PMID: 8648598, PMID: 1698615] |
| cd01646 | CDD | RT_Bac_retron_I | RT Bac retron I: Reverse transcriptases (RTs) in bacterial retrotransposons or retrons. The polymerase reaction of this enzyme leads to the production of a unique RNA-DNA complex called msDNA (multicopy single-stranded (ss)DNA) in which a small ssDNA branches out from a small ssRNA molecule via a 2'-5' phosphodiester linkage. Bacterial retron RTs produce cDNA corresponding to only a small portion of the retron genome. [PMID: 1698615, PMID: 16093702, PMID: 8828137] |

TABLE 3-continued

InterPro descriptions of signatures present in reverse transcriptases in Table 2.

| Signature | Database | Short Name | Description |
|---|---|---|---|
| cd01648 | CDD | TERT | TERT: Telomerase reverse transcriptase (TERT). Telomerase is a ribonucleoprotein (RNP) that synthesizes telomeric DNA repeats. The telomerase RNA subunit provides the template for synthesis of these repeats. The catalytic subunit of RNP is known as telomerase reverse transcriptase (TERT). The reverse transcriptase (RT) domain is located in the C-terminal region of the TERT polypeptide. Single amino acid substitutions in this region lead to telomere shortening and senescence. Telomerase is an enzyme that, in certain cells, maintains the physical ends of chromosomes (telomeres) during replication. In somatic cells, replication of the lagging strand requires the continual presence of an RNA primer approximately 200 nucleotides upstream, which is complementary to the template strand. Since there is a region of DNA less than 200 base pairs from the end of the chromosome where this is not possible, the chromosome is continually shortened. However, a surplus of repetitive DNA at the chromosome ends protects against the erosion of gene-encoding DNA. Telomerase is not normally expressed in somatic cells. It has been suggested that exogenous TERT may extend the lifespan of, or even immortalize, the cell. However, recent studies have shown that telomerase activity can be induced by a number of oncogenes. Conversely, the oncogene c-myc can be activated in human TERT immortalized cells. Sequence comparisons place the telomerase proteins in the RT family but reveal hallmarks that distinguish them from retroviral and retrotransposon relatives. [PMID: 9110970, PMID: 9288757, PMID: 9389643, PMID: 9671703, PMID: 9671704, PMID: 10333526, PMID: 11250070, PMID: 15363846, PMID: 16416120, PMID: 16649103, PMID: 16793225, PMID: 10860859, PMID: 9252327, PMID: 11602347, PMID: 1698615, PMID: 8828137, PMID: 10866187] |
| cd01650 | CDD | RT_nLTR_like | RT_nLTR: Non-LTR (long terminal repeat) retrotransposon and non-LTR retrovirus reverse transcriptase (RT). This subfamily contains both non-LTR retrotransposons and non-LTR retrovirus RTs. RTs catalyze the conversion of single-stranded RNA into double-stranded DNA for integration into host chromosomes. RT is a multifunctional enzyme with RNA-directed DNA polymerase, DNA directed DNA polymerase and ribonuclease hybrid (RNase H) activities. [PMID: 1698615, PMID: 10605110, PMID: 10628860, PMID: 11734649, PMID: 12117499, PMID: 12777502, PMID: 14871946, PMID: 15939396, PMID: 16271150, PMID: 16356661, PMID: 2463954, PMID: 3040362, PMID: 3656436, PMID: 7512193, PMID: 7534829, PMID: 7659515, PMID: 8524653, PMID: 9190061, PMID: 9218812, PMID: 9332379, PMID: 9364772, PMID: 8828137] |
| cd01651 | CDD | RT_G2_intron | RT_G2_intron: Reverse transcriptases (RTs) with group II intron origin. RT transcribes DNA using RNA as template. Proteins in this subfamily are found in bacterial and mitochondrial group II introns. Their most probable ancestor was a retrotransposable element with both gag-like and pol-like genes. This subfamily of proteins appears to have captured the RT sequences from transposable elements, which lack long terminal repeats (LTRs). [PMID: 1698615, PMID: 8828137, PMID: 12403467, PMID: 11058141, PMID: 11054545, PMID: 10760141, PMID: 10488235, PMID: 9680217, PMID: 9491607, PMID: 7994604, PMID: 7823908, PMID: 3129199, PMID: 2531370, PMID: 2476655] |
| cd03487 | CDD | RT_Bac_retron_II | RT Bac retron II Reverse transcriptases (RTs) in bacterial retrotransposons or retrons. The polymerase reaction of this enzyme leads to the production of a unique RNA-DNA complex called msDNA (multicopy single-stranded (ss)DNA) in which a small ssDNA branches out from a small ssRNA molecule via a 2'-5' phosphodiester linkage. Bacterial retron RTs produce cDNA corresponding to only a small portion of the retron genome. [PMID: 1698615, PMID: 8828137, PMID: 11292805, PMID: 9281493, PMID: 2465092, PMID: 1722556, PMID: 1701261, PMID: 1689062] |
| cd03715 | CDD | RT_ZFREV_like | RT_ZFREV_like: A subfamily of reverse transcriptases (RTs) found in sequences similar to the intact endogenous retrovirus ZFERV from zebrafish and to Moloney murine leukemia virus RT. An RT gene is usually indicative of a mobile element such as a retrotransposon or retrovirus. RTs occur in a variety of mobile elements, including retrotransposons, retroviruses, group II introns, bacterial msDNAs, hepadnaviruses, and |

TABLE 3-continued

InterPro descriptions of signatures present in reverse transcriptases in Table 2.

| Signature | Database | Short Name | Description |
|---|---|---|---|
| cd05536 | CDD | POLBc_B3 | caulimoviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. Phylogenetic analysis suggests that ZFERV belongs to a distinct group of retroviruses. [PMID: 14694121, PMID: 2410413, PMID: 9684890, PMID: 10669612, PMID: 1698615, PMID: 8828137] DNA polymerase type-B B3 subfamily catalytic domain. Archaeal proteins that are involved in DNA replication are similar to those from eukaryotes. Some members of the archaea also possess multiple family B DNA polymerases (B1, B2 and B3). So far there is no specific function(s) has been assigned for different members of the archaea type B DNA polymerases. Phylogenetic analyses of eubacterial, archaeal, and eukaryotic family B DNA polymerases are support independent gene duplications during the evolution of archaeal and eukaryotic family B DNA polymerases. Structural comparison of the thermostable DNA polymerase type B to its mesostable homolog suggests several adaptations to high temperature such as shorter loops, disulfide bridges, and increasing electrostatic interaction at subdomain interfaces. [PMID: 10997874, PMID: 11178906, PMID: 10860752, PMID: 10097083, PMID: 10545321] |
| cd05780 | CDD | DNA_polB_Kod1_like_exo | The 3'-5' exonuclease domain of archaeal family-B DNA polymerases with similarity to *Pyrococcus kodakaraensis* Kod1, including polymerases from *Desulfurococcus* (D. Tok Pol) and *Thermococcus gorgonarius* (Tgo Pol). Kod1, D. Tok Pol, and Tgo Pol are thermostable enzymes that exhibit both polymerase and 3'-5' exonuclease activities. They are family-B DNA polymerases. Their amino termini harbor a DEDDy-type DnaQ-like 3'-5' exonuclease domain that contains three sequence motifs termed ExoI, ExoII and ExoIII, with a specific YX(3)D pattern at ExoIII. These motifs are clustered around the active site and are involved in metal binding and catalysis. The exonuclease domain of family B polymerases contains a beta hairpin structure that plays an important role in active site switching in the event of nucleotide misincorporation. Members of this subfamily show similarity to eukaryotic DNA polymerases involved in DNA replication. Some archaea possess multiple family-B DNA polymerases. Phylogenetic analyses of eubacterial, archaeal, and eukaryotic family-B DNA polymerases support independent gene duplications during the evolution of archaeal and eukaryotic family-B DNA polymerases. [PMID: 18355915, PMID: 16019029, PMID: 11178906, PMID: 10860752, PMID: 10097083, PMID: 10545321, PMID: 9098062, PMID: 12459442, PMID: 16230118, PMID: 11988770, PMID: 11222749, PMID: 17098747, PMID: 8594362, PMID: 9729885] |
| PF00078 | Pfam | RVT_1 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. [PMID: 1698615] |
| PF00136 | Pfam | DNA_pol_B | This region of DNA polymerase B appears to consist of more than one structural domain, possibly including elongation, DNA-binding and dNTP binding activities. [PMID: 9757117, PMID: 8679562] |
| PF07727 | Pfam | RVT_2 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. This Pfam entry includes reverse transcriptases not recognised by the Pfam: PF00078 model. [PMID: 1698615] |
| IPR000477 | InterPro | RT_dom | The use of an RNA template to produce DNA, for integration into the host genome and exploitation of a host cell, is a strategy employed in the replication of retroid elements, such as the retroviruses and bacterial retrons. The enzyme catalysing polymerisation is an RNA-directed DNA-polymerase, or reverse trancriptase (RT) (2.7.7.49). Reverse transcriptase occurs in a variety of mobile elements, including retrotransposons, retroviruses, group II introns [PMID: 12758069], bacterial msDNAs, hepadnaviruses, and caulimoviruses. Retroviral reverse |

TABLE 3-continued

InterPro descriptions of signatures present in reverse transcriptases in Table 2.

| Signature | Database | Short Name | Description |
|---|---|---|---|
| | | | transcriptase is synthesised as part of the POL polyprotein that contains; an aspartyl protease, a reverse transcriptase, RNase H and integrase. POL polyprotein undergoes specific enzymatic cleavage to yield the mature proteins. The discovery of retroelements in the prokaryotes raises intriguing questions concerning their roles in bacteria and the origin and evolution of reverse transcriptases and whether the bacterial reverse transcriptases are older than eukaryotic reverse transcriptases [PMID: 8828137], Several crystal structures of the reverse transcriptase (RT) domain have been determined [PMID: 1377403]. |
| IPR006134 | InterPro | DNA-dir_ DNA_pol_B_ multi_dom | DNA is the biological information that instructs cells how to exist in an ordered fashion: accurate replication is thus one of the most important events in the life cycle of a cell. This function is performed by DNA-directed DNA-polymerases 2.7.7.7) by adding nucleotide triphosphate(dNTP) residues to the 5' end of the growing chain of DNA, using a complementary DNA chain as a template. Small RNA molecules are generally used as primers for chain elongation, although terminal proteins may also be used for the de novo synthesis of a DNA chain. Even though there are 2 different methods of priming, these are mediated by 2 very similar polymerases classes, A and B, with similar methods of chain elongation. A number of DNA polymerases have been grouped under the designation of DNA polymerase family B. Six regions of similarity (numbered from I to VI) are found in all or a subset of the B family polymerases. The most conserved region (I) includes a conserved tetrapeptide with two aspartate residues. It has been suggested that it may be involved in binding a magnesium ion. All sequencesin the B family contain a characteristic DTDS motif (SEQ ID NO: 1558), and possess many functional domains, including a 5'-3' elongation domain, a 3'-5' exonuclease domain [PMID: 8679562], a DNA binding domain, and binding domains for both dNTP's and pyrophosphate [PMID: 9757117], This domain of DNA polymerase B appears to consist of more than one activities, possibly including elongation, DNA-binding and dNTP binding [PMID: 9757117]. |
| IPR013103 | InterPro | RVT_2 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. This entry includes reverse transcriptases not recognised by IPR000477 [PMID: 1698615]. |

Table 4 (below) shows exemplary GENE WRITER™ proteins and associated sequences from a variety of retrotransposases, identified using data mining. Column 1 indicates the family to which the retrotransposon belongs. Column 2 lists the element name. Column 3 indicates an accession number, if any. Column 4 lists an organism in which the retrotransposase is found. Column 5 lists the predicted 5' untranslated region, and column 6 lists the predicted 3' untranslated region; both are sequences that are predicted to allow the template RNA to bind the retrotransposase of column 7. (It is understood that columns 5-6 show the DNA sequence, and that an RNA sequence according to any of columns 5-6 would typically include uracil rather than thymidine.) Column 7 lists the predicted retrotransposase amino acid sequence.

TABLE 4

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| R2 | R2-1_TG | . | Taeniopygia guttata | GTCTAGTTACAACTGGGCAT CGCTGCAGAGATCGCACCTC CTCGTGGTCCCGCTGGTAGC CCTTCGAAGGGTGACTAAGT CGATCTCTGCCCCAGGTACG GAGCCGTTGGGACTCACCAG TCCAACGTAACTCCTGCCTA AATTCGGTGAAACAAATTCC TCGGTAAAAAGCCCC (SEQ ID NO: 1140) | TTCAGGTTATTTAGATGCTT AGTTTTTGTACCTTTCTTGT TTTGTTTAGGATTTTGATAG TGTTAGTATTTTTATATTTT TGTACGATTGCATAATGTTC TTTTTTATACAGTTCTGTTT TAATAAAATAGACGATAGCT AGAGACGTTAGGGCAGCCAC AAGCCAGTTAGGTAGCGGAT AGTAGGTAGGAACAGACTTT TACTATTTCATAACGCGTCA ATTACCACCTGATTTGGACC AATTCACGGGATTTGTCCAA | MASCPKPGPPVSAGAMSLES GLTTHSVLAIERGPNSLANS GSDFGGGGLGLPLRLLRVSV GTQTSRSDWVDLVSWSHPGP TSKSQQVDLVSLFPKHRVDL LSKNDQVDLVAQFLPSKFPP NLAENDLALLVNLEFYRSDL HVYECVHFAAHWEGLSGLPE VYEQLAPQPCVGETLHSSLP RDSELFVPEEGSSEKESEDA PKTSPPTPGKHGLEQTGEEK VMVTVPDKNPPCPCCGTRVN SVLNLIEHLKVSHGKRGVCF |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | GGTGGACGGGCCACCTTTAC TTAACCCGGAAAAGGAACAT ATATAATTTATGTGTTCG ATAAA (SEQ ID NO: 1263) | RCAKCGKENSNYHSVVCHFP KCRGPETEKAPAGEWICEVC NRDFTTKIGLGQHKRLAHPA VRNQERIVASQPKETSNRGA HKRCWTKEEEELLIRLEAQF EGNKNINKLIAEHITTKTAK QISDKRRLLSRKPAEEPREE PGTCHHTRRAAASLRTEPEM SHHAQAEDRDNGPGRRPLPG RAAAGGRTMDEIRRHPDKGN GQQRPTKQKSEEQLQAYYKK TLEERLSAGALNTFPRAFKQ VMEGRDIKLVINQTAQDCFG CLESISQIRTATRDKKDTVT REKHPKKPFQKWMKDRAIKK GNYLRFQRLFYLDRGKLAKI ILDDIECLSCDIPLSEIYSV FKTRWETTGSFKSLGDFKTY GKADNTAFRELITAKEIEKN VQEMSKGSAPGPDGITLGDV VKMDPEFSRTMEIFNLWLTT GKIPDMVRGCRTVLIPKSSK PDRLKDINNWRPITIGSILL RLFSRIVTARLSKACPLNPR QRGFIRAAGCSENLKLLQTI IWSAKREHRPLGVVFVDIAK AFDTVSHQHIIHALQQREVD PHIVGLVSNMYENISTYITT KRNTHTDKIQIRVGVKQGDP MSPLLFNLAMDPLLCKLEES GKGYHRGQSSITAMAFADDL VLLSDSWENMNTNISILETF CNLTGLKTQGQKCHGFYIKP TKDSYTINDCAAWTINGTPL NMIDPGESEKYLGLQFDPWI GIARSGLSTKLDFWLQRIDQ APLKPLQKTDILKTYTIPRL IYIADHSEVKTALLETLDQK IRTAVKEWLHLPPCTCDAIL YSSTRDGGLGITKLAGLIPS VQARRLHRIAQSSDDTMKCF MEKEKMEQLHKKLWIQAGGD RENIPSIWEAPPSSEPPNNV STNSEWEAPTQKDKFPKPCN WRKNEFKKWTKLASQGRGIV NFERDKISNHWIQYYRRIPH RKLLTALQLRANVYPTREFL ARGRQDQYIKACRHCDADIE SCAHIIGNCPVTQDARIKRH NYICELLLEEAKKKDWVVFK EPHIRDSNKELYKPDLIFVK DARALVVDVTVRYEAAKSSL EEAAAEKVRKYKHLETEVRH LTNAKDVTFVGFPLGARGKW HQDNFKLLTELGLSKSRQVK MAETFSTVALFSSVDIVHMF ASRARKSMVM (SEQ ID NO: 1016) |
| R2 | R2-1_Gfo | . | Geospiza fortis | AGACTTAAGTGAGTTTGGTT ACAACTGGGACATAGCTGCAG AGACCGCGCCTCCTCGCGGC CCCGCTGGTAAGCCCTTAAC AGGGTGACTAA (SEQ ID NO: 1141) | GGTAGATAATCTTTGTATAG TGGGGGGGGATCTCATGTAC CGGGTTTCTTTTATTTGATT TTCAATAAAACAGACGGTAG CTAGGTTCGCAAGGCAGCCA CAAGCCAAAGATAGGTAGGG TGCTCATAGTGAGTAGGGAC AGTGCCTTTTGATTCACAAC GCGTCAATACCATCTGACAC GGATACCCTTACCGGACTTG TCATGATCTCCCAGACTTGT CCAAGGTGGACGGGCCACCT | VGLCPSPGVDGTHQPNDSFQ NFGETNFSVQVARLVTRNLA PRSVRGNGFGSGMATHPVPA DESGHESDPFLVGRSCGQPA RLTRQSVGTQTSRDDILPSK TTKLTENELDLLVNFSLELY RSDLQGFVQEGIHFSVNREV LEGFPEVYEQPAPQPAVGDD LNTSLPPDNNICVLEKGSSE AVEDGTPEVAHPVPETQGKE SPNNIVMVTLPNKNPPCPCC RVRLHSVLALIEHLKGSHGK |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | TTACTTAACCCGGAAAAGGA ACATATATTAATTATATGTG TTCGGAAAA (SEQ ID NO: 1264) | KRACFRCVKCGRENFNYHST VCHIAKCKGPKVEKAPVGEW ICEVCGRDFTTKIGLGQHKR LAHPLVRNQERIDASQPKET SNRGAHKRCWTKEEEEMLIK LEVQFEGHRNINKLIAEHLT TKTSKQISDKRRLLPRKQLT DLSKGVAGQKVLDPGLSHQP QLGVVDNGLGGGHLPGGPAA EGRTIEPLGHHLDKDNGHRE IADQHKAGRLQAHYRKKIRK RLSEGMISNFPEVFEQLLDC QEAQPLINQAAQDCFGCLDS ASQIRKALRKQNTQKDQGDQ PKRPAQKWMKKRAVKRGHFL RFQKLFHLDRGKLAKIILDD VECLSCDIPPSEIYSVFKAR WETPGQFAGLGDFEINRKAN NKAFRDLITAKEILKNVREM TKGSAPGPDGIALGDIRKMD PEYTRTAELFNLWLTSGEIP DMVRGCRTVLIPKSSKPERL KDINNWRPITIGSILLRLFS RIITARLTKACPLNPRQRSF ISAAGCSENLKLLQTIIRTA KNEHRPLGVVFVDIAKAFDT VSHQHIIHVLQRRRVDPHII GLVKNMYKDISTVITTKKNT YTDKIQIQVGVKQGDPLSPL LFNLAMDPLLCKLEEHGKGF HRGQSKITAMAFADDLVLLS DSWEDMNANIKILETFCDLT GLKTQGQKCHGFYIKPTKDS YTVNNCAAWTINGTPLNMIN PGESEKYLGLQFDPWVGIAK TSLPEKLDFWLERIDRAPLK PFQKLDILKTYTIPRLTYVA DHSEMKAGALEALDRTIRSA VKDWLHLPSSTCDAILYTSM KDGGLGVTKLVGLIPSVQAR RLHRIAQSPEETMKDFLEKA QMEKMYEKLWVQAGGKRKRM PSIWEALPEVVPSIDTATTS EWEAPNPKSKYPRPCNWRRK EFKKWTKLIAQGWGIRCFKG DKISNNWIRHYRYIPHRKLL TAIQLRASVYPTREFLARGR EDNCVKSCRHCEAAEESCAH IIGMCPVVRDARIKRHNRIC ERLMEEAGKRDWTVFQEPHI RDVTKELYKPDLIFVKEGLA LVVDVTIRFESTKTTLEEAA AEKVNKYKHLETEVRNLTNA KDVIFMGFPLGARGQWYNKN FELLDTLGLPRSRQDIIAKT LSTDALISSVDIIHMFASRG RRQHA (SEQ ID NO: 1386) |
| R2 | R2-1_ZA | . | Zonotrichia albicollis | CGACTTGAGAAGGTCTGGTT ACAACTGGGCATAGCTGCAG AGATCGCGCCTCCTCGTGGC CCCGCTGGTAAGCCCTTAAC AGGGTGACTAAGTCGATCTC TGCCCCAGTCCAGGAGCCGC TGGGTTTCACCAGCCCAGCG ATTCCTTCCAAATTCGGTGA (SEQ IDNO: 1142) | GTAGTCACATTGCACTTTCT GTAACTTGCACTGGGTGTGG GATGTGGGCCTGGGGTGTGG GTTATGGGGTATATATGTGG GATATTCTGGTGGGAATGTC CATTCACTGTATGCCTATCT TTTTAATAAAAAGACGGTAG CTAGGTTCGCGAAGCAGCCA CAAGCCAATAGCCAGTTAGG TAGTCATAGTGGGTAGGTG ACAGGAACCTTTGACTCAGA ACGCGTCATTAACATCTAG AACGGACCAAACTTCGGACA TGCACCGATTAACCGGATTT GTCCAAGGTGGACGGGCCAC | NKFLGKSRVAYCLKPGPPVS DRGKEFGSGLTTHPEPESES GHDPTVPNPGPSLGAGEGAQ PLPLLRVSVGTQTCEEDFIT SRPTKLPGIESELGPLVKFS LEVYRSDLKGDVQFEGIHPP DNWGVLEGFPEVYEQLAPQP NGGDELNHSLPGDREGDVLE KDSSEKEKEAAPEALPSVQR ARSEQLPDNIVKVTVPDKNP PCPCCGVRLNSVLALIEHLK GSHGRRRVCFRCAKCGRENF NHHSTVCHYAKCKGPQIERP PVGEWICEVCGRDFTTKIGL GQHKRHMHAMVRNQERIDAS |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | CTTTACTTAACCCGGAAAGG GAACATATATAGTTATATGT GTTCGTAATA (SEQID NO: 1265) | QPKETSNRGAHKRCWTKEEE ELLMKLEVQFENHKNINKLI AEQLTTKTAKQISDKRRMLL KKGRGTTGNLETEPGMSHQS QAKVKDNGLGGDHLPGGPVV DKGTIGKPGQHLDTDNSHQI TAGKKKGGGLQARYRRRIMK RLAAGTINIFPKVFKELIND QEARPLINQTTEDCFGLLDS ACQIRTALREKGKSQEERPR KQYQKWMKKRAIKRGDYLRF QRLFHLDRGKLARIILDNTE SLSCDISPSEIYSVFKARWE TPGHFNGLGDFEIKGKANNK AFRDFITAKEIEKNVREMSK GSAPGPDGIALGDIKKMDPG YSRTAELFNLWLTAGDIPDM VRGCRTVLIPKSTTPERLKD INNWRPITIGSILLRLFSRI ITARMTKACPLNPRQRGFIS APGCSENLKLLQSIIRTAKN EHKPLGVIFVDIAKAFDTVS HQHIIHVLQQRRVDPHIVGL VNNMYKDISTYVTTKKNTHT DKIQIRVGVKQGDPLSPLLF NLAMDPLLCKLEESGKGFHR GQSSITAMAFADDLVLLSDS WENMKENIKILETFCNLTGL KTQGQKCHGFYIKPTKDSYT INNCPAWTINGTPLNMINPG ESEKYLGLQIDPWTGVAKYD LSTKLKIWLESIDRAPLKPL QKLDILKTYTIPRLTYLADH SEMKAGALEALDQQIRTAVK DWLHLPSCTCDAILYVSTRD GGLGVTKLAGLIPSVQARRL HRIAQSPDETMKDFLEKAQM EKMYEKLWVQAGGKKKGMPS IWEALPMTVPPTNTGNLSEW EAPNPKSKYPKPCDWRRKEL KKWTKLESQGRGVKNFRNDT ISNDWIQYYRRIPHRKLLTA IQLRANVYPTREFLARGRGD NYVKFCRHCEADLETCGHII GFCPVTKDARIKRHNRICDR LCEEAAKREWVVFKEPHLRD ATTELFKPDVIFVKEDRALV VDVTVRYESAKTTLEAAAME KVDKYKHLEAEVKELTNAKD VVFMGFPLGARGKFYKGNFN LLETLGLPKTRQLSVAKTLS TYALMSSVDIVHMFASRSRK PNV (SEQ ID NO: 1387) |
| R2 | R2Dr | AB097126 | Danio rerio | AATCCCCCTACCCAATCCC CCCGTCGTGACCTCCAGGCC AGGAATCACGAGCGTACGAC AGTGGCCATCCGGCAATGAC AATAGCGTGACTAACGACAA TGAGTCAGATCCATGACCCT TGGAGTGGGTTAACCTCCGC CTCTTTAAAAAC (SEQ ID NO: 1143) | AAATCCCAGCGGGATACAGC AAGAAGGTATCGGATCTAAT AAGGTTGAGCGAGGAGAGGG TGGAGATCCTTTGGGGGGGG TCGGGCTAAGTTCCCCTCTC GGGTCCTCCCACGGTGACGC TCTACCCCTCCCTCCTCGCT CGTAGAACCCAACGGTGAAC ACGGTTGGCAGGATGAAGTG ACGTGAGGGGTAAGACATGC GTACGTGAGCGCGCATTTTT GCTGTTCTCTGGACTGGGTT TCGTCCCCCTCACAACCATC ACTTACACTATAGGGGCACA GCGGCTCCTACCTCCCTCCC TATGACCCCCCCTTCCCATA CCGATCCATGGCTGTTCTAG TCTGGACCGAGGGTCGGACG GGGCATTTGAAGGTAGCTGG | MESTAKGKSYWMARRPVEGA TEGSLGRVPFVTRDPKRKPE AKRTLTHGLGLRECSVVLTR LIEGRRGRDHTPSGWNAQRG MPNDESSVEEPNGPIPSNPI PTGTQALPEPMADGEQGEHP GVVVTLPLRDLNCPLCGGSA STAVKVQRHLAFRHGTVPVR FSCESCGKTSPGCHSVLCHI PKCRGPTGEPPEKVVKCEGC SRTFGTRRACSIHEMVHSE IRNRKRIAQDRQEKGTSTDG EGRAGVERADAGEGPSGEGI PPKRPRRARTPREPSEPPAN PPILSPQPDLPPGGLRDLLR EVASGWVRAARDGGTVIDSV LAAWLDGNDRLPELVDAATQ RTLQGLPAGRLARRPATFVA PNRRRGRWGRRLKLLAKRRA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | AATCCTCCGCTGCTGCGAGC<br>CTGAGGTCGATGGTTAGAGG<br>TGAAATACTTGGGAGGAGAC<br>ACAGCCTCCGGAGAGCCCCT<br>CCCCGGGTGGTCATCATGGCA<br>ACCGGGTGAAACCTTACGGT<br>TTCACTTACGAAACAGCACC<br>ATAACAGCGCCGTAATAGCG<br>CACCGGTGTGACTACTGTCC<br>AGTGCTGATATTCTCATCTG<br>GAGAATACAACACGGGTAAT<br>GGCAGAGTATTCAAAACCCA<br>AATGTTTACGATCGACCAAC<br>GGAGTCGTTCCCTTGCATCT<br>AGGCCGGACCCGAAACTGCC<br>GTAATTGCCCGTCCCCAAGG<br>TAGCCTCTTAGAAAACCGAA<br>GCCCGGTCGGGCGGTGGTT<br>GCGGCGGCGCTGCGGGGGCC<br>TGCTGCTCGGGCGGCGTCGG<br>TGTGCCGCGGTGGTTGCGGT<br>GGTGCGGCGGGGATCTCGGT<br>CCTTGCGGTGCCGCTGTGCC<br>GCCGCGGTCGCGTCGGTGGC<br>GCTGGGGTGGTGGCCCGAGT<br>GGCGTCGGCGTGCCACTGCC<br>CATAGTCGCCCGCGGGGGCG<br>ACCGATCTGGAGGGGCGAGG<br>GGGCTCGCGGGACTTTAACG<br>AGAAACGGAACGCAACTTCT<br>CGCATCGCTCCCGGGACTTT<br>CCCCCCTCGTTCAGCCGAGG<br>GATGCCAAAAGGCATGAAAG<br>GTAAGTACCATACCGGTCCG<br>CAAAACTCTCTTCTGACTCG<br>GTTCTCTGTTGGTTTTCTAG<br>AGTAACAACGAGGTGGAGGA<br>GAGGGACATGGCAGGGACTC<br>CCATTCGTGCCAGCGGGTGG<br>GGACAGATCGAAGGAACGGT<br>TCGAGGGCGTAACAGACGAG<br>AGGGAATCCGGTCACACATT<br>GATGCCATGCCTAAATAGGC<br>GAGGTTTGTATTTCTACTTT<br>GTGGGTTCAGTATAGTCGGA<br>GCATATGGTCGGTTGTCCCG<br>TTGTTTTCACGGCGGCAAG<br>CGACTATCATGATAAAGTAG<br>AATGGGAGACGGGCTCCCTG<br>ACAAACCCGGAAAGGCGCCC<br>CCCCGTGGTTCGTAGCAGCT<br>GACGGATCACGCTCGAAGAA<br>AAATGAGTGAGAGGGGACGC<br>CGCAACCAC<br>(SEQ ID NO: 1266) | YHDCQIRFRKDPARLAANIL<br>DGKSETSCPINEQAIHEHFR<br>NKWANPSPFGGLGRFGTENR<br>ANNAHLLGPISKSEVQTSLR<br>NASNASTPGPDVGKRDISN<br>WDPECETLTQLFNMWWFTGV<br>IPSRLKKSRTVLLPKSSDPG<br>AEMEIGNWRPITIGSMVLRL<br>FTRVINTRLTEACPLHPRQR<br>GFRRSPGCSENLEVLECLLR<br>HSKEKRSQLAVVFVDFAQAF<br>DTVSHEHMLSVLEQMNVDPH<br>MVNLIREIYTNSCTSVELGR<br>KEGPDIPVRVGVKQGDPLSP<br>LLFNLALDPLIQSLERTGKG<br>CEAEGHKVTALAFADDLALV<br>AGSWEGMAHNLALVDEFCLT<br>TGLTVQPKKCHSFMVRPCRG<br>AFTVNDCPPWVLGGKALQLT<br>NIENSIKYLGVKVNPWAGIE<br>KPDLTVALDRWCKRIGKSLL<br>KPSQKVYILNQFAIPRLFYL<br>ADHGGAGDVMLQNLDGTIRK<br>AVKKWLHLPPSTCNGLLYAR<br>NCNGGLGICKLTRHIPSMQA<br>RRMFRLANSSDPLMKAMMRG<br>SRVEQKFKKAWMRAGGEESA<br>LPRVFGANQYQEGEEVANDL<br>VPRCPMPSDWRLEEFQHWMG<br>LPIQGVGIAGFFRNRVANGW<br>LRKPAGFKERHYIAALQLRA<br>CVYPTLEFQQRGRSKAGAAC<br>RRCSSRLESSSHILGKCPAV<br>QGARIRRHNKICDLLKAEAE<br>TRGWEVRREWAFRTPAGELR<br>RLDLVLILGDEALVIDVTVR<br>YEFAPDTLQNAGKDKVSYYG<br>PHKEAIARELGVRRVDIHGF<br>PLGARGLWLASNSKVLELMG<br>LSRERVKVFSRLLSRRVLLY<br>SIDIMRTFYATLQ<br>(SEQ ID NO: 1388) |
| R2 | R2-1_GA | . | Gasterosteus aculeatus | CATATTGGGGTCTCAGGAGG<br>AGACACAGGGTCTGTTGCGG<br>CTCCGGTAAACGGTACCGGA<br>GTCGGTTAAGCATCGTTTGG<br>GCCCGCCTCCACGTGGTGGT<br>CCGCGGTAACACCAATAGGG<br>TGGCTAAGAGGCCCAGTAAT<br>TTCCCCGAATTGTCTTCCCC<br>CCCGCGCGGGGGGCACCCCC<br>CTTTAGTGTCGGAGCGGTCG<br>CGCCTCCGCGTTTGGGGTGT<br>CGCAGGCGTGAGCCTTCGTC<br>CCCTTAAGTTCAGACGGTCC<br>CGGCTTCTTGCCGGGCCAAC<br>CCCCGGTGCAGCGTTCTCCC<br>ATGTTGGATCGGCACCCAGC<br>CCCGGGTGCCATGCGAGTTC<br>AGACATTTTGTTTATGTATC | GGAGGGGAGTAGGTCTCTAC<br>TCTGACCCGAAGGGCCCCCC<br>CGTTTCAGACCTGATTCTAG<br>GCTACCTGTGCCTAATTGGG<br>GGGGTCCCAAAGAGATGTTG<br>TCTGTTGTAGAAGGGTTTGC<br>GCCACTGACTGCACGGAAGG<br>GTGGGCCTCGACAGGTAGGG<br>GTTACATGACTCCGTGCTGC<br>TCAGCAGACCCGCGCCTCTG<br>AGACCGGGTAGGGCTACTTG<br>AACAAGCGACGCCCTGGTGT<br>ATGTCCGTATCCTTAACCTGG<br>TTTGGGAAAGCCGATACCGG<br>CAATGCCCGCTCACAGGGTGTC<br>GCGCACCCCACGGGATGACG<br>TATGGGCCCCGGGGGACCTC<br>ATGGATACTCCACTGGACTT | MLRGGVGTPPAGGAGAVGPG<br>MASPGGCSVRFSPGGRRLLG<br>HRTGGLSPSVSWRLKRLSVS<br>LRRWSGPGLLGADGAGGGAA<br>VASPRGTQVLGSGAGRRWLG<br>HGSRGSSPSAARGLRRLTVR<br>LKRLSGGLLSPKACRDAEEG<br>SSSSPGFRNPKGLGGRGLTP<br>LGSRRFCRLTVSLNRWRGSL<br>VKLNASSRASGRRTPVKPAC<br>DSRAGRGSEHAEGGGVSAAP<br>MVLRSRRKLTFSVDGDSNSG<br>DRARSGSVSAARPGHLLVDG<br>ESASSRSGPAGDARLAGPST<br>RSRRKGCLPPVDFENPKKRT<br>RLMAKMTNGNPTSHVPCPAP<br>CSNGHEGGGRVAVIEGRLPE<br>LSGSRISGIQPALPVETSFV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | GTCTGCGTGGTTGACTTGCT AAGCTCATTTCCTCCTCTCA CTGCGTCCCCCCAGGTGCTG ATCGGTTGAAGAGGATTCGT CGTTGACCTCGGCGGTGAAT TTGGGATTGTATTATACAGG TAGGTATAGAGGGCGTGCGG (SEQ ID NO: 1144) | GCACAATCCTGGTGTACTGG ATGCAGCGACGTTGGTGACA TAAGCAATCGCTAAGTCGGG GTAGGGGAGGTGGGGACCTC GGCACGGCTGTAGGAACGGG TGTATGGGCTCCGGCAGCCG TCGTCACTCCCATACAACAC AGGGGCTGCATCCTGGTGGC CGGTGCTAGTTGGTTCTGGA AGCCCGCCCGGGCTGGTTCG CAGAAGCAGGGTGCGCCCAG GGTAGGTTTGGTATATCTGG GTCCGGTGCGATACCTATCG ATGGGCAGCGAGGGCCGCCT CGTCGACGCGCTGTGTGGAGC TGGAGCCGGCCTGGGTATGA ACAGTTCTTGCGGATGTGGC GTAGCTAGATAGTACCCGTG GTTGTGGGCGTGGTGTCGAC CAAATGTTGTCCTGTGTGCA CATAGGCCAAGGGTTACGTG GGTGGCAGTCAGAAGCACCC GCACCTGGAAGTGATTGCCC CGGGATCCCGGCTCTCTGTG AAGAGCTACCTTGAGGAAAG GTGTTCCGCTGGAACTCAAG ACCCTACAGTAGGGGATATC AACTGGCTTTGAGGTGCTGT GATTCCGGAACCAGGGCGAG GGCGAGTACTTAGAGCATGT CCAAAAGCCCGGGGAACGTT CCGGGGGCCTGCTTGGGTCG TTGGACCCACATCCGTAAAA CGATGGATCTCGCGTCGGCG CTCGGGAGAACTTCCCGCAT GAACGCTGATTGCATGTGAG AACGCCCCCACGGCGGCGGG GCAGGCGCTCCCCCTGGGTG TAAGGCTCGGGGGGTCACG GCTCCGCTCTAAAAG (SEQ ID NO: 1267) | GQSTGRGADGDANANSSPPS PNLGGSVGMVPAVRDGTPPL GRPGEDHSRECAGGNTPLWM LEDSFRCDYCPREFGTRAGR SLHMRRAHLAEYDGAGFCWG ERLSEFAATRLWSTEETKKL AVFCERGVPSPSECRAIAAS LGAGKTHHQVRSKCRLVFEA IRRRELLEVAAATERLEKSA RRKQPAVPPAPVHGVRGVLR GLLGKRVPREGGTTGSTSAR IVRRDDCRQGAVASASLNLI RRLGRKATGRSGRRRVLGRP PRMDVRRSVRMRRMRRFLYR LARLGWAKLAMFVLDGQMGA SCPVPLVEVSAVFRERWSIV RAFLGLGQFGGFGTADNAGF GKLIDPAEVRAHLQSIKNRS SPGPDGITKVALSKWDPEGI KLAHMYSTWLVSAGIPKVFK KCRTTLIPKTGDVSLHGDVG QWRPITIASLVLRLYSRILT ERMTVACPSHPRQRGFIASP GCSENLMLLEGCMSLSKAGN GSLAVVFVDFAKAFDTVSHE HLLSVLVQKGLDQHMVELIK DSYENSVTKVHCQEGCSTDI AMKVGVKQGDSMSPLLFNLA LDPLIQQLEREGRGFPVNGK SITAMAFADDLAIVSDSWEG MRANLDILVDFCELTGMRTQ PSKCHGFLIEKSGSRSYKVN RCEPWLLNDTALHMVGPKES IKYLGVQVNPWTGIFAEDTV AKLRQWVVAISKTPLRPLDK VSLLCQFAVPRVIFVADHCM LSAKALTEMDRSIRQAVKRW LHLARCTTNGLLYSRKSSGG LGIPKLSMIVPAMQARRLLG LSRSKDETVRWMFLETTDHV AFERAWLRAGGSPDEVPELG PDLVEGSPAEGNADPVSTVR PRKRIVPCDWRQVEFDRWAG QLVQGKGIRTFEADKISNCW LYDYPPNKLKPGDFTAAVQL RANVYPTRELAGRGRTDTID VCCRHCGEAPETCWHILALC PKVKRCRIQRHHKVCQVLVA EAERHGWEVEREKRWMLPSG ECVAPDLICWLDELALIVDV TVRYEFDEESLERARIEKEC KYRPLIPVIRASRVQTKKVT VYGFPLGARGKWPAKNELLL ADLGLSKARTRSFAKLLSRR VLLHSLDVMRTFMR (SEQ ID NO: 1389) |
| R2 | R2_BM | AB076 841 | Bombyx mori | GGGCGATACGCATAATTTTA ATTTCCCGATTGAAATCCAG TCGTCTTAATCTGGTGACCA GTGGCGCGGTCACCAGTGA GTGCACAGGACGTGAATGGC TCCGAGGCTGGCGGAGTCAC TCACTATAAGTGTGAGAGAC GATGTCCTGTGCCAAGTATA CGTCCAACCCTAACGGGTTA AGTGAAATTAGTTGCTCATA ACAGGGACGGTGTACCTGTT TGCTCGTGGCTGGCTATCGA ATGGACGGGACCAATACACC CCCCTGTTAGTAATGGGGTA AGAGAGAGCGGTCTGAAACT ATGGCCGAAATCACGACGCC CCACTCCTACCCATAACCTG | GCCTTGCACAGTAGTCCAGC GGTAAGGGTGTAGATCAGGC CCGTCTGTTTCTTCCCCGGA GCTCGCTCCCTTGGCTTCCC TTATATTTAACATCAGAAAC AGACATTAAACATCTACTGA TCCAATTTCGCCGGCGTACG GCCACGATCGGGAGGGTGGG AATCTCGGGGATCTTCCGAT CCTAATCCATGATGATTACG ACCTGAGTCACTAAAGACGA TGGCATGATGATCCGGCGAT GAAAA (SEQ ID NO: 1268) | MMASTALSLMGRCNPDGCTR GKHVTAAPMDGPRGPSSLAG TFGWGLAIPAGEPCGRVCSP ATVGFFPVAKKSNKENRPEA SGLPLESERTGDNPTVRGSA GADPVGQDAPGWTCQFCERT FSTNRGLGVHKRRAHPVETN TDAAPMMVKRRWHGEEIDLL ARTEARLLAERGQCSGGDLF GALPGFGRTLEAIKGQRRRE PYRALVQAHLARFGSQPGPS SGGCSAEPDFRRASGAEEAV EERCAEDAAAYDPSAVGQMS PDAARVLSELLEGAGRRRAC RAMRPKTAGRRNDLHDDRTA SAHKTSRQKRRAEYARVQEL YKKCRSRAAAEVIDGACGGV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CACGTGGTACCGCCGCACAT TGACCGATACGGGAGGAGGG GCAGCACTTGAATCACGTAG TCTTGGTGTAGCCATTGCGG GACTACAGCCCTCGTAAGTG CCGCCTTAGAACGCAACGGG GCAATAGGTGGGCCGGGGCG CTAGCGGGGGGGAGTAATCT CCCCTGTTGGCGTGCACCGC ACTGCTCCCACTGGGGGCAG TGTCATCCGGAAACAGGTGG GCCGGGGCGCCACCAGGGGG GAGCAATCCCTCCTG (SEQ ID NO: 1145) | | GHSLEEMETYWRPILERVSD APGPTPEALHALGRAEWHGG NRDYTQLWKPISVEEIKASR FDWRTSPGPDGIRSGQWRAV PVHLKAEMFNAWMARGEIPE ILRQCRTVFVPKVERPGGPG EYRPILIASIPLRHFHSILA RRLLACCPPDARQRGFICAD GTLENSAVLDAVLGDSRKKL RECHVAVLDFAKAFDTVSHE ALVELLRLRGMPEQFCGYIA HLYDTASTTLAVNNEMSSPV KVGRGVRQGDPLSPILFNVV MDLILASLPERVGYRLEMEL VSALAYADDLVLLAGSKVGM QESISAVDCVGKQMGLRLNC RKSAVLSMIPDGHRKKHHYL TERTFNIGGKPLRQVSCVER WRYLGVDFEASGCVTLEHSI SSALNNISRAPLKPQQRLEI LRAHLIPRFQHGFVLGNISD DRLRMLDVQIRKAVGQWLRL PADVPKAYYHAAVQDGGLAI PSVRATIPDLIVRRFGGLDS SPWSVARAAAKSDKIRKKLR WAWKQLRRFSRVDSTTQRPS VRLFWREHLHASVDGRELRE STRTPTSTKWIRERCAQITG RDFVQFVHTHINALPSRIRG SRGRRGGGESSLTCRAGCKV RETTAHILQQCHRTHGGRIL RHNKIVSFVAKAMEENKWTV ELEPRLRTSVGLRKPDIIAS RDGVGVIVDVQVVSGQRSLD ELHREKRNKYGNHGELVELV AGRLGLPKAECVRATSCTIS WRGVWSLTSYKELRSIIGLR EPTLQIVPILALRGSHMNWT RFNQMTSVMGGGVG (SEQ ID NO:1390) |
| R2 | R8Hm-A | . | Hydra vulgaris | TTCAAGTGGATGAAGCTGGG AAGGTAATCTGTAGTTGGTT GAGTTGGTTGCAGATTACTG CTGTCGATTTTGCTTTCTAT TGAAAGCCTGTCTCTACGGG TCCTGAAGCTTGAATTTTGG TAGCTATAGTTTTGTGGGAG GAAAGTGGAATTTTGTACCA TCTTTTGTCTCTCGTATCTA CTATAGTAAATCCGGTCATG CAGCCTCTACGCGGCGCAAC TAGAAACTTGGATCAGTGAT CAAGGCTAATGCATGCCGGG TCTCCTCAGATTAGGAGTAT AATACAAATCTGACTTCATC ACTAAGAGGCTATGGGGCTA ACGATCCTATAGTCTCG (SEQ ID NO: 1146) | TAAATGCCAAAAGTTGCTTG GGCTAAATGATACGTACGCT AGAAAAAGCGACTTGCTGCA CGGATGACGGTTCATCAGAG CCCGATATGCATGTCAAG GCGGCAGGGAGAATCACTAG TGTAGCTGTTCTTTCCATTA CGACTTACGCGGTTAACGTG GCACGATAGATTTACACCAG GAAATAATACGTGAAGGGTT CCACCATATACTGGAGTTTA GATCTATGAGGGAAACATTT GTAATAAGTCAGTCTGGTAA CCTGGCGCCGCTGTTGAGTC AAATTAACTATGTCAATACT CATTAAGTTATCGACTTTGA TATGGCATGGGGTGATTCCG CGTTATATCAAAGTCAAACA TGATGATTGCAATGAGAAAC TACCACGCTTGGTCACGTTT GTGAGGAGAACATCTCATTC AAGCCTCCCGGATGTCGGCA CCCGCTGACATCTTCTGGCT TATGAAAATTTTCATTAATT TTTGTAAGTCATGGGCGGCT GAAAGC (SEQ ID NO: 1269) | MNLLIVTSSIKESDVPSSGK GGVAVNNITAGASGKDTCVI IHPGTDGIWCCTECVEIHNS GKDLKRHLAKRHPSVTISGY KCNLCPFVSERQLSVGTHLR YCRGVKEVVKREFACASCSF SSDTFSGLQVHMQRKHIAEW NDQLKEKTEFAWTDRELREL AEKELTTPSFRYNKIFYAAL GTSRTYDAVRKIRYNDRYKS AIAEMRSQIADAAAAAQERD VERGLVSAHSDRGKEMLPVV ETKSDIQVNNDIKKDIELTP NSRQKQTNLALARPAVIEVE EDLGRQDVKQYLASLRQDDY TSPAERSIFAYCREETNWSA TKRQVLKISRTTRGLRQPKK VRPFEFPEGFKPNRNMRKWR KYRFLQECYREKRAETVSKI LDGTFIDEPEEEIRPELEEV QRMYIDRLEKRTQLDTTKIV QTDEVFCLQSYGRITIGEVR DALGASKKDSASGPDGLLLQ DVRRLGPLLLCNIFNMWYLH GIPVEENRCRTILLYKSGDR HLASNYRPVTIGNMLNRLYA KIWDKRIRKNVRLHVRQKAF IPVDGCFENVKTIQCVLQSY RKRKLEHNVVFIDLAKAFDT VLHDSIRKALWRKGVPSGVV KVVDSLYAGAVTSISVGKTK TRSICINSGVKQGCPLSPLL FNLILDELAERIEATGCGLD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LDGHVLSSMAFADDYVLLAK DSVEMNELIRVCSTFFKEKG LSVNPGKCQSLRVLPVKEKK RSMKVLVRPHRWWRIKDQDV DIPSMTYDSLGKYLGVSIDP TGKIALPIEEWKNWMTKLKE CKLKPEQKVKILKEVVCSRV NYVLRMSECGISELRSWTRF VRNWAKNIIHLPTWCSSDWI HSIKGLGIPDVSKGIVIQRM RASEKMSTSEDGIVRVVGAR LVQKNRVLWEKAGFEGIELK AARRHCEVERLNNIGNITNG VALKTIAAVSSVNRYWMIED NLKSGNKILVWKAMAGAIPT KINLSRGVADQTLKKCRRCG LTAETDGHILAGCHTSSDAY SKRHNMLCDKLAKELKLNGG PNRRVWRERTCFTSTGRRYR PDIIVKDDSKITVIDMTCPY EKSEGHLIQCESAKVTKYEP LKLDKYWTRELEGANGIVAE KVELMGLAIGAIGTIMRSTL RKLCELKSGRIVRRLQMIAC NNSAQIIKGHLSRATRRNLR (SEQ ID NO: 1391) |
| R2 | R8Hm-B | . | Hydra vulgaris | CTTGGGGTCACTGACACATT TTTCGGTAGCCATAGTTTTT TGAGAGGAAGAGTGGAAGTT TTTCCATGAGTCGTCTCTCG TATAAACTGTGGTAAATCCG GCCATCCAGCCTCTACGCGG CGCAACTAGAAACTTGGATC AGTGATCAAGGCTAATGGAT GACGGGACTCCATGGATAAG GAGATATAAAGATCTTATTT GAACGCATCTTAAGGGGTTA TGGGGCTAACACCCCCTTAA TTCTGGTGCACATTTATTGA CCGTT (SEQ ID NO: 1147) | ATGCCCGAGGTAGTTGGGAT AATGATGCACAAGCTCGTAA GGCGACTTGCTGCACGTATG CCGCTAAACGCTTAGCTCGA TGAGTGCATGTCAAGACGGT CGGGAGTATGATCAGTGGAG CTGACTTTCCAGACAACTCA CGCGGATTCGCGTGCGGTGG ATACAACACCTGGTATAACA TATGAAGGGTTCCATCTAGT ACAGGGATAACGATCCATGG GAGCAAACTAATTAGTTGGA GGTAATCCAACGCCGCTGTT GAGTCAGTTTTTAACCGCCA GTCAACTCTTGTAGGTTATC GGTCTTCGGCAGACCTTGGA CCGCCTAGCGCCGGCCAACA GTTTGTCGTCGACTAACATG ATGATTTGCGAGAGAAACCC ACGCTTTGTCACTTATGTGA GGATAAAATCTCTTGTCCAT ATGATCCTTTGAAGGGAACA GCGCTTTGAGCTTGCTCGGC GTTGGCACCTTTAGTCTGTA ATATTTTCTTGATATTATGG ACGAAAAAGGTAGTATGGTT GCA (SEQ ID NO:1270) | MSNRITIGDVPSVGKGGLTV NKQTAGADGAEACVVIHPGA KGIWSSPACLRKFTIGKELR AHLAQIHKLAPSAVRYRCNK CPYEGDVQLSVGTHLRYCKG IAGVVEEKKQFACAICNFSS DTFSGLQVHKQRKHVVEWNE QLKEKTEFAWTDRELRELAV KEVTIPFSVVNTETFAVLDI TTRTKDAVRKIRYTDRYKSI LAEVRAQVNAVAEEAPQASD ESQITLLVNTGRGAELQPAV INITDSIELVTDVNEVEMVT SNSTNEEQPINAPVEPAVIE ADLGRQDAKLYLASLRQSDC TNASDRWTLAYCRGEVDWCK TKSRLFKVSRHARGLRQPQR VENWEFPEGFRPNRNLRKWR KYSFLQSCYRTKKKETVSKI LDGTFKDTPEEEIRPELEEV QRVYVDRLEVRTQLDTTRTV HIDERFDLVSYGRITIREVQ DAISASKKDASGGPDGLLLQ DVKKASPRQLCIIFNMWYLH GIPVVENRCRTILLHKGGEK HLTSNYRPVTIGNMLNRVYA KIWDRRIRKNLQLHVRQKAF VPLDGCFENVKTIQCILQSY RRSRREHNVVFVDLAKAFDT ILHDSIEKALLRKGIPRSVI KVVDSLYAGAVTSITVGKTK TRPICINSGVKQGCPLSPLL FNLVIDELAERLEATGCGLD LEGHVISSMAFADDYVLLAK DSVEMNVLMNVCNTFFEEKG LAVNPAKCQSLRVLPVKGKR SMKVLTRTHRWWKINNQDVE IPSMTYESVGKYLGVMIDPA GKIALPIEEWKLWLTRLREC KLKPDQKVKVLKEVVCARAN YVLRMSGCGICELRKWSRFV RGWVKSIIHPPAWCNSEWMH SSKGLGIPDVVSGIVIQRMR AAEKMAKSTDGVVRVVGARI VQTNRVLWKRAGLAGIELDA ARKFCEVKRVNKIGNQTNGG ALKTIAESSVSRHWLLEKNI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | RPGNKILVWKAMAGVIPTKI NLSRGVADQTLKKCRCCGLT AETDCHILAGCPTSRDAYSK RHNLLCDKLAKELRLNGGPS RRVWRERMCLSGNGRRYKPD IVVKDDGVITVIDMACPYEK SERHLSQCEDAKVAKYEPLR LDRSWTQELEGNNGRSANEI SVVGIAVGAIGTITRKTQRI LSKLKLAKVGRPLQIIACNE SAQIIRRHLSGSRLRNLR (SEQ ID NO: 1392) |
| R2 | R9Av | GQ39 8057 | Adineta vaga | GAAATAGTTTGCAATGGTAG GTGTATGGCGCCTCTGTGTC TCTCTTTCGCTGGATATAGT TTGACGATTTTGTACCAGGT ATCTGTTTCTTGTGAGTTCA GCACCAGTTTGAACAGGCTT AGCGATAGACCTTCGAACTT GAAACACTGTTGTGAAGCTG GCTGGGCCCCTGCAGATTTT CTCGATTAGAACGTGAGTGT TACGTCCAGAATGACCCACC AGTGGTTAGTTCTACGTTGC CCTGGAAAGGAGAAAAGTTG AGCTAAAATCGCACGGCCTA GTTGTTTATCAAATAGGCAC GGTGAGGAACTCTTCTATGT ACCCTGACTAAAGTACTCAC TTGTGCGCTGGGTTTGCTCC CCCTCGCATTGACTTATCTG ATCGCACTACCCACCAAACG AAACATAAACTTAGCTCGTG GTATCAGTCCACAGCGTGTG CAGTCGGATTCAGGGGAGCG TGTTAGTGACAAGCAGGATA ATATTAACATAGTTAATGTT AAGGCGTTCAACATTCCTTA TCCAATTGGAAGAGTTGACT GTGAAGTTTGTCATGAAGAC ATTGGACAA (SEQ ID NO: 1148) | ACTAGTCTCCTTCTTCTATT AGTCAGTCTAATTAATTTTT CTTACATTCTACATCTAGTT CCATTATTAAATTGGTATGA TCAGTGCTATCTCTGCTACA CTCAATGCTTAATCGTATGT TATTGACAGTCTGACACTTG ATTACTCTTACGACATATGC ACTGTTTGCTTCAGAGAAAC CACTGTTCATATAGTGAAGT TCCTCAGTTTTCTGTTGATA TATTCTTCTTTCATTCTCGC TTCTCCTTTTCTACTGTGTT CTTTTATCAGTTTTTTGTG GAAAAATTGAGAATAAATAA AGT (SEQ ID NO: 1271) | MNLPIREHAVSVHNINKFNY LCQLCSKSYDTINSVKAHYV ACRRQKNASSTTAVPTNVIN NNQLAINTNQVISRNPLQCV ECLMKQVDFYAKDTKALVTH MRTKHAAAYEESKKVATRRV AWSPDEDQILAELEVKLKKI QKGQLLSRLVVEYNKCADKS KAPSRSKDAIRTRRQQHDYK LLLRSLQSQQPPVGSEDSDS DISSSNNNPLTTTHNVTPTP DSSNVVLLIQKIRESVDSIV KITNLKLNTNMLNAASAFIN QNNNMDPLELSMRGIEEDVK AIRDKELQKPTRNVPSSTTS RKPTRNAKRLEKSKKYGYYQ HLYYNNKKKLVAEILDGETS GAKPPPMNLVEDYYRNIWSR STIDDSPVNNIKTVNSDSIF APISRDEIKLALSNTKKDSA AGPDAVTIKEAKAIIDNLYV AYNIWLGVQGIPEQLKLNKT ILIPKGNSDLSLLKNWRPIT ISSIILRVYNRLLAYRMNKI FKTNDKQVGFKPVNGCGINI SWLHSLLKHARLNKNSIYAC LVDVSKAFDSVSHQSIVRAL TMNGAPSLLVKLIMDQYTNV NTVITCSGSISNKINISSGV KQGDPLSSLLFNLVIDELFD VIKDQYGYTIDNIGTTNARC FADDLTLISSSRMGMNKLLE LTTKFFKERGLNVNPSKCMS IGMSKGYKGKKSKIESEPLF SITDAQIPMLGYIDKTTRYL GVNFTSIGAIDAKRIKKDLQ DTLDKLEHLKLKAQCKMDLL RTYMIPRFMFQLIHTELYPK LLIKMDILIRKLAKRILHLP ISTSSEFFYLPFKEGGLQLT SLKEAVGLAKIKLHKKIMSS NDPMLCYLIESQRSRIVEHF MKDLKLGDSLTLNEMMNNIKE CFMKEKRISFAQKIHGVGFE VFSSSPLTNQWINGEIKTMT TKTYINSIKLRTNTLETRVT TSRGLNIIKTCRRCHVADES LMHVLQCCSSTKGLRYSRHH KICAKVANKLVMNGYGVFRE KSYPDPNNSGSYLRPDIIAV KNGHVIVLDVTVVYEVTGAT FINAYQTKINKYNAIMVQIE QMFNCVNGELHGLVIGSRGS IHHSQLHIWHQMGFSSIELK YVAIGCMEDSLRIMSTFSKA IT (SEQ ID NO: 1393) |
| R2 | R2Ol | LC349 444 | Oryzias latipes | CGCACAGGGGACACAGAGCC TGCCCAAGTACCGCTCCCGA GGGAGCGGGAAACGGGGGGG TGACTATCCCCTGGGGTCCG | GGGGGACAGCTGGGAGTCTC GGCATGATTACAAATCTTGC GCTGCACTCGGATGTCGTCC CCGTGACGGACACATTAATC | MGTDTVYVGQDYPSGLSKRV PARLVAGPMLRERSCHAHVF RAGHMWNWRTSLPSGRWDQP ALEKSRVLTRSVATATDPEI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | GCGAGAGCGCTGGTCTACGG ACCAGGGGTGGCTGTGGGCA GGCTGCTCCTCAGGCCAGTT GATTAGTTACGCATGGGCTG TACCTCCACGTGGTCCCGCT GGTAACGACTTGTCGGCTAA ATCAGCCCGCCCACCATCTG GGATATGGTTGACCGTCTAA CCCCAGTACTCAGGTCACAA ACAAA (SEQ ID NO: 1149) | CGGAAAGCGAGTGGTGACTC GCCTCAAG (SEQ ID NO: 1272) | TSYPGKSVSTSTQVQEEDWC SRESGWISPGLAPEEPSVVS EITASMVATMRVATEEVVLE PQPEQVVTILPEHGRNVPPG LAEQDTASPIEVSVLLPDLA ENCPLCGVPSGGLRLLGKHF AVRHAGVPVTYECRKCAWRS PNSHSISCHVPKCRGRARMP SGDPGIACDLCEARFATEVG VAQHKRHVHPVEWNKVRLER RGARGGGIKATKLWSVAEVE TLIRLIREHGDSGATYQLIA DELGRGKTAEQVRSKKRLLR IDTASNSPDDAEVEEERLES LAVRSSSRSPPSLVATRVRE AVARGESEGGEEIRAIAALI RDVDQNPCLIETSASDIISK LGRRVDGPKRPRPVVREQTQ EKGWVRRLARRKREYREAQY LYSRDQARLAAQILDGAASQ ECALPVDQVYGAFREKWETV GQFHGLGEFRTGARADNWEF YSPILAAEVKENLMRMANGT APGPDRISKKALLDWDPRGE QLARLYTTWLIGGVIPRVFK ECRTKLLPKSSDPVELQDIG GWRPVTIGSMVTRLFSRILT MRLTRACPINPRQRGFLASS SGCAENLLIPDEIVRRSRRD GGPLAVVFVDFARAFDSISH EHILCVLEEGGLDRHVIGLI RNSYVDCVTRVGCVEGMTPP IQMKVGVKQGDPMSPLLFNL AMDDPLIHKLETAGTGLKWGD LSIATLAFADDLVLVSDSEE GMGRSLGILEKFCQLTGLRV QPRKCHGFFMDKGVVNGCGT WEICGSPIHMIPPGESVRYL GVQVGPGRGVMEPDLIPTVH TWIERISEAPLKPSQRMRVL NSFALPRIIYQADLGKVTVT KLAQIDGIVRKAVKKWLHLS PSTCNGLLYSRNRDGGLGLL KLERLIPSVRTKRIYRMSRS PDIWTRRMTSHSVSKSDWEM LWVQAGGERGSAPVMGAVEA APTDVERSPDYPDWRREENL AWSALRVQGVGADQFRGDRT SSSWIAEPASVGFAQRHWLA ALALRAGVYPTREFLARGKE KSGAACRRCPARLESCSHIL GQCPFVQANRIARHNKVCVL LATEAERFGWTVIREFRLED AAGGLKIPDLVCKKADTVLI VDVTVRYEMDGETLKRAASE KVKHYLPVGQQITDKVGGRC FKVMGFPVGARGKWPASNNT VLAELGVPAGRMRTFARLVS RRTLLYSLDILRDFMREPAG RGTRVALIPAATGAAN (SEQ ID NO: 1394) |
| R2 | R2_LP | AF015 814 | Limulus polyphemus | TGGGAGGAGACCCAAACTAT CCTAGGATGGGCGAACCG ACCATATGAGCCATATTAAC ATTGCCCACACTATCCTCTG GAGGTACCTCCTCGTGGTAC GGCTGGATATAGGTAAATCC TGTAACCAAATCCTCCACC CGTGAAGGAGAACACTAAAA CCCATATAGTGGCCTCGCCA ACCACTATATGTCCAACGGC AGGAGAAGCTATCTCCCGGA TGGGAAGGAAAACCCTAAAC | ATTTTGTCTCTTTCCCCAAT GATGTCTACTAGCACGCTGC CGAAGCTAGATAGATTGAGG AATCTGCGTAATCTGTAATG ATTACGCCTCATGGGCATCT ATCGGTAGCGTCGACCCTGA CGTTAAATTGGGTAATAAGA AATATCGA (SEQ ID NO: 1273) | GIDGYMFGYARASGSTVSI QSSSMTEGETNERATPRASD SSSVSIQSSCVTEGECLPPT DNCNPSVENQLPCVTEGRFE RVGSLVTVRLPFRKVACDLC SKEFLTYSKFAVHQANFHNS ETQACCTYCGKSDGNHHSIA CHVPKCPWRRTVTFAANLSN FLCDLCNDSPKTKSGLSQHK RHKHPCSRNAERILSLGVRT PSARPRQVVWSEEETRTLRE VEVVYSGQKNINVLCAGHLP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CGTGATGGGAACTTACCGGC<br>CCCATCAGCTATTGGGTACC<br>CGGTAGGGACTTGCAACCCT<br>ACCCTGTATTTGCATTTTAT<br>AGGGAACCGGTCGGCCCTAT<br>ATCAGAGTAGACCGTTTATT<br>AAATATGGGTGAAAATATTA<br>ACAGTAAAAGCTATGGTTTG<br>GCGTCCGTGTGGTGCCAGGG<br>CGGCGGCCAAACCCGAGCTA<br>CTTGGCACCAACTGGGGATG<br>GTAGCTTCCGAGCGATTCCC<br>TGGCGACGTGGGACCGATCG<br>ACGATGGAGTCCAAACATCC<br>GGAATAGAGGAATTGAGAAA<br>TACCTATTCCACCACCGGCT<br>CACATACCCAAGGTGAACCC<br>GGTGCAACTAGAGTACAACC<br>TATCTGTGGCGGTAGGTGCC<br>GAACCACTCAGGTGACGGGC<br>TTGTTTATTGATGTCTCCCT<br>ACGAGACACGAATTGTGACA<br>AATCCACTCCGGTGGACAAT<br>TACCCGATCTATGAACCTGT<br>TACCGATATTAGACAAGAAA<br>ATAAAGAACTGACAACGCCT<br>AGAGCTTCAGGCAGCATGTC<br>TGTAAGTATCCAGTCATCGA<br>GCGTGACTGAGGGCGAAATT<br>GATAATAACTCTGAAACTGA<br>(SEQ ID NO: 1150) | | GKTSKQVSDKRRDLHRIRSS<br>NVHGTPTTQSRGDPVEQVEE<br>YEELDWEGMHPFPDPDSKFC<br>SYLDQLRDQKGLTEPVWQEI<br>EIVAQEWVENLAHVQSSWNH<br>ERTTKQVPENNTPARRPFKR<br>RLHRVERYKRFQRMYDLQRK<br>RLAEEILDGREAVTCNLKKE<br>EIKDHYDQVYGVSNDRVSLD<br>DCPRPPGANNTDLLKPFTPT<br>EVMDSLQGMKNGAPGPDKIT<br>LPFLQKRLKNGIHVSLANVF<br>NLWQFSGRIPECMKSNRSVL<br>IPKGKSNLRDVRNWRPITIS<br>SIVLRLYTRILARRLERAVQ<br>INPRQRGFVPQAGCRDNIFL<br>LQSAMRRAKRKGTLALGLLD<br>LSKAFDTVGHKHLLTSLERF<br>AVHPHFVRIVEDMYSGCSTS<br>FRVGSQSTRPIVLMRGVKQG<br>DPMSPILFNIALDPLLRQLE<br>EESRGFMFREGQAPVSSLAY<br>ADDMALLAKDHASLQSMLGT<br>VDKFCSGNGLGLNIAKSAGL<br>LIRGANKTFTVNDCPSWLVN<br>GETLPMIGPEQTYRYLGASI<br>CPWTGINSGPVKPTLEKWIA<br>NITESPLKPHQRVDILCKYA<br>LPRLFYQLELGTLNFKELKE<br>LDSMVKQAVKRWCHLPACTA<br>DGLLYSRHRDGGLAVVKLES<br>LVPCLKIKTNLRLVHSTDPV<br>ISSLAESDGLVGAIEGIAQK<br>AGLPIPTPDQRSGTYHSNWR<br>DMERRSWERLALHGQGVELF<br>KGSRSANHWLPRPVGMKPHH<br>WVKCLAMRANVYPTKRGLSR<br>GNLSKNKDSAKCRGCTSMRE<br>TLCHLSGQCPKLKSMRIRRH<br>NKICEHLIAEASFKGWKVLQ<br>EPTLVTDNGERRRPDLIFHR<br>DDKAVVVDVTVRYEISKDTL<br>REAYASKVRRYGCLTEQIKD<br>LTGATSVVPHGFPMGARGAW<br>FPESSDVMADLNIRSKYFEE<br>FLCRRTILYTLDLLWKSNNE<br>QYLERLAP<br>(SEQ ID NO: 1395) |
| NeSL | NeSL-1 | Z82058 | Caenorhabditis elegans | GCTCACTTTCTATCGTGTTA<br>ACCGTACGTTTACACTCCCA<br>GTGAGTGTAATAAAGGTTAT<br>TCGATAGAGGGTGTCTCCCT<br>CTTTCTTGGGTAATTCTTCG<br>GCGGTCCGGGGTCTCTCCCT<br>CGTCTTTTTTTTAAACTTTG<br>CTTTCTCATCCACTCTTTTG<br>CTCCTTTTTACTAACTCTTG<br>TACTCTATAGTCTTTTCTCA<br>TCCCCCATCCGCCGTTGGGC<br>AAAGTTTATTTACTTTGTTA<br>AATCCATATTTTATCTCTCT<br>CACCCGTACAGAAAGCTCT<br>CCTTCTCAAACGCTTTTCTG<br>TACTTTTTCTTATATTTTCA<br>TTAACATATTTTCCTGTTT<br>ATACTAACCTAACCTCCATT<br>GTCAATTACTAACTAACTTG<br>TACAACGGATTTCG<br>(SEQ ID NO: 1151) | CCTCCAGGGCACGCCGCACG<br>CCAAAAGTCCTGGCATAACT<br>CTGCAAATAACATCAAACGT<br>CAATCAACTCCACAAACTCT<br>CCACTCTCTTCAAGTCTTCT<br>CGGTGCTTCCAACACCACAA<br>TGGTGAAAGCTCCTTCACCT<br>TTTCCCTCCAAAATTCTTCC<br>CATGTGGGAAGTCCTGTTC<br>TTGTAAGCTCTCCGGAGGCT<br>GCAAGAGCAGAAGAAATTCT<br>TCTTTCTGACAAGGTCAGAA<br>GGAAGTCCGTTCTTGAGGC<br>GTCCATCCCGGGCGTCATAG<br>GAGAGATCAGATGCACCTTC<br>TAGCAGGAGCTAGAAGGGCT<br>GCCCTGTCTTGAGATCCCCA<br>CGGGGGTCAATAGACGGGAG<br>GGGCTGCTGGCTTTCTCTTT<br>TTAAGAGGAAGCACCAATCC<br>GGAGATCCTTAGGGGTCAAA<br>GGATTAAAAGGCAGCAGGTC<br>CAATTCTCCTCACTGACTTC<br>GGTCAGAGAGGAGTCCCGCC | MLRRKGRHRMVMVNSVKWQP<br>SAHABAIGTGKSWAPQRSQA<br>SEHGWQSNAMFDPPNRILFA<br>RDSWSLNQSTHLQNQRSGSG<br>LGIRPGQVRNNMVGGGPHRA<br>GDPKRRVELVSIQGSEVTVR<br>TIYPSDEIFSCYSKSCDIKT<br>KAGYGPEDLKHLTRHIKNEH<br>GLKARWAYQCGLCNEKSDPS<br>VSEGHKWMEAHMVAVHQSSA<br>EKRIKSYQKCTGARVAEQLQ<br>AAAPSLTVPGKHKSGSRDAA<br>KDSMTPTKDDDPKTRIYQTR<br>SVVKKSTQKTAEPTDEGSRG<br>PKYASIFQKSVKARKSLALL<br>CELSSPKPMNPLPTNELTLK<br>EGNSRELAKEEAPSEGIDDI<br>VIIDLDESEESPPRRKRFNT<br>WCLDHESSREAWLDDTAIFW<br>YISYLCRGSTKYSALDPCLW<br>SMYKVKGSRYILDRLESSIT<br>YFFPICEEDHWTLLVLKDNS<br>YYYANSLHQEPRGPVRDFIN<br>DSKRARKEFKVQVPLQRDSF |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | TTGGAGACCTCCCCGGGGAG GTTGCTGAAGAGGCGGAAGC TCCTTCTAGCAAGAGCTAGA GGGAGTTCCCAGTCCTGAAA CCCTTGCGGTTGATGATGGA ATGGAAGAGTACTTCGGTAC TGCTCGTTGCTCTCTCTGCG TTTTACTGCCGAGGGCCGGA TTTTGCTCGAATCGCGAAAGG TCTCAATCGACCATTCAAGA TGACGGCTTATCTAAGGTCC GAAAGCAGTTGGGAGAGTAA CGTGTTCTCCTACCTTTCAA GTTGAATGGTCGTTTTACTG TTTGGATAGCTGACTTGAT GCTAGTACGCTTCATCTGTG GATGACGCTCCCCAAGCAGT CAAGTAGACTTGAAAGGTGC CCTCGCCCTAGTTAGCTCTT AGACCTTATGGGTCGCCATG GTTGTGGACGGGTATGCTTG CCGGAGCCGAGTCGTGTTTC TTAGAACCAACCTCGACGAG GCGAAAGCTTGCACAAGTTA GCACAATTGTGGTAGGGCCG ACTAGAAAATGAGTCCCTTA GGGGGTTACGCCTTGGCGAA AGTGAGGACAATTGGCATTG ACGGGTGCTTCGGCACTAGG CAAAGGCGCCACCACACTGT CCAATCTCTAAAAAGTTCAC ATTCATCGAAGAACTACCGG AACCAACCACACATGTGTTG AAACCTACACGGTGGAAGGG AAAGGAAAGCTTCGCTGGAA CGAAAAGAACGGATAGGTTC CCCTTCTTGATGGCTGTGAG GCTTAGGATGGACGGGAAGG CCGTGAGGCCTCAGGCGGGT AACTCGGCCAGACGCTAGTT GATCTTCGGATCACGACAGC CCTGGCTAAGAGGAACCCTG GATGGAGTGTGAAGGATGGG CGGGTAGGGGGTTAAGCCTG TTGACAGACCACCGACTGCA GTCACAAAATCAGTGATTAT GCGGGTGGACCAATCTGTTG GCGGGTGTTTCCCTCTACCT GACCCCGCAATATGGTATGT ACGATCCTCGGATCTAAAAT TCATAATGGCCCACCACAAC CATAAACCTCCCTAGCAGCT GGTGGTCCCGATAATTCGGG TTCTTGCCACTACTGCGACC CAGGCTCGCC (SEQ ID NO: 1274) | NCGVHICLMTNSIMAGGKWH SEEDVRNFRKRLKKTLQEEG YELYSVNSLGIPFQAPTTEQ MDYKETRCKRSYASVLTQIS PPAKRPDCKPDNNIFVPTKD CAAEGNPQEKGRNESPEEIN TEHIVVAGKPANNISPRCRS TSEMLFEMVKATTSSGRSSL GTMTQDEFIRTSTIAEAVPL MSIKLPPMELPRKILPPIPP RKPTQTNGGQKGKQQRVPTG KPDTLNAKVRNWENNQLESY AMEGRSFQRLEWLTEVLTAS IQKAAAGDEGIVDIICKRNP PLEVAKGEMCTQTENKRKTT NNAARIADPIQSSKGAGDVK ASYWKERARTYNRIIGSKEE LCKIPIDQLEDFFKKSTSRT NVQESIMKEKSSKIPALKIG NWMEKKFIGKEVAFALRKTK DTAQGADGLRYHHLQWFDPS GELLAKVYNECQRHRKIPKH WKEAETILLFKNGDQSKPEN WRPISLMPVIYKLYSSLWNR RIRAVPNVLSKCQRGFQERE GCNESLAILRTAIDVAKGKR RNLAVAWLDLTNAFGSIPHE LIEYALTAYGFPQMVVDVVK DMYQGASMRVKNATEKSDRI PIMSGVKQGDPISPTLFNIC LETVIRRHLESANGHQCLKT RIKVLAFADDMAILTDSPDQ LQRELSKLDNDCTPLNLIFK PAKCASLVIQKGVVRSASIK LKGNAIRCLDENTTYKYLGV QTGSAARISAMDLLEKVTKE LECVVKSDLTPPQKLDCLKT FTLSKLTYMYGNSIPLITEI KMFANIVIRGVKVMHRIPVR GSPLEYIHLPVKDGGLGVAC PKTTCMITFLVSTLKKLWSD DEYIKTLFTSLAEEVVKKES KKSTVTMDDIADYLNVEERI NRSEFGYNSITRLRDVMRNL AITGDSPLYRLKMVVKNGKI ALLVQATSESMERIYTEEDA KKLQRSLKDQVNKALKHRFN TTKVVKSKVVRVVQQHPASN RFVTKGGNLSLACHRFVHKA RLNLLACNYNNYDKSKSKVC RRCGKDLETQWHILQNCPFG FSKKITERHDAVLHKVKTLI ESGGKKNWTMKIDEELPGFS RLRPDICLKSPDEKQIILAD VACPYEHGVEAMERSWQAKI DKYETGFAHLRKSGTKLTVL PIIIGSLGSWWKPTGDSLKE LGIKGSVINSAIPELCATVL EHSKNTYWNHIFGEAYIPNP MRNGHAKPAGNGWKKERLQK APVRPTN (SEQ ID NO: 1396) |
| CRE | Cn11 | . | *Cryptococcus neoformans* | CCCTCTTAATACCCCATAAC ACATAACAACCCCCTAATCA ACGTTCTCTGCACCTTAAAC ACCACCAAC (SEQ ID NO: 1152) | TGAGGAAGAGGAGGTTGGAT TATTTTTTCTTTTCTTTAAT AAGTTGTTTATTTAAGTAGT TTCTTTCATTCGGGCAACCC ACACGACAACCCAATAAATT AAACAACGAAAAATGCAACC TCTATAACCC (SEQ ID NO: 1275) | MSLQRAKNARGDPGRCNLCS ADYRDLKDHLNKQHSTHFFV PSDLRGSSLVACPRCGTPCS AGTGLSRHQSRYCGLTAPRI RRNRVGNSTNTSRCPPSNTA ASPIVPSPSPERPSPPQPAE VVASLEPLSEAEEVLEVAQV DAETVDTLEGTRRAPESVPR SAEEGSTRVRELNMTAPEEE HRGEEESSHTNPTAPAGLEN AVSSTLGPSPGTLPSLLPSQ |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | ECANERFLYLAHLPVRSKPL PNNLVTDFMDAAERCALAYI AQPSDSTLLAFLALPKVGLT QALAPEQPLRPSTFLKQFPH IPWPEQPPARRPPSNIRPDT TKQVIKLVENGRLGAAERVL EEDASVAELDQGVIDQLITK HPKGPSCPFGNAVGPTPGKA PDIDTIQKALDSFKPDTAPG VSGWSVPLLKTAAKREPVKQ FLQLLCAAIANNTAPGRSML RTSRLIPLKKDDGSIRPIAV GELIYRLCAKALIISHFQPD FLLPFQLGVKSIGGVEPIVR LTERVLEGSAGAEFSFLASL DASNAFNRVDRAEMAAAVKT HAPTLWRTCKWAYGDSSDLV CGDKILQSSQGVRQGDPFGP LFFSITLRPTLNALSQSLGP STQALAYLDDIYLFSNDSQV LSKTTQFLADKQHIIKLNEK KCKLISFDEIRQEGFKMLGT MVGGKEKRAEFLEGRIRKEM AKVGKLKDLPHQHALLLLRF CIQQNLRHLQRSLRSDDLVD LWERLDTMLWEEVKRMRMRQ REDTAEEEALGRSLTKLPAR LGGLGLLSFKDVAPLAYRSA AEASDTLLDNLGLLSSPEEP PTPIPQRTRCAELWESQQEA ILHNLGDTERKRLTENASRL GRSWLSVIPYLQPLRLSNVE IASGLHDRTLVGSSIPVCRF CGSDSPLGHDELCRARNPWT QRRHNAINRVIYQHLKQIQG ATVEIEPHTLSGQRRNDLRV RGSSALAFTDYDLKVYSLGD RDARSTVTPCAPNGKLADFC LDRCVNWLDKVGQVVSKNAP KVTGGVFKPIILSTGGLMSR STADEWKDWRDAMPVGGFEK MEKRIGVELVKARARTLVL (SEQ ID NO: 1397) |
| CRE | CRE-12_CCri | . | Chondrus crispus | ACGCCCCCTATCCATTTCTG CCAGCCTCCCATCGGCTCGC CGTCTCCGCAACCCCTCTTC CTCGGCTGTACCAGTTCCGC TCCCACAACCTCCCTCGCCA CA (SEQ ID NO: 1153) | TAAGTCCTTGACGCCTGCCC CGTGATACAGCATCGGTACC CCTAGCATTTGAATAAAAAA (SEQ ID NO: 1276) | MSQPNISSAETPLSQLPTPV PTPPSPSNPSLSLPTVRDLL LCPIRSSHVYSSIPSSCLHS FTMLLIKTVRAASATMTPTE SHRAFIHLHILPIAVLRRSF RGETGWRSRTGQHHALRQRI RRASSGRHWAALWHEALAAH QVDLDYRTRHSRRYQASATS RHRIGRAMRLAADAQYGRAM SALKAKPLPDLHAAATRDTL TALHPPPASPVQPLSPTDLP PVPEITEGQVLRAARALNPT SAAGPDHLSPRILQLLARTT ISPEAGVTGLSALTNLVRRL ARGDIPDRTAPLLAAATLIP LQPRPHKIRPIAVGQALRRL VTKVLLPPAIQDTRDHLLPE QLANSVASGMDAIVHDTRML MHRHGNPDYIMVSVDARNA FNTFSRQSLLDRLPLQTPSL ARFLNLIYGRTVPDLVLPSS PRFLMKSQEGTQQGDPASML LFSLAIQPLLRRLTRECRLD LNRWYADDGTLVGPISEVIK ALRILRDDGPQSGPHVNINK CRAYWPTVMPEKLSELLRIF PLHVECGEGGVALLGAPLGT DAFVRRHLMNKVQSCHASLS LLDEIPDARTRFHLHRVTGS VCKVEHVFRLTPPHLSLPAA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | TKFDEQQIAAYSRLNDVAVS TSMATQIGLPFRLGGHGFTP LSPFIHASYAASLIEAAPVR VKGPHNPSESFYRRMARRHI VHVLGALNPEVRTRGILGTH SPLGPFEPEALLSRPERVHH TLIQAMQGATSRLYWEHTAW DLDPLPRNHSAASVRRRARY NSLRAPGAASFLCSHPSLTS RVPSAVWSCMLRRHLDTPVY CDSIRPLICSHCCKPMDARG DHAAICRHGFGVVHRHNTVR NLLARHAFRAAGLCCDLEVP SLLPNTANRPADILVQPAPP PSGALPDRPTAYDVTVRSPY CRSTMSLAAKGLAGAAEEAD LDKLRVHSRTVRDAFHLQPD SPLPLLDWHFVPLAFDTLGA TSSRTMAVLEYLAHRIANRT YSSYGTAKIRLLQRISFAVW SSLASATLSRMPYHGAALSS PAQV (SEQ ID NO: 1398) |
| CRE | CRE-13_CCri | . | Chondrus crispus | CNCCAGCCAMCGATCCCGCC GCCACTCGCMGCCCGGCCGT CTCGACCGCCACCTCCCCGA SGCCCCAGCCCATC (SEQ ID NO: 1154) | TAATTCACCTTCATATCTGC TAGTGTCTCTGTAAGCGCAC CCCTCATGCATTGATAAAAT TACCCCCA (SEQ ID NO: 1277) | MAXXPXISPPGAPPAPLRYR MLQCPPPLPKXXXXPVPHPM SSPIRXRLPHRXMRGPPSXT PPRDMHRPHGTPGPHSHRXC GRPPXHCTHASXQPRXAXHX LQXPKLRSPPPHPHVSPLIL CXGPLPTPMTQPRMKRALSX SAKAPPTKRPSASQGPAASS HDXPRTPPPXPPRPPPYRFP PPTLDQHXFALSXAYPHPXP RRPPSPXRXLRHSFPPRFGX QTFSSIPGPRLHSTVLLLIR LVRAATAANTPETTTLXSCT FTCSRLPFFERPSAXLAGG PRAVNFMLSACXYGERVXDE SGXSYXXKXHCITSHPPRPR RYSRQHSRNHHTXFLHLHLL PTAXLREAFRGEXGWRSSRG QLHALRLXIRRACTGREWGL LXXEALDAHSXRTEWQHTHA RRPSPPVSPSARAARAMRLA SQAQYGRAMRTFTNPPLADL NDPATMERLQALHPTPTVPV VPLPPSAQPRPPEVTXEAVX RAVRRLNPNSAAGPDRMSPK LLHLLAHTPISPEAGVTGLS ALTNLVSRLARGSLPPCTIP LASAATLLPLQPRPGKIRPI AIGQALRRLVTKXLLPAAID DCRDHLAPEQXANGIPNGID AIVHDARMLVRRHGNDPHYX MVSIDASNAFNNFSRQQVLD QLPTRAPSLSRYLDMVYARA PSPLVLPSXPPTILHSRXGS QQGDPASMLLFSLALQPLTR LISRECXLXMNRWYADDGTI IGRIDEVXKALDIITKEGPR FQFFLNPSKTRVFWPSRQXD LLSPLMTVGPLRVIDEGGVX LLGAPIGSPSXMAQYIREXL NTCKTALAHLDHIPEARMRF HLHRVSASACRLQHLFRLVP PDFAXPFAQQFDRDQLXAYX RFNSVTMSPRIVPKYGCXFX TXATASPHWHLPYTPXTLLA SSIPLQHGYKVPTFPPSLSI SVLHEARCGSFFEIYLHSXN PHTSRCDYVAKNRAQIRLXF SHGGHGLTSLASTIHASYAA SLIDTAPARLQGPHFPAVSQ |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | YQRFARGPLRVVLRNLPSFV QPAHFSMTEXDLGCLEPXAL LARPERIHTFLLQAQYSAAA SSYWQXPLWESFPNPGDHSA ASLRKRVRYNSLLAPGATSF LTAHPAATSRVHNATWSTML RRHLDAPVTNDSISPLRCXH CSKPMDARGDHAXIXSHGFG TLHRHNTVRNVLARQLFRVA GLAYSLEVPFLIPNTAARPA DILVQPPPPAPGLPPDXPTA YDVTICSPFRRGMLYHAARH RGGAADAASVRKXKALERTI RXALLIEDDNXPPPLDWHFQ PLSFDALGAPSQSTVHVIED HAKLMALRNSCTIATAKSRI QQRLSFAIWSSAAAAILSRL PTHAADISYPIEV (SEQ ID NO: 1399) |
| CRE | CRE-1_ACas | . | Acanthamoeba castellanii | TAACCCTAACCCTCTCCCTC GGCCCCTCTACCCTAAAGCG CCCTAATCGACCGGCGACGC CCTAATCGCTACCCTCTACG CCCTAATCGACTTTGGCGCC AAAGCGACTTTCCCCGGCCG ATTTTCTTCCTGCCTTTTTC TTTTCTCTCCAAGCGACGTG CCTTTTACTTTGCCGCCGTT CTGTTTTTTCTTTTCTCTTT GCACTTCGCTTCTACTTCAC ACCTCCTCCTCCTCCTTCTC GACCCGCGCGGCCTCGAGCG ACTTGCTGCAGCGGCTCCCG GCCTCCCCCACGCGGCCTGC TACTCCCGCTTTCTAGACGC CCCCGGTCTTGCTCTCAGTC TCCCGCATCGAAGCGGTAGT CGGGGTACGTGCTCAAGTGA CTCAAGCCTCTTTTCAGCCT CGGCGCTCTCTCAATCCGCC TCAGTCTTAGCCTTTCAAGT TGCTCGATTACGCTCTCGAA TCGCTCTCTCTCTCAGTCTC AGTCTCAGTCTCAATCTCGA TCTTGCCTTCGCCTTCGTCT CGACGCCTTGCTCTCGWAAT CGCTGCCACTACGTGCCAGC TTTTTCGTGCCTTGTCTTCG TGTCGACCCGGACCGTTTGC AAGCCCTCGCCTTCGTACCC CGCTCTCGTAGCCGTTCTCA TCGCTGAAGCGTTCTACGCG CTGGCAGCAAGCCTCGGCCC TAGCTTGTAGCGCCGCCGGT GGCCGCTCGCCAAC (SEQ ID NO: 1155) | TAAGCCGCGCGACGAGGACG GCCAGGACGACCAGGACGAC GGGCGACGGCGACCACCTAGC ACCGCACGCGCCACGACATA TTGTCGCGCGCTGTACAGGC GGCTAGGTCGAGCCCAGCCG ACCGTTCTGAGCCTCAGTCG GCTTGAGCCCCCGGCTTCCC AAGGCCTACCGGGCGGCTC TTTTTCGCCCTGGTTTTTGC CGGCCTGTTTTTTCTCTCCC CCTTTTCCCCCCTTTTCCAT TTGTACTTAGTTTTTCCTTC GGCCGCGGCAGCTTGTTGCC CGGCATAGTGTTAATATGTT TAAAAAACGTGTAAATAAAT AACTGTTTAACCCTAACCCT AACCCTAA (SEQ ID NO: 1278) | MATTTISRSPSSSSSSSSAR SRASASTSASVASIPRLFRD GRFHCPLAHCQTRTSTWQDL SAHLTRMHDGDVPRDVAAAC GIVQCLHEGCRKWFRGAAGL ASHRGKARHAPPPAPRAALA VAAVPRADSRGRTPAPTPSV APPXAGPPPRAAPRAAPSPL PCPPALPHPPPSASPPTSSV TSPCSPPTTPPSQPSPDLFS GFANAPTTPSPPSTPXSSPA GSPIPAARRFVLPVATPYPA PAPRANRPKLSPVARPFVPK ARAGAIPEASSPVTPQDRAV SRREDAAAAPSSAPGLGLAD EHEDDDTYGGDTIALTAPHA PRETRAPFEFEACFLEEEAP ATAGDLPPYARAFLACPSAR LQEIPRRLKSAWQAAAKTIA EAALDCHTAGDTQGYNAHLR LFIELPARGLAVPTNCRGAA RTKLQRERLLDIAAGRIPAI PDPPCDAPGADDALRGFPVS GTTAGDVSNDDDSGGVHDRP AATASARQAKRLVEQGLSSR ALRALERGEPAVASADTLGR LEALHPPNPTDRGLWPGAPK AAIPRVTAKHLAQVAKELPR GSAPGPSGWTFELVQAAIDR QPTGTVAAFLIDMAQRALRG TLHWRGLLTASRLVALKKPD GGVRPIAVGEALYRVIGRLV LKADRVMSSADATQYVGRHQ YGVAYPGGVEAPVHAVRELH DSGQLRAVVSLDWRNAFNSL DRVHTALLIADRAPALARLY EWSYREDSVLVLPRAFEKAG LPASLLSQAGVRQGDVLGPL FFAIGAAPVLDEIDAIPYVT PRAYLDDIFVTIPHGVTDAA TKAAVAATFATAEREGAAAG LRLNRCKSAVWAADAEALLP PHAAGAREDVESCAPVREGL KILGAPVGSPAFVAKSLDGI IKRAIGTLDLVADAELPLQH KLVLLRQCVAQIPTFWARAV PDAGPALAVWDTALLRRTGA LVGLDVRDGSLQADIARLPV RLGGGLGLRSMKDTAPRAFVA SILFAAALANTRRSELTCSA STARRLRAALPELARTDACN DEAAWRRSIARGVFPDVDKL GTTQLQRVLQGMADSKSAHR TRRQVPFLFAAVFEDAATPG |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | SGAWLAAIPSDPTLVLPDAE LAEAVRIKLLTTTANAAGVC PACHKTGIDPSHAYTCVSLS HLRTARHDVVVRRVELACKT EKPVREHVLAIPPVAPTDNN NNGDEDGSPVTTADDNADGH AVATKRRPETRASARAAAAA ATAAAAAAIINDNSLLSDDD DDDDHDDNCHGEERGEGERN VTCPGHYTATPFAADDTLDN SDEDNEDNAHEDDDEDGKDD NDDDVYNNCNSSSSDGDEGG DDLDYEYSDQSVTRSVDAAT GESPNPERPTTPTRALLRAD LWLPATSTAVDVMVAAACRR SRAKAFDRAVSRKAAKYGPA VADGSIAKVVPFVVSPFGVL SRPAKAFLKRAMGDTTAAKQ AKARLRLAVAAVRGTARLSY AWGACAALIVGGN (SEQ ID NO: 1400) |
| CRE | Cre-1_FCy | . | *Fragilariopsis cylindrus* | ATCAATCTAATACTGAAGGC AATACCAAACTCAACCCGAA ATCAAAATCGTTAGAATCAA TATACGACCCCCGCTGCTGT ACATGTCCAGCCGGATCTCG TTGTAAAGAAGATTGCAGCT GTAAAAAAGTTGGACTTCTT TGTTCTTCCTGTGAAGAAGT TGATTGTGGCTGTTCAAATT CTTTTCATAATAAAGAATTA (SEQ IDNO: 1156) | TAGCACCACCATCTATTCAT ATCCACACACTGACCACCTC CACCTTCACAACTCCACTCT CAATTCCCCTGACTACTAAG AAATATTTCATGGTGGTTAC ATTGGAGGTATCCCAACACC AAGCACAAAATGAACCCACT AACCCTCTCATCCTATCCAC GGGGACCACCTTTGAGCAGA ACACCATTACATATTACAACC TTTAGCTAGATTAAGATAAT TATTTAGTACATATTTTATA CTATTAAAAAAAAAAAAAA A (SEQ ID NO:1279) | MAPLPWNAATSSPPSPVPLT NDKKKDSTLPTATSKNLSKN NNNKNNNTNRINNIKNNDNT NDGSNKINLKLPPAAVKITN PYKNKKKNKKKNNAGKSNPK TNQNPNSSPLSDNDDDDTDS SNITINRRLKFGTDDLAPPN PPSNTNTIGTATAATAATAT TTATAATATTATNTTTTTTT TNNTTGDNLASNINNNNNNN NSGSNNSNTNNINNTDGNGS NNRPPPRVYTVDPRSDLPGA EISAANKMLDEVYGDHVHDN PGSHLSGLISSSQDQLWQGY FRRLIPHNQSLYDCPKGKLG KDITNEYSNLFEAIMNGKCN MEKLLVFPVVVLQRRHGVTK NADVKRRLLSRLTAWKEGKF KYLVEDTHRDLIAKQSKARG DTTPAHRAKVYSSKLMRGHL QSAVNYITDREGGGILYPYD VDEKSGHTVSRVLQDKHPSM RDPGPTAMPAYESVPELPTL EITADTVEIVAGKLSGGAGL SGVDSIQLKHLLLHHGQASQ RLRNVCAKFGRWLANEHPPW ASYRAMLANRLIALDKMPGI RPVGIGDTWRRFFAKLVLAV SMSYATDCCGSDQLCAGLRA GVDGAIHGLSAMWREMESEE NTGFVLIDADNAFNEVSRIN MLWTIRHEWPAGARFAFNCY RHHSLLVVRNPGGKPFTFFS KEGVTQGDPFAMIAYGVALL PLIRKLKELNVLLVQSWYAD DASAAGKFDEILRLFQDLLR MGPDFGYFPNASKSILITHP DNVVAAHHFFNETHGLGFKI STGSRFLGGFIGDTTSRDEY VSTKIADWIHGTKELAAVAR LKYPHAAYTGITKCLQHKWS FTQRVIPGIDDLFQPLEDEL TNNLLPALFGDPPSTMDDKL RLLTALPVKHAGLALPNPVT SSATNYKNSTLMSSHLLLAV QGKINFSLQDHRDTCQSSLS ASRELRQTENDSSLTNLLAA LPPAAAGQPSTTRAIKRAGE TGLWLTTIPNHINGNILGCD EFIDAIRLRYQKVPHNLPAK CDGCGSAFDVGHALQCKSGG LIIRRHDELNLELASLAKMA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LRESAIRAEPEINPSASIMD SPTTITAIDTNGDRGDLLIK GFWDNGMDAIIDVRITDTDA KSYRTRDPKKVLQSQEKEKK KKYLDQCLLQRRAFTPFVVS VDGLIGYEASNVLKQLSKRL ADKWNKPYSVTCGIVRSRIS IACARASNQCLRGSRIPFKT MSRQIQWEDGAGAGLYRIVR (SEQ ID NO: 1401) |
| CRE | Cre-1_HM | . | Hydra vulgaris | TTTCTAATGTTACGTGATAT GATATGGTTAGTTCATGGTT AGTTTATGTTTATGCTTAGT TTATGGAAAATCGTTTATTT ATGGCACAATATTGTTTGCT GTTTTTAAATTTATGTAACG TGTGCATTTGATGTATATTC TTGAACTTTTTAATCTGAAT TTTTACTTGGTTTAATACGT TTATTATATTCTTCGATTGA GCAATTTATCCTATCAAAGC AATTTATCCTTCGATTCGAG CAATTTATCCTTCGATTCGA GCAATTTATCCTTCGATTGA GCAATTTATCCTATCAAAAT TAGCATATATACTGCAATTT TCAAATAATCTACGAAATAA GTTCACTTACTGAAAATCAT TAAGTAAAAGAAGAAAGGAA GAAAAAATAAAAATAAAAAG TAGTAAATCCTTTCATAACA ATAATCATTCTATTATTAAA TTTAAAGGAATATTTTGGTT TTGTACTAAATCATGCGTTC ATATTTCACCGAAGAAGGGG GCTGCTATATTTTGTTTGA AGTTGTTTATCTTAAAACTT TAAACTTGTGTTCAACCAAC CGTAAACATTAGTTCGCTGT TCGCTCAAATTATCTACAAT ATAAAATTTATCAATCTTTI TTCGTTACGGTAAACAATAA ACAATAAAATAACTATAGTT ATTTTATTGTTTACCGCATA TTGTTTAACTATAGTTAAAC AAAGTATTTGTTATGGAAC ATTACCAGTATCTCTTGTTA AGGTAAACAACAAAACATAG ACGGCATCTCTTTTTAAGGT AATTAAGTATACGGCTAATA ATAAAAATATACAGCTAATA ATAAAATCTTCA (SEQ ID NO: 1157) | TAACTTGTATTTTTAAATTG TTTTATTAGTTT (SEQ ID NO: 1280) | MNMVSICKRCDRSFTTLKGL NIHKGQCKIFVSNTNKQINN VVNNELTTPNKNKVEINTIL NCDEISVEHYSTNTPYLPKI NICESIIDPNDYLWGHMPFS FLLNHVNTIYDEIVFYHKNL FKVPSGKGGKMFIEELTFWL KQFNNRTKLNGIAMKCFMIV PSLMLQKPSIRSKAKEHAEC LVRRITLWRNGNFSELMREI RYIQSKINTSKKKRTFEDIS RIFAKLMMEGKVAAALKVLD RESSGILQCSESVLKELKSK HPDETPVQDNCLLYGPLQNT PECLFDSIDEISIFNSALQT KGSAGPSGMDADLYRRVLCS KCFGPSCKTLREEIATFTKN IATKSYQPDIVQPYIACRLI PLDKNPGIRPIGIGEVLRRI VGKTISHHCQKEIKEAAGPL QTCAGHGAGAEAAIHAMQKI FHQEDTDGVLLIDARNAFNC LNRSVALHNIQITCPILAMY LVNTYRKPAKLFIYGGETIF SKEGTTQGDPLAMPWYSLST VTIINTLKLVIPDVKQVWLA DDATAAGKLQSLKKWYKCLE DVGGLYGYYVNQSKCWLIVK SDNQAEEAKLIFGNSINITT QGKRHLGAALGSEAYKKVYC EDLVSKWSKELNNLCEIATT QPQAAYSAFIKGYRSKFTYF LRTIEAFENPVTPVEKILSE KLLPVLFGTDCSIIKENRDL LALNPSEGGLGICNLITEAK EQHTASKKITNLHIKSILDQ SDVMKEKDDFGKTFSEIKTK TNMDKSKKKKEEVKKIHAGL PENLKLLVEQACDKGASSWL NTLPIKEQHLDLNKEEFKDA LRLRYNVPLANLPSYCACGE KFDELHAMSCKKGGFVCNRH DNIRDLLTVCLNKVCTDVQA EPHLIPLTNEKFNFKTANTN DEARLDIKAKGFWRKGETAF FDVRVTHVNSKSSKKQPTKH IFRRHEDAKKREYLERVLEV EHGTFTPLIFGTNGGFGDEC KRFTALLAQKLSLKMGERYG AVINWLRTRLSMEITRASLL CLRGSRTPFRHYNTDDVGLE NVQCGLI (SEQ ID NO: 1402) |
| CRE | CRE-1_LSa | . | Lactuca sativa | ACATTAAATTAGAGAGGTTG ATGTTTCAATGGAAGAAGAT GAAATTCCAAGAAGCTATTT TTGTTGCCCACCAAGTGTTT GATAAAATGTCCAAACTAAT TTTTCTCTTGTTGCAGCTTT ATTGTTCAAGATAATGTAGT TTGCTTAGTTTGAGCGTTCC TTGTGCACACCAACAGTGTG | TGAACTATATTTTATATATT AAAAAAA (SEQ ID NO: 1281) | MASSSTSSSDICLCPFRSFH CCPNGEVGSKGIXRMISHIK RHHLLTEDRKCVLREALSSD VGLFMAVEETLKAFGQWMCG KCMTLHALSRYCHHPDGRVX FVTGADGSSRYIVGILKPST KESVTNALGGLVFDVGLLDR VFKEPITTVKSIPHSCRLAF SQALKTALYKVIAQPGSVDA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TTGGTGTGCCATTTCCTTTC CTTCCTTTTTAACTATTGCT TCATAGCTTAAGCTTCATCT CGAGGCTTGTTCTCTTGT (SEQ ID NO: 1158) | | WICLLLLPRCTLQVFRPKNR QECRSGNRKSLQQSSILKSL DTWGKEDGIRKLVQNMLDNP EVGAMGQGGGILQKESTSSN TNIRQCLRKVADGHFTAAVK VLCSSGVAPYNGDTIKALED KHPFRPPPSMPSPIISEPPL VADFDCVFGCIKSFPKGTSC GRDGLRAQHXLDALCGEGSA IATDLIRAITSVVNLWLAGR CPTILAEFVASAPLTPLIKP DNGIRPIAVGTIWRRLVSKV AMKGVGKEMAKYLNDFQFGV GVSGGAEVVLHSANRVLSEH HADGSLAMLTVDFSNAFNLV DRSALLHEVKRMCPSISLWV NFLYGQAARLYIGDQHIWSA TGVQQGDPLGPLLFALVLHP LVHKIRDNCKLLLHAWYLDD GTVIGDSEEVARVLNIIRVN GPGLGLELNIKKTEIFWPSC DGRKLRADLFPTDIGRPSLG VKLLGGAVSRDAGFISGLAM KRAVNAVDLMGLLPQLCDPQ SELLLLRSCMGIAKLFFGLR TCQPVHIEEAALFFDKGLRR SIEDMVVCGGPFFGDIQWRL ASLPIRFGGLGLYSAYEVSS YAFVASRAQSWALQDHILRD SGICGMDSDYLCAMTRLRDT IPGFDCSGFTNKDTPPKSQK ALACALFSKIVKDMEVDFDM TVRQKAVFECLRAPHAQDFL LTIPIDGLGQHMSPVEYRTI LRYRLMIPLFPIDEICPVCR KACLDTFGEHAVHCRELPGF KYRHDVVRDVLFDACRRAGI SAKKEAPVNFLTDPQDGRST LRPADILVFGWVGGKHACVD LTGVSPLVGLRSGGFTAGHA ALKAAACKVAKHENACIENQ HVFVPPFAFDTFGFLAPEAVE LLNRVQRVMHSNVISPRSTD VVFKRISFAIQKGLAAQLVA RLPSIDMY (SEQ ID NO: 1403) |
| CRE | Cre-1_MB | . | Monosiga brevicollis | CATCTTGGCGTGAACCACGT TGTCAGACAAAATCTGCAAC CCCGCTCTTTGCGGCCCGCG TTTTGGCGGCGCCCTCGCTC CCACCGTGTCCGCTCGCTTG CTCGCTTGCTTGCCCCGCGG AC (SEQ ID NO: 1159) | TAGGTAGGCACCGTCTCGGG GGTCCCTCTGTGGGGATCCC TGTGTGCACCTGTCGCTCCC TAGGTGGTTCCTCGTTGTGT CTTTTGATGGCTTGACTTGT ATTTTTGTTTTAATTTTGCT TTAATTTTTGCTGTATTTGT GTGGTATTTTGCTGAATTT TTGTAAGGTCCTTTGTATGA TGTCTTTGTCTTCTGTGGTC GGTTGTTTTCCTCAATCCGA CGTTGTGTCTCGTTGGATGT GAGCGTGCCGTGGTGTTCTT TGTGTTTGTGCTGTGATGGC TTGTAGTTGTGATGTGTGAC TGCCTTTTTGGGTGTCTTGT GTTTGAAATGGCCGTATCTC TGGTTATACTTGGTCGTTTT GTACGATTTTGTTTCTATG TGCGTGATTCTTCGCGCTTG TACTTCTTGGCATGATAGAA GCCAATGAATGTGTCTTGTT | MATESGGEDSWTQVRGAKRP SAESPPSNTTTSPSQTHRSA KHTKHGSARHDRNHVFPDPM TTPLRPHARHSVPTARASSH VPSTSPAAGATESSARAVVP AAEPVTRTSNGGGEQHPIIG NTSNASPRTPRTPSSPRSFA QVAAAMPAAATATSSAPMTE DLSASVPSEPNGSGEQQPSP ESTGQTHHSIPNTPSDFLTM SSDESDSPPRSTALRAPTPI APPAHDGDGDTNGSATPEPL VQSPTPAQMVLPYPSGTQQT HSDPSPPSASPPATTILPAA ISHPVEHSEHANSAPLGEVS ESETHNTAGEHSESEQDVLL SDPAPPIAANVLDAQRKVLL KTSGHRQLLACPFGLCKCKG PRLDRKAWVNHVLREHPYDE QATDLVKQVMEAKLVAQCNK CHLFFEAAGISQHRSRCGAN LKRATEALFHAAGHDLLEIM |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | CTCTTGTGTTGTTTTGCGTG CCGTCGTGATTTTGATGTCG GGGTTGCACAGCTTTGCTTT CAGCTCTGAGGTTCAAACAC CTAATTTA (SEQ ID NO: 1282) | RGAWPQQCVGSRISVCELLK LARHPLMQRSYPSNATETK LMAATLSQLYWSAVHSDYTA EEREMCWALILALPSMLLSA PSTALSTIDLRNMFHDRLRW LVTGQLGRVVDAMRKAVARK QSRRGQLNAGAGAHPNDAVD QSLRSLVRDPDLADEAWANH VTNRLNRGQIAKAFDADKAR AVIGNSEVQAVRDLLVPPGL TPYIASTPASTSTLAPATAV SSPTVSFTKGELPKALAATK GVTDPYGWSGELLASIYRIK EHFSQVLGPRQGSTSDPTAP SDGDAPQGPTTATGGPQVAL NKIFHHIANNTVPESIRHAL CSINYTILEKANGKFRPVGT DSIFNKVVNRALLEQQQPHI AHLLQASPELAVGVKDGISA AVGMAFGELQACESTPGWTM LSLDFKSAFNYTDRARLHEI VADKVPGLLRAFERHYARPT THCIVDKFFKVIDIDVGQGI VQGNELSPFFFALYSCEVLG LLDATTDYRCKVIKYLDDIV LMGPAEDVAADVEIVKARAE SAGLHLQPSKSRFYMPRHHS ASITAIKSVLPDAVRETANT GMTVLGTPIGRREWMKKQLN DKAKHIAGKLNDMLTTGVSL QALLTAMQYVPSLINHLYTL PPSLTSGLSELLNRACKDTF VKAFFAKVNLSAPAGAEGHD VTLEQLLEARLFTRANTGGF GLHDLVERGPVAYVCNMAKL ATRYPRVYDRLLEDASRAAD FEAHVORAGFQMATVKDAAT QRPAEIIALRSKAALDDLMA KCALDLQQAYLASREWGVST VLTMRGRDKLRRLSDTTFAI AVVSMMGFGLHELINVKPTD KCPLCSSKTPQPRLTREHLL TCRPIKRHNALRDEMGRLLR YATLSHWVEKSGYNANGQS CRIDLHCRNPFPGGALGPAL PDLGIDVTVRTAQPPTTSQA CIKVGAALRRAEKEKRDYYT GFNHGKTLIVPAAMTTTGGF ASSFVDLLGQLARCAEARGV YQPGLDEAFVPRWKGRFAAL VHQMNADHIQRHFGGVCLRS S (SEQ ID NO: 1404) |
| CRE | CRE-2_HMa | . | Hydra vulgaris | AATTTAAAAAAAAAAAATCG TTTATTTATGGCATAATACT GTTTGTAATTTTTGAAAATT CGTGCAACAACTGCAGTTAA ATTGAAGAGCTGAAATTTAA GATCTGAGCTTTTCAATCAG AGTTTTTTACCCTAAAACAT TAAATTTTATCATAACAAAA ATCGTTCTAATATTATTAAA CTTAAAGAAATTCGTTCTTA TATCAAATCTTATTTCAGTG TTTCACAGACGAAGGGTTTT ACTAGATTTTTATTTTTTCA ACTTTTGAATTTGTTTATTA TAAAACTGTAAACTAGTGTG CAACCAACCGTAAAAAWTAG TTAGCTGTTCACCCAAAATA TTATTCAGTATGAAAATATT TAATCTTCTTATTCGCAGT AAACAATAAAATATCTAGTT | TGAGCTCTTATAAATTTATA TTATAGCATTTTGTTTTA (SEQ ID NO: 1283) | MSSCKVTIPHVCPYCKVELK TICGINRHILKCKKNPLQIP SLQKTNTSLTLEPNTKVIPS ITKQNDIIASTSSNNLAFN QKKDYTLTPTYSRKTTPVSI LSSMKMTPISITSHIVRRKL PELPSQTTNHLFNENFINVP FLPEIMNHLPVPNNNVMWGV YSYQQFKLFVDSTYDEIVNY RRNIFNIPSGKAGKEFIEEL TFWLRKFNSTSSLNSIALKV TMILPNLLLQKPSAKSKSKE HTLCLTRRIDLWKKGDTSLL LKEVRNIQKKFVNSKXKRSM DDISRIFAKLIMEGKITAAL KFLEKEASSGILPLSDNTLK DLKSKHPEPSRVEDYSLLFG PIDLIPKCFFDCIDEQLVMK AAFATKGSAGPSGMDADIYR RILCSKNFIKEGKELRKEIA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | AAACAAAATATTTCTTAATA ATAAAAAACAAAAACTTTTT CTTAACAAGTACA (SEQ ID NO: 1160) | | KMTQNLLTETYEPTFLEAFT ACRLIPLDKNPGIRPIGVGE VLRRIIGKVISWSFNSEIKE AAGPLQTCAGHGAGAEAAVH AMKEIFDNVQTDAILLIDAK NAFNCMNRQVALHNIQIICP LISIYLINTYRNPSRLFVAG GKEISSQEGTTQGDPLAMPW YSCNTTIIIEHLLVNYPQVK QVWLADDAAASGSIANLHSW YQHLIDEGCKHGYYVNQSKC WLIVKSPSLAENAGIVFGKS VNITTEGQRHLGSVIGSQNF KNKYCTEKVAKWLTELKQLC KVAETQPQAAFIAFTKGFRS KFTYFLRTIPKFEQYLAPVD EILSHLLLPTLFGKDTPFED HIRKLFTLTPRDGGLGIPIL VEEAPHQFLSSVKLTKNLVQ QIIDQDKILKTKNSSGNVLE DLEKILTTDRLKHRKEKIIA VDSMQPDSMLRNIQQTRSEC ASTWLNALPLENQGFVLNKE EFRDALCLRYNFDLKNIPRI CECGEPFNVTHALSCKKGGF ISSRHDNIRNLFTTLLKRVC INVQSEPHLIPLDNENFYFH TANKSNQARLDIKANGFWRN GQTAFFDVRVTHVNSMSNKN LDIAAIFRKHEKEKKREYGE RVREVEHGSLTPLVFGTNGG MGKECHRFVRRLAEKLAEKQ NEKYSVVMTWLRTKLSFEIL RSTILCLRGSRTPWTKKNDF EIGVDFKMDALEARI (SEQ ID NO: 1405) |
| CRE | MoTe R1 | JQ747 487 | Magnaporthe oryzae | CCCGAACCCGAACCCAAACC CAAACCCAAACCCAAACCCA AACCCAAACCCAAACCCAAA CCCGGAGGGTTCCCAAGTCG CCTAAACCCGAAGGGTTTAG GATATTATTTCGTTATTAG AATTGGATAATTATTTACCC CTGTTGGACAGGGGGGTTGC AGGGGTTAAATTAAGGTTTT TTATTATTTATGCGCCGTTT ATTTGTTTACCCCCCCAAAT ATTATAAAAGCGCGTTCCAT CCTCTTAGGAAAAGCGAAGC TTTTCCTTGTAAAAGTCGCT AGACTTTTACTATAAAAGTC GCTAGACTTTTATACCAATC TTTTAACAAAAAGCGTAGCT TTTTGTTGCCAATCTATTAA AAAAAGCGGAGCTTTTTTTA ACTTTTTCTTTTTTTTTTTT TTTTCTTTTTTTTTTTTTTT TTTCTTTTTTTTTTTTTTTT TTTTTATATATATTATTAT TATTATTATTAGCGGTGGG CTATTTATGCGCTTTAATTT GTGCGGGCTATTTATGCGC TTTAATTTGTGCGGGCTAT TAATGCGCTTTAACTTTACA AATTTTATTTATGCGCTTTA ATTGCTGCGGGCCTGTTAAT GCGCTTTAATTTACAAATTT CATTAATGCGCTTTAACTTT TATATTTACTAATGCGTTAT TTATATAATTGCTATTATTA TCGTTGCTATTATTATTATT GCTATTATTATCGTTATTAT TATTGCAATTTTATTATATA | TAATAGGTAACGTCCCTATT TTTGTCTTTGGTTTTGTTTT TATCTTTGTTTTTGTTTTTG TTTTCGTTTTTGTTTTTGTT TTCGTTTTTGTTTTTTTTTT CCTTTGTTTTTGTTTTTATC TTTATTTTTGTTTTTGTTTT TACTTTGTTTTATTTGTTTT ATATTTACCTTTTGATTTTT TCTATTTTTCCCACCCTTAT TATTATAACCCCAACCTACT AATATTTTTCTTTTTTCTT TTTTCTTTTTACGGTTTTAT TTTCCCGTTTGTTTTTCTA TTTTATTTGTACGACAAAAC CCTTAGCAAATAAGCTTAGA ATATAATAAAGCGCGAATTA AAA (SEQ ID NO: 1284) | MVCPTCNGVYADYNDHIRKK HPDERYTALQLQPLGLTPCP ICKTACKNDLGVKTHLSKIH KISGASKISTQPRIRTENTD NTNSVPTSSFNPVLPEIQTL TPGLNNSRWADNPRKRRADT PSPTRGRNTRPRRFSYTDID LTNDEPADNPRANNPRVNNP RVNNEPPSSPNSLPSISEPH TPGTLPLTNSNISLKDQHDK ITGPILQKPLIQKLIEYSKI PIPEHHLHARQAKIFADAAN RIAKNFIQSPTEKTLFNLLI LPRIFGIGLINGKVTKIMQN FPSQIPPIPKIDFPSEKTDS DPVLNAKKLLEKGYIGRAAK AIIDPTPVAPETPESLNILR EKHPIGQNNPFNTKSQPISG RQITEKAILLAISSIGREKA PGLSGWTRSLLDAAIKIPTQ NDVIPALRLLTDMIRQGTAP GRELLCASRLIGLSKPDGGV RPIAVGDLLYKIAFKAILNT LWSPNCLLPYQLGVNSIGGV EPAIFTLEEAIMGPNINGIK SITSLDLKNAFNSVSRAAIA SSVAKYAPTFYRSTCWAYNQ PSILITENGSVLASAQGIRQ GDPLGPLLFSLAFRPTLETI QKSLPYTYIAAYLDDVYILS KTPVKDKIAKIIEKSPFTLN SAKTTETDIDTLKTNGLKTL GSFIGPTELRKEFLQNKIQN FESSINALKKLPKQYGLLIL RKSTQLLLRHLLRTLNSQDL WELWEKTDKLIADFVINLTV TKRKKRPITDFVTPLITLPI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | AACCCTCGTTTGTCCCTCGA TTTATCCCGTTTCTTTTTCCA TCCCATCGCGCGTTTTCGTA AGCTTTGGTTTTCGTAGGAT TTGCTTTCGTAGGCTTTGCT TTCGTAGGCTTTCGTCAGCT TTTACCTGCTTTTATTTTTT CTTTTTCTTTTTATTCCCCC CCCTTTTTTTTTACCTGGTTT ATTAGCGGTTTACCTGCTTT TATTACCTGGTTCCCCTTTA CCTGTTTTATTAGCGGTTTA CCTGCTTTTATTACCTGGTT CCCCTTTACCTACTTTATAA GCGGTTTACCTGCTTTTATT ACCTGGTTCCCCTTTACCTG TTTTATTAGCGGTTTACCTG CTTTTATTACCTGGTTCCCC TTTACCTGTTTTATTAGCGG TTTACCAGCTTTTATTACCT GGTTCCCCTTTACCTACTTT ATTAGCGGTTTACCCGTTTC TATTAGTGGGCATTTATTTC CCGTTTTTATTAGCAGTTAA ATTTACCCTTTTAAGGTTAT TTACCTGCTTTTATTCACAG GGCACCCCTGTTTTACTAG CAGTTAAATTTACCTTTTTA AGGTTATTTACCTGCTTTTA TTCACAGGGCACCCCTGTTT TTACCAGCAGTTAAATTTAC CTTTTAAGGTTATTTACCT GCTTTTATTAACAACCCTTT ATTTTTTCCTATTAACGGGT ATTTATTTACCTGTTTTATT GGAATTCACCCGTTGGACGG C (SEQ ID NO: 1161) | | KDGGFGLLRHNGIAQDIYFA AKDLTTEIRHKIQRISNDFP QNQSPTATEILHLLHNGVLA DCKNGLTNAQLNALTENASY LGRKWLNILPIQKSNRLTDW EMAEAVRLRLLAPVKPLTHP CNHCGNRTNINHEDVCKGAV RKYTARHDQINRSFVNSLKS RPEIDVEIEPDLNNENNVNN ANTTTENPTPSPNGQNDTGC LFTTPIRSGTRNGQNGLRAD FAVINGVSKYYYDVQIVAIN KDSGNTNPLNTLADAANNKR RKYQFLDPFFHPIIISAGGL MEKDTAQAYKQIQKLIGPVA AHWLDTSISLILLRSRTTAA ISIAKNRPRA (SEQ ID NO: 1406) |
| HERO | HERO-2_BF | . | Branchiostoma floridae | TTTTCAGTCTGGCTCAGCCA GTGACCGCCGGGAAAGTCCG GCTGACTACCACGAATAGGG TGGTGACAGCTGGATAGACA GACGACAGCTCGGAAAGACG GCATTGGGGCAGTATGGGTT GGCACCCCTAACTGCATCTC CCCTAGGAGAGCATCCCGCA ACACGCTACAAAGAACCACA AAGAGCAATACCCCCAGGGA TGCCCGAGAGGGGGGAGGA TGAGCATCCCATTCGGACGG TCCAATCGGTATTGACCCCA GCAAACGGAGAATCGACA (SEQ ID NO: 1162) | TGATTAAAGACCCGAAACAC CCAATGACCCCGGGTTCATC ACTGATGATGTGTCCCTGTT CGCACTACCAGAGTGTATTC TAGAG (SEQ ID NO: 1285) | MNAVCVCGKVCKNQRGLRIH QTKMACLRRVQAEHRSGAVA TTVEPVLSASAPGQTEEDQG PEAPHSARNLRATPAPPQGR KSDHHRVKWPAANSKEWSQF DEDVDMILESVSRGSTDQKL QSMCTVIMSMGAERFGTIGQ RKPTDTMKPNRREVKIRQLR QELKSLRRSFKASTSGEERA ALAELTHHLREKLRTLRRAE WHKKKGKERARKRSAFITNP FGFTKRLLGQKRSGNLTCPV EEINLHLSNTFSDASRDVDL GPCPLLVTSPEPEVHFDISE PTLKEVRETVKAARSSSAPG PSGVVYKVYKHCPRLVVRLW RILKVVWRRGKVAADWRQAE GVWIPKEEESSKVDQFRLIS LLSVEGKIFFKIVAQRLIKY LLDNQYIDTSVQKGGVPGVP GCLEHTGVVTQLIREAKENR GDLAVLWLDLANAYGSIPHK LVETALTRHHVPESIQNLIL DYYSNFWLRAGSSTATSAWQ RLEKGIITGCTISVPLFALA MNMIVKGAEAGCRGPVSRSG TRQPPIRAFMDDLTVMTATV PVCRWLLQGLERLITWARMS FKPAKSRSLVLKKGKVAERF RFTLGGTQIPTVSEKPVKSL GKVFNSSLKDTASVQQTRSD LTTWLEGIDKTGLPGSFKAW MFQHGVLPRVLWPLLVYEVP MTMVEQLERTISRFLRKWLG LPRSLSNIALYGRSTKLQLP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LSGLTEEFKVTRAREVLMYR DSSDSKVSSAGIHVRTGRKW KAQEAVDQAEARLRHSVLVG SVAVGRAGLGSCPKPRYDKV SGKEKRLLIQDEIRAGEEED RRCRMVGMRKQGAWTRWEHA DSRKVTWPELCRAEPSRIKF LISSVYDVLPSPANLHVWGL AETPSCQLCQRRGTLEHILS CCPKALGEGRYRWRHDQVLR VLADTVSNAIQSSRSQQPPK KSIVFVRAGEKTRQQPTSAG GLLSTARDWQLLVDLGRQLK FPEHIVATSLRPDMVLVSES TRQVVLLELTVPWEERISEA NERKRAKYAELVVQSQSNGW RARCVPVEVGCRGFAGQSLA YVLKLLGVRGFRLRKSIRDI LEAAEKASRWLWFRRGEPWK PHGHRSGNDQPRLGRPGEGV W (SEQ ID NO: 1407) |
| HERO | HERO-2_DR | . | Danio rerio | TTCAAGCCTGGCGCAGCCAG TGACTCCTAGGAATAGACTA GGTGGCAACCAAGAATAGTT TGGTCGACTACTGGAGAGAC AGTTGACGGCACGGAAAGAC GGCACTTGGGACAGTATGGG TTAGCACCCCAGCCTGTGTC TTTCGTGAGAGAGAACCCAA ACAAGCTACGGAAAGCCCCA CAGAGATATACCCCCAGGAG ATCCCGAGAGGGGGGAGGA TGAGATCTCCAATCGGACGG ATCAAAGGTTA (SEQ ID NO: 1163) | TGATCAACCCCGGCTGGGTC ACCTGGGTGAGAGTGTATGA TGTTGAGAGACCCGAAACAC TCAATGATCCCAGGATACAT CACTGATGATGTGTCCCAAA TGCATCCATGAGATGTTTCT TGCATAA (SEQ ID NO: 1286) | MTHANEQTTNKIYVTCICGK LCKNHWGLKIHQARMKCLEQ ESKVQRTGPEPGETQEEPGP EATHRAKSLHVPEPQTPSEV VQQRIKWPPASKGSEWLQFD EDVSNIIQAIAKGDADSRLK TMTTIIFSYALERFGCIEKG KTKPTTPYTMNRRATQIHHL RQELRSLKKLYKKATDEEKQ PLAELKNILRKKLMILRRAE WHRRRGRERARKRAAFITNP FGFTKQLLGDKRSGRLECSI EEVNRFIEETVSDPLREQEL EPNKALISPTPPAREFSLRG PSLKEVKEIIKASRSASTPG PSGIPYLVYKRCPGLLLHLW KILKVIWQRGRVAEQWRCAE GVWIPKEENSKNINQFRIIS LLSVEGKVFFSIVSRRLTEF LLENNYIDPSVQKGGIPGAP GCLEHTGVVTQLIREAHENR GDLVVLWLDLANAYGSIPHK LVELALHRHHVPSKIKDLIL DYYNNFKMRVTSGSETSSWH RIGKGIITGCTISVILFALA MNMVVKSAEVECRGPLTKSG VRQPPIRAYMDDLTITTTTV PGSRWILQGLERLIAWARMS FKPSKSRSMVLKKGKVVDKF HFSISGSVIPTITEQPVKSL GKLFDSSLKDSAAIQKSKKE LGAWLAKVDKSGLPGRFKAW IYQHSILPRVLWPLLIYAVP MSTVESLERKISGFLRKWLG LPRSLTSAALYGTSNTLQLP FSGLTEEFMVVRTREALQYR DSRDGKVSSACIEVRTGRKW NAGKAVEVAESRLQQKALVG TVATGRAGLGYFPKTLVSQV KGKERHHLLQGEVRASVEEE RVSRVVGLRQQGAWTRWNTL QRRITWANILQADFQRVRFL VQAVYDVLPSPSNLHVWGKN ETPSCLLCSGRGSLEHLLSS CPKALADGRYRWRHDQVLKA IAASLASAINTSKNHRAPRK AVHFIKAGEKPRALPQLTTG LLHKASDWQLEVDLGKQLRF PHHIAATRLRPDIIAISEAS RQLIILELTVPWEERIEEAN ERKRAKYQELVEECRERGWR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | TYYEPIEIGCRGFAGRSLCK VLSRLGITGVAKKRAIRSAS EAAEKATRWLWIKRADPWTA VGTQVGT (SEQ ID NO: 1408) |
| HERO | HERO-3_BF | . | Branchiostoma floridae | CTGACCAGCAGACGGGAAGC CCGCGACCAACTAGTCTCCG CAAATATTGCACACAGGGCG ACCCTATGGAGCTGATTCAG TCAAATTTCCTCTGAGATAT ACCGATAACTATCTACAGAA ACTGCACAGTTAGTTTGGAA AGAGCTTTTCTACTGAAAGA CAGCAAAATCCGCCACTTTA GACGAGCGTCAAGACTGCCC TCCCCATAACCAAT (SEQ ID NO: 1164) | TAGAAACCCACAAGGCTGAG AAATGTAGAGCATCTGTATG GACAATATTGATGATTGAAA TGTTGTGATTTTAGATCAAA TTTAGAAATATGAAAACCGA ACTAAACTAAATATAATGTT TTTTTTAAAGTAATGATAAG CAATACCCACATTGTGCAAT ACTATCTATGTTATGTCCTT TGTCCCCCCTGCATGTTTGG TCAATAATGACCATCGTGTC CTGGGCTCCGTGTACCTTTC TTTTACTATGAATAAAGAATG ATTTTACTAC (SEQ ID NO: 1287) | MALPAVRSGPASTWTLLITL VIVAAKGTDGFMSFKLPLLS TDTWSGYNNDVKTLLGPLHH ELATNEMSPKLAGEGFSDIM CDFMASKPEFSHTTEESHSE GYISHEPQSLAQVKRLKNKL RKKAFRADATPEDRKAFRDA IKTYSFMKRQQRKETTKSA AHQEKEYHKNFWKFAGKCAK GQLDIPPVKPAFSVYYANEY YKNKYSHPTRVDFNKLLWFP HLPVEEQLPANSFDMSPVRP KDIKAVLSKRCATSAPGPDG IMYGHLKHLPACHLFLSTLF SKLLESGDPPTSWSSGNVSL IHKDGSPEAAENFRMICLTS CVSKIFHQILSERWAKYMTC NDLIDPETQKAFLTGINGCV EHVQVMREILAHAKKNRRTV HITWFDLADAFGSVEHELIY YQMERNGFPPIITTYIKNLY SRLKGKVKGPGWESDPFPFG RGVFQGDNLSPIIFLTVFQP ILQHLKGVEQQHGYNLNDKH YVTLPFADDFCLITTNKRQH QKLITQISSNTKSMNLKLKP RKCKSMSIVSGKPSDISFTI DGDPVKTTKDAPEKFLGGYI TFLSKTKETYDILAKTIETT VENINKSAIRNEYKLRVYME YAFPSWRYMLMVHDLTDTQL QKLDSIHTKAIKTWLRMQPS ATNAILYNTRGLNFKSISDL YLEAHALAYSRSVLKADEKV KHALQAKLDRESQWTRKMQK WGIGKCHTIHQQAIHVAKDS EWTSVRKHVKQQVTDMRHDV WTKHQENLLQQGQMLQLLEE EKCDLTWRSAMYNLPRGILS FAVRASIDALPTLCNLTTWG KRNTDKCKLCGNRETLHHVL NHCGVALQQGRYTFRHNSVL KHITDTIIESIDTSRINATI YADIQGYTTNGGTIPVHTIP TTQKPDLIIYLPEQKTLHIH ELTVPFEKNIKTSHDRKVNK YSTLAADLETAGISATLTCF EVGSRGLVTPENKTRLRTLF KIVKAKPPKTLFTDISRIAM LSSYAIWNSRHEPYWESETL L (SEQ ID NO: 1409) |
| HERO | HERO Dr | . | Danio rerio | AAAGCAGTAGAG (SEQ ID NO: 1165) | TAGCATGCCACTTGGACACA GGCCGGGGTCTGATCAGCCT CGGTCGGGTCGCCTGGAGGA GGGTGTCTGTTGCAAGACCC GAAACACCCTGTGAGCCCAG GAAACAACACTGATGATGTG TCCAAGGTTGTGCATCAGGA GATGTTTCTGTAAC (SEQ ID NO: 1288) | MTTHRAEVTTSGKTQEEPGP EATHSAQSLLVSPTPAAGRS PATQSCPQVTAAHNSPQSPQ SQQVAVTRSDCVPLAQPRIQ WPQSSKKAEWLQFDKDVNQI LEVTGKGGVDQRLSTMTTLI VNIAAERFGTVTPKPTPSTY TPSHRVKEIKRLRKELKLLK RQYKAAGEVERAGLEDLRGI LRKQLVNLCRAEYHRKRRRE RARKRAAFLANPFKLTKQLL GQKRTGKLTCSKEAINNHLK ATYSDPNREQPLGPCGALLT PPEPTSEFNMKEPCRSEVEE VVRRARSSSAPGPSGVPYKV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | YKNCPKLLHRLWKALKVIWR RGKIAQPWRYAEGVYIPKEE KSENIDQFRVISLLSVESKI FFSIVAKRLSNFLLSNKYID TSMQKGGIPGVPGCLEHTGV VTQLIREAREGRGDLAVLWL DLTNAYGSIPHKLVEVALEK HHVPQKVKDLIIDYYSKFSL RVSSGQLTSDWHQLEVGIIT GCTISVTLFALAMNMMVKAA ETECRGPLSKSGVRQPPIRA FMDDLTVTTTSVPGARWILQ GLERLVAWARMSFKPAKSRS LVLRKGKVRDEFRFRLGQHQ IPSVTERPVKSLGKAFNCSL NDRDSIRETSTAMEAWLKAV DKSGLPGRFKAWVYQHGILP RLLWPLLIYEVPMTVVEGFE QKVSSYLRRWLGLPRSLSNI ALYGNTNKLKLPFGSVREEF IVARTREHLQYSGSRDAKVS GAGIVIRTGRKWRAAEAVEQ AETRLKHKAILGAVAQGRAG LGSLAATRYDSASGRERQRL VQEEVRASVEEERTSRAVAM RQQGAWMKWEQAMERNVTWK DIWTWNPLRIRFLIQGVYDV LPSPSNLYIWGRVETPACPL CSKPGTLEHILSSCSKALGE GRYRWRHDQVLKSIAEEAISK GIKDSRYRQATAKVIQFIKE GQRPERTAKNCSAGLLSTAR DWVMTVDLERQLKIPPHITQ STLRPDIILVSEATKQLILL ELTVPWEERMEEAQERKRGK YQELVEQCRANGWRTRCMPV EVGSRGFASYTLSKAYGTLG ITGTNRRRALSNNVEAAEKA SRWLWLKRGEQWGQ (SEQ ID NO: 1410) |
| HERO | HEROFr | . | Takifugu rubripes | AGACTAGGTGACAACCAAGA ACAGTTGGTCGACTACTGG AAAGACAGTTGGCAGCTCGG AAAGACGGCACCCGGGACAG TATGGGTTAGCACCCCAGCC TGTATCTTTCGCGAGAAGGA ACCCAAACAAGCTACGAAA GCCCTACAGAGAAACACCCC CAGGAGATCCCGAGAGGGGG GGAGGATGAGATCTCCAATC GGACGGACCTAACGTTA (SEQ ID NO: 1166) | TGATCACCCCGGCTGGGTCG CCTGGGCGAGGGTGTATGAT GTCGTGAGACCCGAAACACC CTATGAACCCAGGATACATC CTGACGATGTGTCCCAGTGC ATCCAGGAGATGTAKCTTTA AGT (SEQ ID NO: 1289) | MTPAMEMTTTVTCICSKLCK NQRGLKIHQARMKCLEREVE VQRTGPGPGETQEEPGQEAT HRSQSLHVPEPPNPNRVVQQ QRIKWPPANRRSEWLQFDED VSNIIQATAKGDVDSRLQAI STIIVSYGSERFGRIEKGNT ETTSYTMNRRSFKIHQLRKE LRTLKKQFKRAXDGDKQALK ELYNILRKKLKTLRRAEWHR RGRERARKRAAFIANPFRF SKQLLGDKRSGRLECSREEV NRFLQNTMSDPLRGQDLGPN RALISPAPPSAEFKLAEPSL KEVEEVIKAARSASSPGPSG VPYLVYKRCPEILRHLWKAL KVIWRRGRVADQWRCAEGLW IPKEEDSKNINQFRTISLLS VEGKVFFSIVSRRLTEFLLK NNYIDTSVQKGGIPGVPGCL EHNGVVTQLIREAHESKGEL AVLWLDLTNAYGSIPHKLVE LALHLHHVPSKIKDLILDYY NNFRLRVTSGSVTSDWHRLE KGIITGCTISVVLFVLAMNM VVKAAEVECRGPLSRSGVRQ PPIRAYMDDLTVTTTSVPGC RWILQGLERLILWARMSFKP TKSRSMVLKKGKVVDKFRFS ISGTVIPSITEQPVKSLGKL FDSSLKDTAAIQKSTEELGG WLTKVDKSGLPGRFKAWIYQ YSILPRVLWPLLVYAVPVTT |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VESFERKISSFLRRWLGLPR SLNSAALYGTSNTLQLPFSG LTEEFKVARTREALQYRDSR DCKVSSAGIEVKTGRKWKAE KAVXVAESRLRQKALVGAVA TGRTGLGYFPKTQVSHARGK ERNHLLQEEVRAGVEEERVG RAVGLRQQGAWTRWESALQR KVTWSNIMQADFHRVRFLVA AVYDALPSPANLHAWGKSET PTCSLCSGRGSLEHLLSSCP KSLADGRYRWRHDQVLKAVA ESIALAISTXKHHHAPKKAI SFIKAGERPRAGPQITTGLL HTAXDWQLHVDLGKQLIFPQ HIATTSLRPDMIIISEASKH LIMLELTVPWEERIEEANER KRAKYQELVEECRGRGWRTF YEPIEVGCRGFAGRSLCKAF GRLGVTGTAKKRAIKXASEA AERATRWXWLKRADPWVATG TQAGS (SEQ ID NO: 1411) |
| HERO | HEROTn | . | Tetraodon nigroviridis | AGATTGGTCTGGCTAAGCCA GTGACGTCCAGGAACAGACT GGCTGACGACCACGAATAGA GTGGTGACAGCTTGGATAGA CAGCTGACAGCAGGGAAAGA CGGCAACCGGGGCAGGAAGG GCTAGCAACCCAGCCTGCAT CTTCCGTGAGGAAGAACCCA AAACTTGCTACGAAGAGCCC GAAGCAAAGATACCCCCAGG GGAGCCCGAGAGGGGGGAG AATGAGCTCCCCAAACGGAC GGATAAC (SEQ ID NO: 1167) | TGATCACTCCCAGTCGGGTC GCCTGGGTGAGGGGGTCTGA TGTTGAAAGACCCCGAAACCC CCGATGACCCCAGGTACTAT CACTGACGATGTGTCCAAGA CATGCATCAATAGGTGTATT TAGAAATC (SEQ ID NO: 1290) | MATTQASVKPTAVATCVCGK ICKNPRGLKIHQTKMGCLAS VQPEQRARFSLSESREVPAR AEPYGPQQPHSPEALGETQE ERGQESPHSAQNLRAQVAQA PDNPQHHRRVKWPPASKVSE WQQLDEDLEGILESTAKGGV DRKLQTMTTLVISFATERYG TMEKRAAPEKYTKNRRAEKI SQLRQELRVLKKQFKGASED QKPGLAELRCTLRKKLLTLR RAEWHRRRAKERAKKRAAFL ANPFGFTKQLLGQKRSAHLE CAKEEVDSYLHDTFSDAERE NSLGECRVLISPPEPACSFN TKAPTWKEIQTVVRAARNNS APGPNGVPYLVYKRCPKLLA RLWKILRVIWRRGKVAHQWR WAEGVWVPKEEKSTLIEQFR TISLLNVEGKIFFSILSHRL SDFLLKNQYIDSSVQKGGIP GVPGCLEHCGVVTQLIREAR EGRGSLAVLWLDLANAYGSI PHKLVEMALARHHVPGPIKT LIMDYYDSFHLRVTSGSVTS EWHRLEKGIITGCTISVIIF ALAMNMLAKSAEPECRGPIT KSGIRQPPIRAFMDDLTVTT TSVPGCRWILQGLERLMTWA RMRFKPGKSRSLVLKAGKVT DRFRFYLGGTQIPSVSEKPV KSLGKMFDGSLKDAASIRET NDQLGHWLTLVDKSGLPGKF KAWVYQHGILPRILWPLLVY EFPISTVEGLERRVSSCLRR WLGLPRSLSSNALYGNNNKL TLPFSSLAEEFMVTRAREVL QYRESKDPKVALAGIEVRTG RRWRAQEAVDQAESRLHHKE LVGAVATGRAGLGTTPTTHL SRLKGKERRDVQLEVRASI EEQRASQWVGLRQQGAWTRW EEAMARKISWPELWRAEPLR IRFLIQSVYDVLPSPSNLFL WGKVESPSCPLCQGRGTLEH ILSSCPKALGEGRYRWRHDQ VLKAIAESISSAMEYSKRLP LPGRGVRFVRAGEQPPPQPR AQPGLLATARDWQLRVDLGK QLKFPENIVETNLRPDIVLH |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | SQSSKQVILLELTVPWEERM EEAYERKAGKYAELVEDCRR AGWRSRCLPIEVGGRGFAGK SLCKAFSLLGITGMRRRKAI CAASEAAERASRWLWIQRDK PWTSASWTQAGN (SEQ ID NO: 1412) |
| NeSL | LIN9_SM | . | Schmidtea mediterranea | AAACGACATCATGAACGCTT GGCCGCAACAATCCAGTTAT CCCTGCGGTAACATTGTGGA ACTCATAAGACAAGTACTAA AAGAAGAATTAGAAAAATTA GAAGAAAAAATTGAAAATAA TTTATTTATAAAATTTAAAA ATTTAAATAAATTTAAAAAT TTAAATTTAAATTTAAATGA AGATAAAAATTTATTTAATC CAATAAATAATCAAGAAAAT CAAGAAA (SEQ ID NO: 1168) | TAAAATGGCAAAAAGATATT TCAAGATGAATTGTGGACTC ATCTAAAAAATGACCACCTT GAGTCCAAATATGCCTAGCT ATCATGGTTGCTGATGGAAA CAGTAAGGCACCTGATAGCT AACTTTTCACTGTGAATATC TTCAGATATTCACAGTGACA CGAAAGGACACCACTAGTAA AAACCACTAGTTTTTTCTGA CACCTCTTGCTACAAACTCT GTAAAAATCAAAAGGATCGA TAGGCCGCGCTTTCACGGTC TGTATTCGTACTGAAAATCA AGATCAAGGAAGCTTTTCCC CTTTTAGTCAACACCAGGTT TCTGTCCTAGTTGAGCTTCC CTTGGGACATCTGCGTTACC ATTTGACAGATGTACCGCCC CAGTCAAACTCCCCACCTGA CACTGTCCTCAAAACAGTTC AATTGCATCCGAAGATCGCA ATTTTTTCACTAAAATAAAT TAACAAAAGTTAATTATACT GCTTCATTGAGTAAGTAGAA AAACAATC (SEQ ID NO: 1291) | MMDSRQLNTPKIRKYQNPKM TNDIMKSYNYAVLSDVTPQE TTQTTTHLNVDIDNETTQPK QPLTKSGKPKSKPIAVSYKF KDATFIWDTTPQTNPPRDCT KLIDKTRPRKTIFKKSAFQS YLKKELSNETFVEVKTFLMA THKYRFKDENSRLLAYRIIN RYVMETANEFKETEFDMARF AKFFTIPENWLKHLKPYSTA TETSPADRIKVQKLVDLTCR YPFKTQEEQTSVANFLHFFT QRSIIGISRDYKFQKFIPFM ARKNTRPETTSTMVTTSPTE QNRLPMVIITPLEEPKSEHR RPEKRGASNDTIVLSDEEFP LLKRRTLPTRKSKNPTGAGN VPTETECTDEVKFILNNEYQ IECKECGKVWENVRNGLNHL RQKHDFPNRTDVMVSCVRCE VPIKGAECVNHIKNHKKDDK EESEAGSLVANTQDIPNESS LSQAAIEVYLRNILKMKENQ ERNIQYLEPSTANFLINRNL RAFYQNVKIEKLIGWEQVIW LIHWNKCHWIVYLANCDSKT SVILDSDNQMTLQQRCNIKA KFDKFLEGTFEEKTVLGTLE RKVPQQPNNFDCGIYVIQYI SDFLKDPQRIDYHTPDSKRI RKEIGELILEEMKNPASKIK NPNKEIQSLLOKFRLLQINV NDVFHWFAAEYQKSLPKIRT KRDGKLNKLSCSYQIQRLFG LAPKRAVKEIYFQETSTADL ETRVLNEHFKKDESTMKECK IKNGNHYQDWITKAQIDNKE ILEALKNSTDSAPGEDNIPL RQWIIWNNDGVLFDMFNYIK RTHDIPDMWKNYTTTLLIKP GKSQESNIPANWRPISILPT SYRIFMKVLNKRVLEWANRG ELISKWQKAVDKANGCDEHS YVIQALIEKANRSYYKNEQC HLAFLDLADAFGSIPFQVIW HTLKNMGMDEETINLLKEIY KDCSTKYKCGKNESEKIKIT KGVRQGCPLSMTLFSLCIQY LIQGIAEKKKGATIAGQEVC ILAYADDLVIVANTAKDMQM LLTTIENLAKQADLIFKPAK CGYYRDPRDKKSMMKIYGKE ISIVDEKNVYTYLGVRIGDT KKKDLNVRFEEVKKKTTAIF KSKLRSDQKLEAYNIFCQSK FVYILQGEDIAKTKIETYDE EIKKMIKEDILKLQDKSPFT DFVIYSPREKGGLGITKIID EQTIQTINRTAKLLNSSHRA IRAIIYEELIQVANLRGEKE INTIEEALKWLEGTNKYKKN SNAKTTWITRVREAFQTLEK KHKIKVRFVPKENCIGYKIK CDTQEKIVELDNSKELSKSL HWMIKEAYYKEWKALKCQGY IISLKTSEFMEWKMPRGLPD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | PDWRFLTKVKANMLDVNMKQ ANQGGRLGSTKCRKCEDKES ASHVINHCASGNWSRVEKHN QVQNELAKELTKRNISFEKD SIPKETKESLRPDLVIRLKD KIMIVDIKCPFDEESAIESA RNKNIDKYRELAKEIQAKTG LQTTVSTFVVCSLGTWDKRN NELLRQMGIRYEESKEMRIN MIQKAIHGSRKTYDHHRNFN NG (SEQ ID NO: 1413) |
| NesL | NeSL-1_CBre | . | Caenor habditis brenneri | AAGGACGCTGGTTTAAGGCC GAATTCGTTCGTTCTTTTTC TGGCGGTCTTGCTTTGAGCT TGGTTTCCGATCCT (SEQ ID NO: 1169) | TAAACCCACACGAGAMCTAC GACGCCATAAGATCAGGCAT GTACGGATGTGAATGAGACT GATGAACGGAATGAGCACGT GCCCATAAGATCGGGTATKA AAGAWCAGAGACGATCCCTA MCATCGGGAAAACACGAGTT ATACTGCTTCACTGAMCTCG CTAAGCTCTCATAATGACCG AACTTGTTCGCAACTGCCTC CTAACCGGGCGGGTGTGAGA AGGGAGGTCGCCTTGAGGCG GACGCAATGAGGGATGTGTG CAGGTTCCCCCTCTTGAGAT CCGAAAGTCTAAAAGTACTA GACCGAAAGATCGAGGACGG ACGGGATGGCCGCGAGGCAC ACGGCGGGTAACACAGCCAG ATAACCTAGTAGATCTTCGG ATCTCGTCGGCCTGGAGATA TGTGGAACCCTGGGAAAGGA GAAAGTTGTTTGTTGGGCTG GCAAGAGTGAAGTTTGAATG TGAACCACCGTCATGCAACC ACTAAACCAGTGGCGATGCG GGTGGAGTCATCACAGGAAA ATGTTTCTGTTGCTTGACTT ATCAGTGTTTGATATCGCCC TCAGGCACAAGTATGAAGGC CCCCACCCACATAAACTCCC TAGCAACTGGTAGTCCAGCA AGCGCTGGTWCTTGCTACTA TTGCGCCCCAGGCTCGCCC (SEQ ID NO: 1292) | MPLXISDCVHLVSAEGDTMN GRSTCGPLSRSSSVVSRSRS SPSPSVPPHPSPSIGPDTGL SAGIIGTSRGCSLWLPEVDN ALSQWLRKGLERDHEVLVCG FEAAKPLSLSKARLLRKTPR NTGVVRHILEFDGRLVHTNC NETECVLSTLXSXXAVEVVR ISLKCEPREPCEPKCVLSIL CSDKIVXISFECETREPFPF FXDRKFREPIPFVFERMYDP RDPIPSFICWMYDLRQRMTP GTLPXNPLSXENKDSWGRPA VIKNEIRSMRSYLEENVKEN RLNLLRRLRGGGEGKKMIRK LVAEKKSDTEAVCRILYPLD DRYECFVDGCETTSTMGYGS SDLKYMTTHIKKEHGVKVQW TYECSLCNKQAPFMGGAASK WVTAHMATKHTETVKLKLKP SISTTAKVAAKLDEIAVSLP KPRQVRVLRDPDEVKEKVAK PTLASTREEVKRNALRNMAP LVELSSQNQLTGAERPEETS EAMRLEECRTPEKIAELEGK IQTRTVTKKLSALKESMEKR TREEKVGKPSLAPIHEEVKK TARRSLAPLVEPSTFTHLTG ASRLQAVRDAFSKANKDAAA KRRSSLAKPARLSEIMNTTF TKETVNETKEPVNDTDESIA TIQPQVRVYRFNTWCLDHET TREAWLTGEVVDWFMGKVTE KKDQYRVFDSLVWSMYKFHG VGYVLDLMRDPLTYFLPICE HDHWVLLVIDEKGIWYGDSK GAEPCREIAKFIEETKRERR MFPVPVPLQRDGVNCGVHIC LMVKSIVNGEPWYTEEEVKV FRRNVKRGLKEFGFELYSER IVYYGDDSIKVNDEHDDDVV FLSEETNNTTFTIEQAEDPA EEDAQHLESPVKPVKLMELK IPKIEIKKKEIRRKPKQQIE KKRKVPTGKPDELLVRVRLW LEREVQSYFDSGKRFQRLEW ILDVLTAAIHKATAGDEQAI ERIEKRSPPLEVEEGEMSTQ TEPKKRERKEKESGCEMKAS HKEMYFKNRSKAFNVIIGKD SKQCEIPIETLQKFFEGTTA ETNVPAEVLKEMGSRLPKLE ALDWMEANFIESEVSDAMKK TKDTAPGVDGLRYHHLKWFD PEYKMLTLLYNECKNHRKIP SHWKEAETILLYKGGDETRP DNWRPISLMPTIYKLYSSLW NRRIRSVGGVMSKCQRGFQE REGCNESIGILRTAIDVAKG KRRNLSVAWLDLTNAFGSVP HELIKSTLESYGFPEMVTEI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VMDMYRGASIRIKSKNEKSE QIVIKSGVKQGDPISPTLFN MCLENVIRRHLDSASGHRCI KTKVKVLAFADDMAILAENR DQLQTELNKLDKECESLNLI FKPVKCASLIIERGMVNKNA EVVLRGKPIRNLDENGSYKY LGVHTGIATRVSTMQLLESV TKEMDLVNQSGMAPFQKLDC LKTFVLPKLTYMYANAIPKL TELKVFANLTMRMVKEIHEI PIKGSPLEYVQLPPSQGGLG VACPKITALITFLVNVMKKL WSSDSYIRKLYRDYLDEVAE TETGMEEMTKEDIAKYLSGD VPIDKKAFGYNTFTRVRDVC NSLTXIXGAPLHKLKIVERD GDFAILVQATKEGMEKIFTC AQEKKLQQLLKAEVNTALAH RFFTEKPVKSAVMSVMRQYP QSNAFVKNGKNVSIAVHSWI HKARLNALHCNFNTYGENKS KVCRRCGKDVETQLHILQXC EYGLPKLINERHDAVLHVVR NLIRKGSKKDWKLKIDETVS SCNQLRPDIYMCSPDGKEVI MADVTCPYESGMQAMQESWN RKVTKYEGGFSHFXKMGKKF TVLPIVVGSLGTWWKPTTNS LVQLGIEKXTIRRVIPELCS MTMEYSKDVYWNHIFGDTFR KPPMRFGVEKPKGNSWKKEG SEPKGAASSD (SEQ ID NO: 1414) |
| NeSL | NeSL-1_CJap | | Caenorhabditis japonica | GCGCCCCGGGTTACATTGTC GGGGCCACCTTTCTCTTGGA GTAGAGTACAGTCTACTAAT TTTTTGATAAGCTAGTCGGG TCCGAACCACTAGAGTTTGC TTGAAAATGCGTCAAACCAG CATTTTAGAACTCGCCCAAA AGTTCGGCCCCGACCCCCAA ACAAATGGGACCTTCTTGAC GATTTTCCCTGAAAATCGGA GGATGGAATGGTCCCCTATT CTTGTAAATAGKACTGTGCA ATACCCCTTCGTCATCTGTG GGGAACAGATGACACGTGAC GTCATCCGTGTAGACGTCAC GTTTTCCCGTGCCTGCGGGA GCCCCCAATCGAGCAATTTT TGCTCTTTTGAGTGTCTGGA ACGCTTGAAACCCCAGACAA ATCAGGCCCAGTCGTCGGAA AATTTCTTTTTGAAATTTTT TGGCGCCTGCGAAAAAAATT TTTTAACCGCCACAAACCCC CGGGAGGCGCGGWTAGGGAT ATCGATGTCATCGACTCGTC GGTGATCTTTGATTTTCTCT CTGCGTCTCCTATTTTGGAA CAGTCTCGACCAAAAAACCG GGCCTGGCAACCCACCGAAT CCGGATGTCGGAGGGATTTG GCAAGAAATGTTGGAAATAA CGAAATTTCGTTATTTTCAG CACAATTGTCAAACCGGCAA GAAAACTGGATGGACAAGAC ACACAATTTACCGGAAATTG TGCTTGTTACGTCGAATTTC CCAATTTTGAAAAAATTCCT CGTTCCACTGGTCGGGACGC GAGGTCAGACGATCTGCACG | TAAAAGCCAAAAGCCACGGA GCATCGGGAAAGAAAAATGG AAAAGGACTGAAAACGAGAC TGAAAAATCCCAAACAAAAC AAATCCAAAACAAACTGAAA AAAAAAAAAAAACAAACAA AAACTGGACAGACACTGGAA ACAGTGTCAGGCAAAGTCGC CGATTATACTGTTCCACGCC TTAAAAGTCCCGAAATGGCG CAAAACAACCTGAATCTATC TGAAAGTGCTCCAAACCACG CACAACTCGGAGAAAATCAG GGACAAGTTGCTTCACGCAA CGGGCTGGGACAGGTACCCC CTCCTGAAACCGCGAGGTTG AGGATGGACGGGAAGGCCGC GAGGCTTATGGCGGGTAACT CGGTTGGTGTGCTAGTAGAT GATTTATATCCGACAGCCCC AACTAAGAGGAATCCTGGGA AAGGAAAACTTGAAAAAGTT TTTACAGGGCTGGTAATAGT TCAGCACAATTGTAGTCTAC TGTCTTGCAACCACAACAAA CCAGTGGTTCTGCGGGTAGA TCAAACTATAATTTGTGTGT TTTCTTTTACTTGACCCGGG CAACACATTATACCACGTCC ACAAGGACGAATTCATAATG GCCCCTCCCTAAATAAACTC CCTAGCCAACTGGTGGTCGG CGAAGCCGGTTCTTGCCACT ATTGCGCCCCAGGCTCGCCC (SEQ ID NO: 1293) | WRRPAPKQTKNSSLHHLGHE VKRIARLKPGIFEFHAKPKN SSLHHLGHGVKRXARLKPGI FEFHAKXKNSSLHHLGHEVK RIARLKPGIFEFHAKPKNSS LHHLGHEVRRNSRLKPGIFG FYQKSKNSSLHHLGHEVRRI ARLKPGILEFHAKNRIKSGL KVTFLSDLXAHAGALACSRF LASTLKTEHCRQKSFKPVGF LLHFLKNSSINEVASLRNVK KXFLEFFSGKPIGGMASFSR TKITFFKLCLKNFVLSAENP PIIRQKTNONKASXVQIARG GHLSDCLPSQKMAGVLGRLF LSVQSTLSHRPFDTLLRSDD DKRGRKTIKLQFFIKENLVT PXVARDVKILXKQTKNNSGN SDSNSETKNFSKNKVSRQNG PLIGGGNHKKIGENQITRTL EIESKSDDNKVLVLRILYPT NDWYKCYSQWCQHKSLVGYG AHDLKYLTDHIKSTHSKKVE WSYQCSICDAKAEGTGTKAA RWITAHMPKVHGIEATHRIK QNSEKTTNVKTANSLQEMAL SLQKPKNGPKKVVMATSTTP EKKISELESKIQTREVAKQL SALKESAQKNQQGNKTKNVK SSLKTIAENTNETKKISARK SLINYLKPEDVLNHIPKEPK PASAKKGLQELTGAQRLQET RRRFMAGNRRDSIARRESLS LGKISNSFKIELKNAPEKTT LKKPAVTQKQNTSQNVSSST VVKENKTGNDVITIDDTETV KRKINTWCLDHESTENAWMA DDIIFWYIQKQIEISLDNKK FKVIDPLIWTTYRIYGVECV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TCTGAAACCCAAAATCTTCG GATTTTATGCAGTAG (SEQ ID NO: 1170) | | QDELVGFEKYFFPICENGHW VLLIIDDKRVWYSDSLADKP IEVIEDLINKLNRTQGKFNQ TVPKQKDGFNCGVHVCLVAK SVITENFWYTEKDVNDFRKT VKLWLFSEGFELYSEPYKQI QNKNISVNSEKNQISDNEKN WGDKTQTVNESTLKERDEDI FLLRPHISVGVALKTEDEKN QKAENLKAPQKLKAIRRLKI LKTCLKKLTAVKGKPEETER AAIPNLMAIKLKTPPKVEPV RRNPEKGENYXKSQPNKKRQ IPTGKPDELVKKVREWFEIQ FQAYFEDGKSFQRLEWXTGL LTAAIHKASAGDEQAVGKII KRCPPLEIEEGEMATQTETK QKPKNQKSTKGANSSSSIRE AYAENRARTFNKIIGKDDKC EIPIEKIEKFFENTTSNTNV PTETLARITSDLPKLEIGSW IEEEFREKEVAEALKKTKDT APGVDGLRYHHLSWFDPKXK LLTKLYNECREHKKIPGHWK EAETVLLYKGGDETQAENWR PISLMPTICKLYSSLWNKRI KSVTGVLSKCQRGFQEREGC NESIAILRTAIEAAKGTKKS LSIAWLDLTNAFGSVPHESI EATLIAYGFPGMVTEVIKDM YNGASIRVKTKNEKSKQILI KSGVKQGDPISPTLFNICLE SVIXRHLKSADGHKCIXSNI KLLAFADDMAILSDSKTKLQ QELQKMDDDCTPLNLIFKPA KCASLIIEWGKVQKDQKIKL KGQFIRSLAEQDTYKYLGVQ TGIETRVSAMQLMKKTVSEL DKINCSALAXWQKLDAVKTF VLPKMTYMYANTVPKLSELK EFANITMRAIKVMQNIPVKG SPLEYVOLPIGKGGLGVACP KTTALITYLVSTMKKLWSTD DYIRKLHTDYLKMVAIKETK TKEVTLEDLASYLSDDKTVC KKAVGYNSFTRVREICKTLS KNKGALLSQLKIIAKDGKLA ILVQAXKDGKTKIFTHDHVK TLQKXLKKEINEALLHRFTT EKRVKSEVVRVVQEYPQCNS FVRDGGKVSIGAHRFVHKAR LNLLACNYNTWQDAATKQCR RCGYEKETQWHILSSCPKSM GGKITERHDSVLKTVKEMIQ TGSLKNWKLKLDHELPGSTR LRPDIYLRSPNGSEIILGDV TIPYEHGIEAMQTAWQKKIE KYEEGFKYLRSTGKKLTIVP IVVGALGSWWKPTTDSLVSL GIDKNTVKRAIPEICSTVLE YSKNIYWNHIFGDSYQKVPM FFGGEKPKGQSWKKVKPPEG KTASNHEPPG (SEQ ID NO: 1415) |
| NeSL | NeSL-1_CRem | . | Caenorhabditis remanei | CGCGAACCAGTCAT (SEQ ID NO: 1171) | TAGCCGATCGTAAAAGAAAC CGAGCCGTAACAACAAGCAA AGTAAACAAAAGAAAAATCA ATAAAAAGGAAGGTTGACCT CAGACCCCGAGGAGGGAAGA GAGACACCSAGAAAAAGAGA GACGCAGAGAAAGGAGAGA CACCTCTCATAAGGAGAGGT AGGTCAATCCAAATGTAAAC | MTVFIDRGIGERGQMAVCSL HRYFSFSPFSPIPPYVNNGS FGENGCGTDKSLLPVIEVVV REVKINWSENILVVECLIMV KSGERVVVKRQNLEKVIQNL ARINSTLFSNLGNQIFCVVP RIKDSTNKEQGYRKEKQXKF HVSFRSIKSQVPPYLRGGGD VMEDTEIRGIRKLEPEAQLD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | AGAAAAAACCAGTGGGGAGG AAAGAAAGACTGATTTCACC CACTAAAATGAATTTGGAAA CAGAATTTGGAAGAGAAAAG AGAAAGGGAAACCTAAAGAA AATAGTTCTCTTGCCAAAAT TCTGTAGAGGAATACTTTGT CAAAACATGATAGAAACCAG TAATCTGGTACGAAAGACAA GTAAGACCTGAACTGACAAG AAGGAAGTCAGAAAGAAATA CCGCTCACAAAGCCTGTGAT CGATTCTCTTACCTACTGAA CTTGTTCTCTTGGCCTCGTA ACCGGCTAAAGGGAGAAGGA ATGTTAATTGGAGATAGACA TAAAGATAGGTGGAGTGAAG GTCCTGTTCTTGAAACTAGG AGGAATGTGGAAAGAGCAGA AGGCCGCGAGGCTTTAGACG GGTAACTCAGTCAGTTGCTA GTGGTCTTCGGATCCAACGG CTTCGGACATAGTGAGGAAC CCTGGGTACGGAGAAGAAAT GGAAAAGAGATAGGGCGGGC AAAGGCTAAGTTCATACACT GTCATGCAACCACTAAACCA GTGGGATCTGCGGGTGAATC ACTTTCGAAAAGAAGTGAAT GGACGTGCTGATGTCTGACT TTAAAGAAGTCTGAAATTAA AAAAACAGATATAAAGGCCC CTCACTATAAACTCCACAGC AACAGGTGGTCCGGCGAGGC CGGTTCTTGCCACCATTGCA CCCCAGGCTCGTC (SEQ ID NO: 1294) | SSKPLICRVLYPTQGYMYKC FYPKCKGHSNGSTDLRSLKK HMVDKHFTNIEFAYKCATCM FLTTGKSATALKSIKAHMAS HHKVTMEPGKKSLVQKLNAR LEEAAPSLPMPRNRSKVIQL TPEKSISELEKKKQTRSVAK QLSTLKESAQKKEEEVKIAE VKKREPRLSIIPESNVRRSL AAGLEQCINPEQSVAQRIRE KREEYAKASREAAAKRRSSL AMKPARLPDKENEITLQETK KIDDPIVIDLEKECILTTVL QVPRNQFNSWCLEHETTIDA WLTDEVIHMYMCTITENRKY FMAIDPVLWPVYVRNGAEDL LRRTSCPGTFFFPICESNHW VLLVIEHDVYWYLDPKGEEP KGNVEILLESMKRKRQYYEF PPPSQRDNVNCGVHVCLMAK SIVDECGYNWYSEEDVRSFR TNMKDILKSKGYELCPEPYN RQNLLKTEKQKEVILEEMID SFVVEDDMTFTVHRDSDHGD DEVEHLKTIEQEPENEISEI ENVEGSVDSVIPKLMEMRVQ TPPVINEKRGKKRVSAKEKP RKQKEKEQKVPTGKPDELVK RVRVWFEKEFKSYVEDGKSF QRLEWXTDVLTAAIQKASAG DEKAVELIEKRCPPLEXEEG EMCTQTEKKKKPKSGKGNGG QESMKSLMASYSENRAKTYN RIIGKHSKQCEIPIAKVQKF FEGTTAETNVPKETLKEMCS RLPKVEVGTWIEGEFSESEV TEALKKTKDTAPGVDGLRYH HLKWFDPELKMLSQIYNECR EHRKIPKHWKEAETILLYKG GDESKXDNWRPISLMPTIYK LYSSLWNRRIRAVKGVMSKC QRGFQEREGCNESIGILRTA IDVAKGKKRNIAVAWLDLTN AFGSVPHELIKETLESYGFP EIVVDVVEDMYRDASIRVTT RTEKSDQIMIKSGVKQGDPI SPTLFNMCLESVIRRHLDRS VGHRCLKTKIKVLAFADDMA VLAESSEQLQKELTAMDADC SALNLLFKPAKCASLILEKG IVNRLNEVVLRGKPIRNLME NETYKYLGVQTGTETRVSIM DHITEVSREIDLVNMSQLAM HQKLDILKAFILPKMTYMYQ NTTPKLSELKVFANLVMRSV KEFHNIPLKGSPLEYVQLPV GKGGLGVACPKNTALLTFLV TIMKKLWSSDSYIRKLYTDY LEEVAKVEIGKFEVNLNDLA EFLSDERAVDSKLFGFNAFT RVREVVRSLCKNKDSPLHSL KIIEREGKLAISVQATEESI EKIFTEDQEKKLMYLLKGEL NTALQHRFFTQKVFKSEVMR VVQQHPQSNSFVRNGGKMSF SAQRFVHPGRLNQLPCNYNT WAKGRTKLCRRCAKNENETQ SHILQVCDYSIGNIIKERHD AVLYKFRELIKRGSKGHWLE RTDRTVPNTGSQLKPDLYLE SPDGKHVILADVTVPYERGI EGMQKAWNEKINKYTDGYKE IFRRQGKSLVVLPLVVGSLG TWWKPTEESLIKLGVEKTTV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | RRIIPETCGMVAEYSKNCYW RHIYGEKYVQTPMINGGKKP EGNDWKKCEKGIEVPKVTN (SEQ ID NO: 1416) |
| NeSL | NeSL-1_TV | . | Trichomonas vaginalis | GGGTGAGTAGTCTAGTGGT (SEQ ID NO: 1172) | TAAGAAGAGATAAGACGAGT GAGAAGAACAGAAGCATAGT AGGATTGGCAGAGCTTAAGC GATGTCACTCGGTACGAAAC GTGTACCAAACACCGGATTC CGTGCTAGGAATCACAAGCC AAAATAAAAGAGACACCACG AAAATTACTCACCCTCCCTC AAACAGATAATAATATTAAC CTCCCATCCATCAGTCCGTA TGGTCTGATAACAGACTAGC ACCACATCCATGATACACTC ATTGGAGTGAAAACCACCAA CAACAAATCCACCTAGACCA AATCCTGCCCCACCTCCACC CAAGTAGCTCGCTTCGCTCG CTCACCTAAAACTTTGCTCG CTCGCTTCGCTCGCTCGTCT TAACCCTTTCCGAATAAACA CTTACAATTCCCGGCTCGCC CCATTTTTT (SEQ ID NO: 1295) | MIPVLGTGGPEKLPLQSYVY CGNTAITDSFTPTAKTILKP EEQNLDIVLKNIAALNPENY SDLIRSLSKMEFRLDYPKEI ENYWISEKLFSQSIASLPIS LLVASMFSPEDRDLSTEPFH CNADGCNFHCDNCERMVEHI REHHNTDPMINTFETTEDTF RRITAIKIDKTGIEELNPLK YRCSYCDELFTEAEDHAIHM ISHLTEKLSPDISFFFNDIL RLYKTIDKPTVQNLFPETQV AIFDTLEETNRFRLIVGREA IETIEEAFPPSPPGTDRKPS IIITDTCQLRFVPCMDEPPK GDLGILTLLLRDFSAHNIPI KSLNNKELIADKDIDYSPDF VEGALANAEEHDTTNSQNNN GRYINSAEKLTEFLIQCEDY LTNIKTLEDLERFYTTIKDY RVNKEVIAEDTPIFVYFLVE EGKLPKPGLRCPLESYEGHE DKAFESLRKLCDHFKGEIAK TSFDPKVHTIDIWVEFLAQA YGTGTFVYKDENGNIDLDTH VFKCPYADCSYTNNDRSKLM DHMKTKKHAKNVYIERYGFF WGIVIEGVNRPKGIVYPTLK DIKEHACRKCPEAGCNTYVT ELSDIKEHLKKKHKSTTAGV DGEIAHTDATYCWITKEELD ALHAERARERAEQVDNTPVQ QIINADNNEENNENQEDNGN NEEADALDPPNNTTETEDEA VHAVIINPPATEEEEVAIIA EARRNIPELQQAEERGCVTP KMTSLVRLKLLKGGGELFNK KLTPLATRYAATGNTEADKI KVDYLTLKCNAALREMIYTN NHSESKFMTAENGEDTAPPP RISEDTRDRIQKAANEIKGT LIKVVKHISHARCLKDSTRD DEHNKFVEMIAKIKNDLRDN KFEQYNIEEIFQGPISDQSI LNIVNTEDNNEFIKKMDYIN RILGTPQDASPYARKKLQAC FADNPTKTLRNIILADKVPQ QSLKPSEYLDYYGPQWANEA EGYENFLHHDYALPERYGQV FANDFLDFMTNESKIIEVIR NKNHLSAHGLDGIPNSVYML FPVSAAKFLSILFRSIIISG HIPDCWKLSKTVMLFKKDDP SLAKNWRPIGITSCTYRIFM TLVNKALQMIPMFHAMQKGF VRGATLSEHIAVANEVLCQS TRTQSEMFQTAIDFTNAFGT VPHQLIFDSLEAKKVPDSII NLLKDLYKGARTAIYTRHAH SEIVPVRRGVIQGCPLSPIL FNCCLDPLLYAVQRRHFEDG YRFQDKAGQYSIAIQAYADD VLVISPTHEGMQRILNTVDE FQKIAKLKVAPQKCVTLAKT STAIQPFRIGPDEIPIKTSM DNITYLGIPISGTKTSRFAA ATGILEKVKAQIRVVFASHL ALSQKIIALRVFILPQLDFY MFHNVFRVNDLKATDQMIRG |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LIDKEAPTSNIPVSFFYMPK NKGGFGLVKLELRQPQLVLT KFARLWLSQQAETKAFFHTM AQEEKSFRKVVEDQENGFLG IKMENGKIVQKNERSKRTNC FITQAAKAADKLEVRFKEWD KGGIQVRGVGENATDWYRSK HIGQISPLIGRVIQQRQYEE FKKDETHSHTFCEPAALAES HDIMKRPQAVPNNLYSAAIA LRTNTAPTPANMHFHNPEVL ANCPLCGCQSCTLFHTLNMC RNRFSLYKWRHNIICDDIYQ FIHDHYPGVTIKCSARITSD GYQTTGPELDDTVKDLLPDL VVYDEANKMIKIIEVTCPYG TDNNVGNSLDAAYDKKVNKY KSLAEQTERLFNWTTTLSII VVSSLGVIPLRTKLDALRIS PADHIQLLKRLSMHAIAASA CIVFEKVPEFFGMRCRPLPG RVTAPNAAIPPNNNENNNDT DHGQENQQATSEEQPTNNGN AQEDNGQGEQINNSTEQTIS VDQIIEEDAENNAIEQALDQ PDEDEFLN (SEQ ID NO: 1417) |
| NesL | NeSL-2_CBr | . | Caenor habditis brenneri | GACTCGCCTTGGGGAAGGTW TTTCAGGGGKSAATTGCCGM AGGCAAGGCAGCCCCCSMMT AGCTTACAAAGTAAGTACMC ATTTTCATTTCTTGTGAATT CTTTAAACATATTTTTCTTG TTTTTTGATTTCTTTTTTCT CTACCTTCCCCCAATTCTTC CCCTCATCTTGTGTATACAT CCCCCTCCTCCAACCAATCA ATACATTGACCTCTCTCTTC TGTCAAAAAATCAATACTAG TATATTGTCCCTTGTATAGT ATTATTTGACGTCGTCTTTG TATTAGGAGTAGGTAACAAW CTGTGTATGGCTTCAAAAAG CATGCACAAACWCCTGTCAA AAAGTAWTTCCCATCMTGTG AATAGCTCAACGACWKGAAG MCCAATGAT (SEQ ID NO: 1173) | TAAACCGGCTCCTCTGGGAG GAGGTATGTCAGAGGACATT CTCCGTGGGCGGATGGGAGG AGTAGGGTAACGACCCGTCA TTCTGGATGCCTAAACCACC ACAATCTGTCAAGGCAAAGT GCCCCAAAAGCACACGCGTG GATCGGTTTGGATGCCGACT GAGCCAGAGGGCAAAGTCGA AGGCCGGTAGGCTCCCGGCG GGTTGTCCGTCATAGTCAGT GGTGCGCCTACACCCAACTG CTATGACACACAAGGACAAC CCAAAATAAATAAGCCAAGG CGGCGTTAGCTTCGAGCTAA CAAGCTCCCCGAGAGGATGG TTGCCACAGGGCACCATCCT GGGGAACGACCCGATCTTTC GGATGCCCAACCACCGCCAA TCTGTCAGGCAACGTGCCCC AAAAGCACACGTGCGGAGCG GTTGGATGCCGACTGAGCCA GAGGGCAAAGTCGTAGGCCG GTAGGCTCCCGGCGGGTTCT CCGTCGTAGTCAGTGGTGTG CCTACACCTAACTGCTATGA CAAGCGTATAGGAGGCCCGG AAAAACAAGCCAAGGCGGCG TTAGCTGAGAGCTAACAAGC TTCTCGTGGATGGGTGCCAG AGGGCACCATCCTGGTGGGT GGATGGGGGGAGCTTGGGAA CGTCCCGATCCTTCGGATGC CCAGACCACCGCAATCTGTC AAGGCACCGTGCTCCAAAAG CACACGCGCGGGTTGGTTTG GATGCCGACTGAGCCAGAGG GCAAAGTCGTAGGCCGGTAG GCTCCCGGCGGGCTCTCGT CATAGTCAGTGGTGTGCCTT CACCCAACTGCTATGACATG CGTACAGGAGGCCCGGAAAA ATAAGCCAAGGCGGCGTTAG CATAGGGCTAACAAGCTTCT CGTGGATGGGTGCCAGAGGG CACCATCCTGGTGGGTGGAT | MRYHXSNXPAXRTSDNXWRS IXKDVRRPDPSTIEEKSRYN RSIGIPDSLKXRSSAVRSXS SXPPSGPQDVRLXNSPSLDD RRRLVDCETTLGSYREWTDK PMMGKMTYAAVTKRAPPRPQ TGGARLSTNLLADEMEIKYR DTNDIRLVIDLPNPHLIKCP LCKSCISARGRGANALKYMK RHIADAHHLNADFVYKCSRC QEHEPENVCGAKWIVNHLKR VHGYTLEDAVSTAKPSTRQQ IANAFNDSAPFIDARKTSDV PEKKSREAGLEKFLAPTKSE DTREKTPPSTRKSSESSEAS IQSTIQETLSESSDTLTVQE IINISSEDEMDEEPPKRRVN VWALIHENGKDAWIDSDLMV IFLESRARGYESCSIIDPLN FICTDMSYLTTIVRRRMEEG YKKIIFPLCANDHWTLVTIT GSTATFYDPMGNEPTETVKK MIDELDLEMQLAPSNSPRQR DSWNCGVFVMKMAEAYIKDT QWDLTDVDTDVKTFRRSLLT ELKAKFNIFAEDIQTYRPPS RKALTRNSQSPVVVCHKCSR PATPIQDVSRMEVEEAPVLV PTPEEPPQEWTFVGKNRKRG VTSRTPNTSPEAKRPAFPPV PLKPSANRWHFPEEETEKME VSSADEVKNSTPPKPPKIPN LLAMKIASPVPLKRGNPSKK HGKGHMMNTARKGPTKKEMP KGEPANLIVKIRSWFDEQLK MYKDEGSNLQRLTWLSDSLT AAIGKAFNGNKYIVDQIIKR NPPPLVEKGAMSTQTSRKRD EFKPRERMAQEPNEPLRIQY AKNRQKTFFKIIGKQSEQCT INIETVEQHFRKTLKAPVVS ENAIKTVCGSIKKVLMPKTI EDPISSVEVKSILTKVKDTS PGTDGVKYSNLRWFDPEGER LAKLFEECRKHREIPSHWKE AETILLPKDCSDEEKKKPEN |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | GGGGGGAGCTTGGGAACGTC CCGATCGTTCGGATGCCCAA CCACCGCAATCTGCCAGGCA ACGTGCTTCGGAWGGTCATT GGTTCTAGACTTGTAATAGA CCATTGGCCGGAAGAGCACA CGCGCGGTTGGTTGGATGCC GACCGAGCCTAGAGGGTGCA AACCTGAAGGGCGAGGTCGA AGGCCGTGAGGCTCCCGGCG GGAAACTCCGTCATAGTTAG TGGTGTGCCTACACCCGACG ACTATGACACATAGGAGGAA TCCTGATCTGATATGATCAT GTATATAGGGAGGGCGAAGG TAAATAGTCAGKGTCAAAGT CCACGTGGCAGCTACTCCCC AGCATAGTAGTGATGCGAGT GGAWCCAACTTTGACACTGA TGTTCCCTGAGCCTGACCCA TCTGCACAAATCAACAGTG TATGATGGCCCACACACTGA GGACGAGTATCACTTGTGAT ACTCAGAGGTGTCCCCCATG ATCAACCAATATCACAGCTA GCGGACCTACCGTGAGGTAG ACCCCCGCCGCTGTAGCAGG CTCGCCCTC (SEQ ID NO: 1296) | WRPIALMATIYKLYSAVWSR RISGVQGVISPCQRGFQSLD GCNESIGILRMCIDTASVLN RNLSCSWLDLTNAFGSVPHE LIRRSLESFGYPQSVIQIVT DMYKGATMKVKTADQKTQSI KIEAGVKQGDPISPTLFNIC LEGIIRMHQMREKGYDCVGH KVRCLAFADDLAILTNNKDE MQEVIDKLDADCRSVSLIFK PRKCASLTIVRGAVDKYAKI RINGDAIRTMADRDTYRYLG VKTGVGGRASETEALIQVVK ELQKVHETDLAPHQKLDILK TFLLPRLQHLYRNATPKLSE LREFENVVMKSVKRYHNIPI KGSPVEYVQIPVKKGGLGVL SPRLTCLITFLTSTLCKLWS DDPFISSIHKDALSRITVKA MGLTTQSATIKETCEYLNTR KAVTKGGYSLFCRMNESLRT LSVIQGAPLKSMEFIPVNNE IGIAVQATKDSEIKVFTKAD SLKLMSKLKDLVRSAMLKRF LEEKSVKSRVTQVLQHHPQS NRFVRDGRNCSIAAQRFVHP ARLNLLSCNANTYDVNHPKG CRRCQADFESQQHILQNCHY SLAGGITQRHDRVMNRILQE IGNGRKAHYKIMVDMETGAT RERPDIIMEERDGPEVLLAD VTVPYENGVQAVERAWDKKI EKYKHFLDYYRKIGKKATIL PLVVGSLGTYWPDTSHSLKM LGLSDGQIRNVIPEICQIAL ESSKNIYWKHILGDSYKTVE GLFCQRNNKEVRFEGKGEKH HVSQRFQPLKCEKVRTMKST KEEGRSRSNAKKGPNWRRSK SESDGRSVSKGRYWRDPSNK PPHSKMTQSALAKR (SEQ ID NO: 1418) |
| NeSL | NeSL-2_CRem | . | Caenorhabditis remanei | CCAACTCTCATCGTATTAAC CTACGGTATTCACTCCTAGT GAGTGTAATAAAGGTTAATT ACGTTTTCTCTTGCMAGAGA AAAAGAAAATTCGAATCCTT TTTGTGTAACTCACAAACTG ACAGAGACCTATCGAATTTC CTTTGTTCGTATATAGGAA TAGTCACTCTGGACCACGAA GTGGACAGTTGTCGGCGGAC TTCCAGAGTGGAGAGAAAAG GTGTGAAGAGGAGGTCTA GAAACTTCGGCTGTCTAG GACCAGTTCCTGAGTGGAAA GAGGAAGGTCTAGAAACACT TCGGCTGTCTAGGACCAGTT CGTGAGATCTCTCGTGAGA GTTGAAAACAGTCAGCTGAG GCTACTGTATTTCTTGATAG CCCCGCCCCAATCCCCCTC CCCCCCCCTCGACAGATTT TTCTGTTTGACCTCCTGGAA TTTGCGAGGAGTGCGCGAGA ATTTTCGAATTCTTCGCGCG TTTTCTGAAATTTTCCAGA AGATTCGAGCGGAGAGTCTT CGAGAAAGTGAGCTGAATTT CGCGCGAATTTTCCGCGATT TTCAAATATCGATTTTTGT CGGAAAATTTATTTTCTGGC AAAATTTGATTGAGTTCACG | TGAATACCGTCAGATAAGCC CCCAACATAAAAATAAAAGT CGGCGTTAGCTAACCACTAA ACCGGCTCCTCATTGGGGGA GAGTATCATTCCGGTGCTCT CCGTTTGGGCGGTAGGGAGG AGTTGGGTAGCGACCCGGAA GTATGGATGCCCAACCACCG CAATCTGATCTGGCATTGTG TTTCGGATGGTCTCTGTCTC TAGATCTGAAATAGAGCTCT GGCCTGAAGAACACACGCGC GGACCGGTTGGATGCCGACT CGATCTGGAGGGTGCAAACC TGAAAGGGAAAGTTGAAGGC CGTGAGGCTCCTGGCGGGAA ACTCCGTCAT | MTNVYLKPVNDNQTNKTGDN SRNTMSNSQCEMTWKPVART YAQAASTNPADDKTVTVLGC KYNLLKLGNTPQTSKRSPPK PSRGGARISSVYTLTDELEI THREEGKITFAIDLPNKNNI LCPLCRECTQTRGRGSSFTK HMKLHVKEKHQLDATFIYKC SMCNEYEPEKKCGTKWIQTH LQKVHNYKYDESAIVVPVPP NTRQQIANELNNAAPFVDIR KPKAAAVEEKKTENGALLKF LTKSNKDDQVKSPSXDIPDA ESPEKETQALTIDPKGNNSP SKSSIRSSQSSASSVCQEIQ EIITLSEDEDPKGARPKPGI NVWSUNETGKDAYIDTDIMM AFLKMRVENCDSVNIIDPLN YQFPARVDLVPUQRNLEDGK KRWFPICADEHWTLLTISNG IAAFYDPTGSRMSSYIEELV NELGLIIPKEQDEQPRQRDS YNCGVFVMKMAEAFIQDTEW EMEEVEEDVKNFRRNLLEEL KPNYEIFAEKIKYYNSPGKS FAQSRPTSRSSQCAVCPTCS RSATPMMDVGNMEVDPVPQQ QETPKSREPEQDEGWKVVGK ARKRGWTERSPNISPEAKRQ FTGPEIKWSPGKFHPLVGET EEMEVTCDSPPTKEPTTEPK |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CGGGAGAGAAGGAATTGTTG GAAAAGGGTATTGATTTTTG TGGCGGAGGAAACTCCCACT GAATCAATAACTCTCAAAGG AGAACTCATCGAACAACCTC GGGTGACCTGAATCTTGGGC GAAATTTTCGCATTGACACA AGATAAMACAAATTACTGTK GAAAATAAATCAGAACAAAC TGTCAAAAAGAGAGACAAAA AGTATTGATTAACAACATC (SEQ ID NO: 1174) | CGCCGCTGTAGCAGGCTCGC CATTG (SEQ ID NO: 1297) | VTPSLPAMKIASPEVTKKQT SKKKGKYGKKKQXTKKAQPP KGEPTKKAQPKGEPAKLIEQ VRTWFDKQMKSYQEQGSNIQ TLTWIADSLTAAIFKANSGN KYLVDKITARCPPPLLNEGE MATQTSRRTEAVKPKDRFVK ESNEPLRIQYAKNRAKTFNV IIGKHSARCEIDINVVENHF RQTLKAQPVTEEALNTVCSG IKKAKVDPSIEGPISSGEVK AILAKIKDTSPGTDGVKYSD LKWFDPEGERLALLFDECRQ HGKIPSHWKEAETVLLPKDC TEEERKKPENWRPISLMATV YKLYSSVWNRRISSVKGVIS DCQRGFQAIDGCNESIGILR MCIDTATVINRNLSCSWLDL TNAFGSVPHELIRRSLAAFG YPESVINIISDMYNGSSMRV KTAEQKTQNIMIEAGVKQGD PISPTLFNICLEGIIRRHQT RKTGYNCVGNDVRCLAFADD LAILTNNQDEMQDVLNQLDK DCRSVALIFPKKCASLTIK KGSVDQYARIKIHGMPIRTM SDGDTYKYLGVQTGNGGRAS ESESLTQIAAELQMVHDTDL APNQKLDVLKAFILPRLQHM YRNATPKLTELKEFENTVMK SVKMYHNIPIKGSPLEYVQI PVKNGGLGVMSPRFTCLITF LASTLFKLWSDDEYISSIHK KALSRITAKVMGLKTQKATL QEQCEYLNTKKAITKGGYSL FSRMNEAIRTLSVNLGAPLK SMQFIPENGEIALEVQASEN SQIKVFSKADSMKLVTKLKD LVKSAMLKNFLENKKVKSKV VQVLQHHPQSNKFVNDGKNX SISSQKFVHPARLSQLVCNG NSYSKDLPKNCRWCGYECES QAHILQHCTYSLSSGITQRF IDRVLNRILXEVIKGRKNND YYDIMVDTEPGPTRERPDII MIQKDGPEVLLADVTVPYEN GWAIEAAWDWKMEKYSHFID YFARLGKRAVILPLWGSLGT YWPDTSNSLRMLGLSDGQIR NLIPDISMIALESSKQIYWR HIFGDSYRIVSDLYCRKDQQ EIRFGDEPMENVQVSDRFQP FKTREREKKSEEEKKRRSKS KKGKTWRGSKKQTDSRQSGK SNQNQGFQRSVGQGVSR (SEQ ID NO: 1419) |
| NeSL | NeSL-4_CRem | chrUn | Caenorhabditis remanei | CCCTTTTCTATCGTATTAAC TACGATAACCGCTCATTTGA GTGTAAAAAGGTTCCCCCC TCCTCGCCTGCCTTACCCAC GCATCTCTGCCTCTGGGAAG GCGGAGGGTCAACTTGCGGG TCTGTGGATTTCCTTTCCTA TCCACCGCCCATATTCTCTG TCGAAAGCCTACCTAGATCA GCCGGGAGTTTTTCCTATCC CATTCAGGCGATCGCTCAAG GCTGTTTTATCGACACTCCT TCTTGACAAGTATTTATTTC TTGACAATTCTATTTTTCC TTTTATCGATTTTCTCTTAT TTATCGATTCTTGTGAAAAT (SEQ ID NO: 1175) | TAACATGCCTTGGAAGGCAC CACGCCAAAAGTCCTGGCAA CTGATTTGAATAATGTATAA AAGTAACTGGAACCAAATGC CCGATAGGTAGGGCGGGAGA AAATGACCTAGAAAACACAA AGTCCCAAGCCCCCGGATTC GAAAGACCTATAGGAAGTCA GTGAATAGAGAGAAATATCA AACAAATCTCACCCATTCAC AAGGACTTACTGGTCGAGTA GAAACAAGCCAAAACATCA GCACGACGCAAAAAGGGGT AACTTTGGGCAACTAATTAA CGGATACCTCCGTGTATCAG GCAAAGCCGCCACCAACAGC AAATTACTGCCCGATAGGTA | MTKTEWSWRHRSRSRSVGIV VKIDTSDYANVRVHVAADLS NEDGHTSHNNGIILPIPMKP SVDRFCQIQYPPRGYYVPHP QSQKGHDAKPSRHWNEEAQP PYYHNNNHGRRGRSAKPSGR RPPRKPILQEESLAAHPQIP GDTASAVPLYSDVVNNENKS QGKPPQGSHRRSGRPGTKPS VPVGEAEQETNSRPIAPEPI VKFKHDKHGWTTVQGSHSSG RPVPKPSVPVVSEANRFQLL QEGDFPPLTTSESSSQEEIKV PNYQRIVSPIPLPSEEDSKL PTKSNYRAPKGRKSRNYKKP QQQNPKKYQQRLPYQPKVNN APTDRMAPEQLKGGGGKTAH |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | GGGCGTGAGAAAATGACCTA CAACCTCCAAGACCCGAGCC CACGGAATCGAAAGACCTAT AGGAAGTCAGTGAATTGATG GAAATACAAAACCAAATTTC TTCCATTCACAAGGACTTAC TGGTCGAGTAGAGCACAAGC CAAAATATCAAGTATGACGC AAAAATGGGTAACCTTGGGC ATCCAATCAACGGATACCTC TGCGTATCAGGCAAAGTCGC CACCAAACTGTACTACTCCG AAAAAACCAAGAAACATGAT TTTCCCACTCCGTTAAAGCA TCTCAACCAAGCTAAAGCGG TAAGGTTATCATGTCAAAAG GTGTAGCTACAGCAACCTAA AGCCCGAAAGGTAGGGCCGT ATAAAAAGACCTACACCCTC CAAGACCTAAACCCACGAAC TCGAACGACCTACAGGAAGT CCGTGAATGGAGAGAAATAT CTCACCAAATCTCTTCCATT CACAAAGGCTAACTGGTCAA GTAGAGCACAAGCTAAGCCT CCAAGCACGAAGTGATATGG GTAATTTAGGCAACCAATCA ACGGATACCTCCGTGTATCA GGCAAAGTCGCCACAAACAC TGTACTACTCCGTTACTCCC AAACACATGGATCTCCTTCT CTCACCAAAAAGCTTTATAA CCAAGCTAACGGTGGAAAGG ACATCATGTCACGAGGAGTA GCTACAGTAACCTCTCTCTT GAGACTGCAAAGTCGAGGAT GGATTGGGAAGGCCGCGAGG CAAAAGGCGGGTAACTCGGC CAGACGCTAGTGATCTTCGG ATCCGACAGCCCTGGCCTTA GAGGAACCCTGGGATAAGGA GCACGACGGGAAGGATGTTC CGCAAGGATTTCCCTTCCCA TTAGTCAGGGCTGGCAGTTG GTAATATAGCCTTTCTACAC ACCACCGTCTTGCACCCACT AAACCAGTGGGATATGCGGG TGGACTCAATGTAGAAAGGT GTTCCCACTGCCTGACTCGC CAACTTTATATGTCTTGTCA ACATAATGGCCCCTCACTAT AAACTCCCTAGCAACTGGTG GTCCGGCGAAGCCGGTTCTT GCCACTATTGCGCCCCAGGC TCGCC (SEQ ID NO: 1298) | NDIEEMEIEEDTDEKIIQVK RIKIVNKLTPHHFVCMMTYP TDNIYRCFVKGCTATSQGGW GAEDLKYLTVHIRQEHKIKV EWTYECGICGDLSGGAGKHI SKWIKPHMRKKHNRDAPTNF KMGSRSSGKPKITELLEESA PSCSNPRRKTLNQKKTAIIT QVTPEKLKTGYQTRSVTKAL SVLKESRQKELEVLREEEKA NAKQKSLHPFFTKAPHIDG VKPTVRRELSKMITPGGEHK GTKIPMVHTKRGLIQKINRK AKKAKPMHLDESTIIEASQL DVITIDDDEDDNMTPMRRR FNTWCLDHETTQEAWLTDDV INWYLKDLCFGNEQYMLVDP LVWLIYKMGGMAGVEQRFKS KKTCLFPICEADHWILLVFD ETNLCYANSLGSQPNGQVKN FIQQLNRKLCSFEKEVPLQK DSVNCGVHVCLIAKSIVNGQ FWYDDSDVRTFRTNAKAALK AQGYELFSEAPKQIENPDSS HREDIKENSMEMCSESLMIV ATPQRSEAPMELVDTEPSDL ESPKSDRVVYEDCITALSDV SEPRMTPEKSETPEVPVVEE RDLDWPKLESPKSDRVVYED CITDLSDVSEQRMTPEKCET PEAPLVVECVELERLPKDLP VTDRSTVVAIPEAVKLEEKS EVVIPRLMELSYTVPPEPSP VVEYTQPYTHTHTKPKVKAT CQMGKKRKVPTGKPDELIQI VRQWFEKEFNDYVTEGRNFQ RLEWLTNLLTAAIQKASAGD EETIEKIRKRCPPPEVRENE MSTQTSQRQKPTTTNQKKRS RNTTQSDTQANTYWRNRAKT YNQIIGQDFKQCDIPIAILE EFYKKTTSVTNVPQETLVKV TSRLPRLDIGKWIEDPFTEQ EVFGALKKTKDTAPGTDGLR YYHLQWFDPDCKMLSSIYNE CQHHLKIPAQWKEAETILLF KSGDESKPDNWRPISLMPTI YKLYSSLWNRRIRTVKGIMS KCQRGFQEREGCNESIGILR SAIDVAKGKRSHLSVAWLDL TNAFGSVPHELIESTLSAYG FPEMVVHIVKDMYKDASIRV KNRTEKSEQIMIKSGVKQGD PISPTLFNMCLETVIRRHLK ESSGHKCIDTRIKLLAFADD MAVLAESKEQLQKELTEMDE DCTPLNLIFKPAKCASLIIE FGKVRTHEQIMLKREPIRNL NDDDGTYKYLGVHTGADARTS EEELIISVTKEVDLVNRSAL TPPQKLDCLKTFTLPKMTYM YANAIPKLTELSAFANMVMR GVKIIHYIPVRGSPLEYIQI PTGKGGLGVPCPRITALITF LVSTMKKLWSDDEYIRKLYN SYLKKVVEAETGIVEVSTKD LAEYLSNKVPSRKHEFGYNC YSRIREVCNGLALNQAAPLY KLEFIEQDNELAVVVQPTEE SKERIFTKDHVKKLQSLLKA SVNDALLHRPLTTKPVKSEV VQVLQQHPQSNSFVRMGGKV SISVHVWIHRSRLNQLTCNY NIFDPKQPKNCRRCGYKNET |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | QWHILQDCTYGWAKLIRERH DAVHHKVVTMICAGAKKNWG RKIDQELPGFTSLRPDICLT SPDGKEVIFADVCVPYSRTR NIEFAWKEKIRKYTEGYSHL VAQGIKVTVLPIAIGSLGTW WTPTNESLYQLGISKSDIRS AIPLLCSTVMEYSKNAYWNH IYGNSYTSVPLRYGHQKPDG DDWKKELSCEPVLALQQ (SEQ ID NO: 1420) |
| NeSL | NeSL-4_SM | . | Schmidtea mediterranea | TTAAATCATTTTTAAATGTG TTTGAATATCTTAAATTATC AAATCATATTAATATCAATG CTAAAAAAAATCGTGCKCA TCAGGCGCACGAAAATAATG GACACAACTCGTCGACCTGC TGTCGACTCACAGAGAACCT CAATTTGGAAGAATGGGAAG CCTATAATGCTACAATTCCG CCAACCCCTATTTGAATGAC AGATAGTCAAATATCAAAAA ATATACAAACTGCTGTCAAG CGTGACTCACTTCCTTCCAA TCGAAAAATAGGAAKATGTA AGAAACATGAAAGTCAAGCT GAAAAACCAATAATATGTCC TAAAATAAAACAATTTGAAA ATATGCAAAAAATACCTATA AAATCACAGCCGAATAAATT CCCATCCGTTCTAAGCAGAA ACCGCTACGAACTACTGCAA GAATCGGATCAAGTATATTA ATTTCCCCCMGGGGGAAAT TAATATACTTGTTAKAAAAT TAATTTTTTAATAAAAATAA ATAAATCGAATAAATATAAA ATAAAAATAAATCAAATTAA ACTTTTATTAACAATAAAAT CGCAGTAAGTAAATTTCCAC TGTTATTAAATTTAAAACAA AATTCCTTTAAAAATGCCTC TCTTTTTCAGTAATAACACC TTTTCTTGCTTTTATTACTA TTTCTTGTGTACTGTACAAA TCGAGCACAGTTATTGCAAA TAGGACATAGAAATTCCTTT TTAAGTAAATTTAAATCCAT GAGAAATAAAATAAAATCCT TTTGATTCAAAGTTTCTATG TTGCTTTCTAATAGAATGGT GTAAGCATTAATGGGTCTTG ATTTTTATAAATTAAATATA TTTAATCTATTAAATTAATA TGTTTTTATTAATTATTAAT TTTTATAGTGGGGGGAAATT AATATACTTGATCCCAAGAA TCAACTGATGATGAAGAATA TGTTATTTCAAAATACATAC AAGAAGCTGGAAAAAACAAA TCAATCGCTACA (SEQ ID NO: 1176) | TGAGTGTGCTACGAGGCAGC GCTGGTAATTGCATCGGCGT TGCAAGATTTGTGTACGATAG ATAAAAACCAATAGTAATAA ATGCTGAGCCTAGCTCGCAT ATCTAAGCCGAAAGGCAGCA TATATATGAGACAATTTAAA AAAAAA (SEQ ID NO: 1299) | MNVDLDATIKSIGMNTKETT YPNSQLRVETTPCTSTTIMH ASCNTTSTISYSPLPSAVSL PESPASSITITTTDDNCDII ETPYPLPQTNGDLSEILKDI EANKDTTMSNKVLDCDSDSG DDRDMIIENDRESDMDLFSQ SLLNTNQSDERREKNLTENA PTEITTEKSYFDIISKASDN TTSKKLLNVKNELTAGLPPM PPVTNTAKFIRNVRPEDIAD PTLYRLDSRGKLGCRTQYKK PGCGDIAVYDYEAIVEHAAF IHTIPFNEQNNVDCQPCHPK KGKDVHTIVLIKYADIFNHI EAHSHVVQTAITDNMKTYLR LTKENXFYCSYRNNKKKNKC KKAFNLESNMMDITEHMKTH TGYSFDXNLNILCYCGIWKP FTELIAHIKTEHLQEYINSI PNKENIHNTTTIVSPLNFAG ILASGETQNIPDEEIIKPRD LPENLAFNRNIENELSWSQH LVKAYIFSYAVKTSTIFINP YTCNALIQCNYKTFFETFPF KDFAKWNEIVLPIHNNTSSW SFFFLNKKKRVAMIIDPTAD DSHTLHFELATDILRTILNV QNIFEDLNFPLTEVEYPVCH EANLSAFXVCHFLKCLMSDL PIDIPDIDHMKETMRPIIRK YNCAKFPESDVRNYRVLIED LIYQLNLDTITCEEILCEIE RINGRLNPKRYFKESKPKTD IIHLQKKKSAELLCVKRLKF QISQKTEIGKIWENDDVDHR PPMARFLKTFASQDCPVSNT SSINLPYYMDTDTDXCTDCE NLSHIMKNLDSSAPGMDLIT GGDWKKISPKHELITAICNC ILRNKVCPEKWKLFRTVLIL KPGKMSESFRANSWRPLAIM DTAYRIFTTLLNNRLLQWIR NGNLISPNQKAIGIPDGCAE HNATLHFAIDRAKRCKTELH IVWLDIADXFGSLPHDLIWY TLANMGLKNETLTLIKELYK DVKTIFDCQGTLSEPVPITK GVKQGCPLSMTLFCLSIDYI LKSILTNYPFLLHDLNISIL AYADDLVLLSDSYLEIKKSL ESTVELAAFANLKFKPSKSG YLSINNVNSDILKLHLYNEE IPTISENNKYRYLGVDFSYK RNQDVDGRLGSALALTRSLF KSYLHPAQKLNAYKTFIHSK LIFSLRNCVIGHRILDCDRN RVTQGREKQLGFDQEIKALL KTMIGDKFQAXNNYFPYTHC KLGGLGITSAIDEYLIQSIT GITRLFHSSNLSFRKMLITE LAHSRGGKNFEAGLKWLNCE |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VNKAFPNTSFFVKFQKSALA LKRKFCICVNLKFVEDNFSL EMTYKKRTSYVNHQNLSTLS KELHDFVGLYYAEQXCQMRV QGHIATAIGDSITAKYLIAS DILNDAQYYFLVRARNNLLN LNYNAYRLKYNIGTKCRLCH LDEETQAHXFNHCRAKPNAR RVKHENVLVSIVAFLEKIGF EIDVEKSPKYISIPTKLKPD MVIRSKRNKDIHVLDLKVPY DSGEGFEKAREDNYVKYKDL AIEIGKAFNQKATISAVVIG CLGTWDKKNNAALSKIGLTK TEIISLARIACPNAVIACYH IYREHVSFTKSAMALPFSLA (SEQ ID NO: 1421) |
| NeSL | R5 | AY216701 | *Girardia tigrina* | GTAGGTAACTATGACTGCAA AATAATAATTCTACACCTAT TGTTGATAACTCATCTCGTG CGCAAACGGAGCATGTTATT TCTAATCATTTCGTCACACA GGATTCTTCTAATTCTGATA GTAATATTATAGATAGAGAT AGGAACCTTGTTGATTTAGA TGCGTCAATAACTTCTCCTA CTATTATACAGCCAGAGGAT AGTAAGATATCTGAGGATGA GGACTTCATCTTAGTCAATA GGAAAAAGAGCAAAAATAAG AAAAAATCTAAGAAAACAAC TGAAAATAAAATGAAATTC CTATTCAAAAGAGTAAAGAT AAGAAAAAGAAGTCTAAAAT TAATACCGAAAAACTAACTG AAAATATTACTACTTCTGAA ATACCACTTGAAATTGCTCC TTCCATACCTTTACCTTCAG CAAGTACCTCGGGTTCTCAA CAACCGGCCAATCCTCCAGA AGACGCTACTCTAAGTGATA CGGATCTCTTCCTTACACAG GATGATCCCGATAGTCTTAT TCTTTCTGGAAGTACTCAAC CAACCTTTGTTGACCTCAAC CCTTCACAGCAATGGAACT TCCTTCAAATACTGACAGCC AAAGATTTGAGGCGGGTGAA ACACCCAAAATCATAACTTC TTACAGGGATGACCTTTTCT ACTCTACAGTCCTTCACTAC AACTCAGATACAGGTTACGG TATAAGTGTTGACAATGGGG AGCAGAGGTTTCGAATTCTT GCTAGGAATCTTGTCAGGAA AACCAAGGATAAGTTCCCCT CTTTATATGCTGGACAAGTA ATTAGACACACAGTCTTCTT CAATCACTTCAACCAGGCAT ACTACGCCAATAATATAACT GATAGTAAGGTAATCTAAT TGAGTTTTCTGATGATAAGC CTTTTCAAAGTATACCGACT GACCCAAAAACTGAACTAGA GCAAATTAGGAGAGAGAGAC AACATCTAGTTGATAGAGCT CTTAGACATAATCAGTTACG GGAAACTTATATTTTAAATA | TGATCCGTGTGTTTGTGTCG TATGATTGTTTCCGTGTGTG TCTATATTTTTCTTTTTTAT ACTTTCAATTACCTCGTTGT AATGTTATAACTTCATATGG AATATATGTAATTTAGTTTA GTTTAGTTTAGTTTAGTTTAG TTTAGTTTAGTTTAGTTAGT TTAGTTAGTTTAGTTAGT (SEQ ID NO: 1300) | TTGRNLGQWSCYSRSIQQSN YSFKLSSTEVGELVEQSPAP LQSPQFSNNYNNLNINNNLY YSLNTFNQSNNLCCLVNIEF FPTQHLLGDIVNSGCINYMN NYNNFDNINLYINSNVLSYN NYNHSFLASPYTTNITEHAD INMHVQEVNMQQDNNTQHAI TQQVSLQATSLQHTLDEMIV QFNTAVRLKKKHKVAKIFRG HNHRKDLPTLPAREQYKTKP KLAIREVLHRKTTATSSPSE NAIKAFFSSYSRPAELFTGQ ELLESSWFPVHPEDDFEFRI PGRDQIAKYIKFASKSAAGL DWITYEDIKLGDPSGEILQP IFEYIVQNNICPSEGKASRT IMIPKPGKSDYSDPSSWRPI TITSAVYRLLMKYLTWELYN WILLNQMLSRSQKSLGKFEG CHDHNAMLNMLIQDVRRQTN PSNPINKNKRLYIVFLDFTN AFGSVPLDTLMYVPQRFGLG TSALTLIKNLYLDNYTNVTC GESKIENVKLNKGVKQGCPL SMLLFNIFINIIIRAIEAMP DVHGYPLGDMDIRILAYADD IALISDSHKDLQEMVYKAEY IGRILGLLFNPSKCALMDIP HDKKRTPPILVNGEMIKCVG KADPYKYLGTFRSWFRKLDI KELLQMMMDETKLITESNLH PHQKIHAYETFIHSQLPFHL RHSRIPFSDFITNRKTNKTT NNSNDSEKSIQKAYDPESGQ LFLNTFALPSGCAKDFFYIT KDAGGPQLTSGLDEYLIQSI MYIFRLLGSEDPTLNSAIKH DLISHLNLKGFVNINFSQAI SIFNSNFTDRTDHFSHLSRT EWARLQLARKKLKSTLAIQT NVCLINGHLVLTLSLENNVL LIDSKEKGDVKKIHASLMGF LRLAHLIRLQKHGWSKLLFS ATTHHEILNKRILNGHVPYK IWYFIHRARLGLLPTKLFSV SNLCRKCGGKKETMSHALVN CPMMQTLINERHDALEISLV QILSSKFQGTVIRQKTYVNE LRPDITMESDTQYYLVEVKC PFDTKMSFELRTQQTTDKYN |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | AACTTAATAATAATAATGGG GGGGGTGGCGAACATTTGAA AAGGAAAAAGATCAAAGTCA ATACGGATGATGTCTCCAGC AATGATGGAGACAGAAAACA TAG (SEQ ID NO: 1177) | | IIIEILEDVHPGKEVRLVTF IVGTLGSWGPQNSDFLRDLG FSKDEIDQVKTRLMLQNINS SCEQWKRFVQYAPTITPGPI PDAESEDDQGTSDNGPTAAT VQGPVIGDEEEELQIYDSGL DESSSDDEPDPDDAELLFTID IEQYLNSVITD (SEQ ID NO: 1422) |
| NeSL | Utopia-1B_CP B | . | *Chrysemys picta bellii* | GTTTAATTCCTTCTGATGGA CATCTGCAACACCCGTCCTG AAG (SEQ ID NO: 1178) | TAACCGAGACCGCCGACCAG GGAAATAACCCACTTCCTTC CCTGACGAACCAAGGGACGC ACCCCACCCATGTACTTATT CGCTACACCGATACTGACTT GGACTCCTTATACATTCCAT GGGTGGCGTACCCGAGCCCA CTTATCCACTGACACTTTAA AAACTCTTGCACCCCAATCT GGGTCTATGCCGGTTATGCG ATATGTATGTATCTCTTCAT CCTTGCAACCGATACCTGTA ATCCCTCATAACCCAAGCCT GACCCCAGATGTACAGTACC TTCCCTCTTAACTCGTGTAT ATTTAATTTTAAACATTAAC TTTAATAAAATTTTTAAA (SEQ ID NO: 1301) | MESPAXIFEKIDAALXIYSA AAXLXXNSLSLSPXXAXXSX XAAPASSTPQKTQXKPIPXT TLGASRKXRTTXKDEXIXXW XKKAPVDTSXGRXSTRRTAL RDLTSRSXNIXXALQEEDPR RTPPXSRDQDAERRPAAPEK AATRGAPPTIQDQDADRCPA GRDATGGAPRRPRTRMLXAA PLGRMPPEEPPPTTRDQDAD RRPAAPERDAPEGTTSSTPD PETTYHPPVRRRAAPRGTHS XAXDLDAARCPSGQRDIVAS ESSTPPGATSPPQASLPDXE ESPAESAGTTEVRPTEGEAG EDDCIYLQYPXPTGLLLCPF CLPXHGVQTLGALSKHVRKA HNKRIAFRCSRCDAPFETQK KCKXHXATCKGPLTTAKVNP TDTLRVPTPTPTDGPASAPQ PASPEPQXVRGDQPPTEGSA TPASRTDDATKRTSPASRIP TLDPAVRGITATSQVSDLTR CLSDLIKTIRHNTDTRRXSA PPQVTSCRPAVGATSTAPQA ARRDPANGGASRSPQIPRPD PAPGRPNTSSKVTQRDSDRQ KPHAPPRTPQPDTTRRRTRT IPSASKHDRAPTKPNTGVSR TPLPPGRSSAASETPRAAPP PPHQDPRLKTHLNTAPQSEG QQGHRLSPQHLNPRRQRSRR NDGREQRVATPWQSAWMEEL AKAEDFETFDTLMDRLTAEL SAEITARRREPQEASRATRR FPAPTRNNTAREGRRGDVGR RYDPAAASRIQKLYRTNRTK AMREILDGTSSYCAIQPERL YSYFKDVFDHEAQTNLQRPE CLLPLPRINLTEDLERDFSP QEVQARLMRTKNTAPGKDGI RYHLLKKRDPGCLVLAAIFT KCKQFHRVPRSWKKSMTVLI HKKGERDDPGNWRPISLCST IYKLYASCLAARITDWSVCG GAVSSVQKGFMSCEGCYEHN FLLQTAIQEARRSKRQCAVA WLDLTNAFGSIPHHHIFATL GEFGMPETFIQILRDLYKDC TTTIRATDGETDAIPIRRGV KQGCPLSPIIFNLAMEPLIR AISSGPTGFDLHGKKISILA YADDLALVADSSESLQQMLD VTSQAAEWMGLRFNPKKCAS LHVDGGARALVRPSRFLIQG EPMASLEEGEVYQHLGTPTG VRVRQTPEDTIAEILRDAAQ IDSSLLAPWQKINALNTFLI PRISFVLRGSAVAKVPLNKA DSTIRQLVKKWLYLPQRAST DIIYISHRQGGANVPRMGDL CDVAVMTHAFRLLTCPDPTV RSIAQEAVRDVVRKRIARAP SEQDIATYLSGSLEAEFGRE |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | GGDLSSLWSRARNASRRLGK RIGCCWKWCEERRELGILVP RIKTPDHTIVTPTARAMLER TLKDAIRCHYAENLKRKPDQ GKVFEVSSKWDASNHFLPGG SFTRFADWRFVHRARLNCVP LNGAIRHGNRDKRCRKCGYA NETLPHVLCGCKQHSGAWRH RHNAIQNRLVKAIPPSLGKI TLDSAIPGTDSRLRPDIVVT DAEKKKVLMVDVTVPFENRS PAFHEARARKALKYTPLAET LRAQGYEVQIHALIVGALGS WDPHNEPVLRACGVGRRYAR LMRQLMVSDTIRWSRDIYTE HITGHRQYHTE (SEQ ID NO: 1423) |
| NeSL | Utopia-1_ACa | . | Acanthamoeba castellanii | CCCGTCAAGGGTGCTCCACG AGATCCCTGTCGCTAGCCGA CCGGTTTTACCACCCCACCC CGCCCGGACAACCACGGACC CTGCTCCGCAGCAGGACCCC ACGCACG (SEQ ID NO: 1179) | TAACAACCATGTATGGTGAA CCACACCTCTCTCGATCTTG TATTCTGTGATTGGACATCA GAGTTCCTGCGAAGGGATAC ACTCTGCCAATCTCGTGGGT TGTAATAAATCCACACCTTC AACA (SEQ ID NO: 1302) | MAAKSVACPHDGCANKYASE ASLRRHIKNKHATDEEGDET SHSCPHCRPFSTARGLSVH IGKSHRQAPPEPTRPPPAPA PADPGLDPDPGPTVTPPSRD DEDREEPDDDPVEIADLSCP HCAQALPSAHGLANHLRACK DHRVPAPGAPRSGPPSSRYW TAVEHHRYVEAMARFADHPD LLARAAAHIGTRTYKQVDSH RTKVIAAEREGRPVRTLDPT MDWRMRPYCASTTARWLAEQ GRSPVAPRSPCPEPHAPPPA AALLYIPATPPAPTPRAPVA PPKLAPPAESTVPATPDGNP EAPAPPFSAPGPPTPKALPP PPPSRRNLRPHLVPKDAWQG VADAVAPAASRLLRTPLAHL STEQWATFEAALAGLEATLH HAARSAEAVPTRCASRARED AERQLREARKTREIFGKAAA LYAAGKDPTATIERIPPEVR LHLPTPGSAEWPARAAAARR VIRRAVARADRLRKRMGILD SDRDLQRLFNANQKKAVRQI LAPSTKAPRCQLDPAAVEEA YIQTLAKPPPIDSPPWKNS VQWPRPPTAADDGGSPFSVA EVRAQLRRLPNGSAPGIDGI PYEAYKRTKLDATLAHVFEV VRLNARLPARWDVARTVLLY KKGDPNDTGNWRPISLQVTI YKIFTAALSKRLISWAGKHN TFSASQKGFLPAEGCHEHAF VLRSVLDDARRHKQNVYLAW YDLRNAFGSVSHDLIAWCAA MLGLPRYLRDAIGAIYRHSA LFVQVGDQETTGVIPMRCGV KQGCPLSPLLFNLCVEPALR CLRRTTGYKFYGTSITVEGQ AYADDLLTAAPSAYHAARQV ATIEEWANWAGVSFVVQALS LDAPAGKCAALAINFEGGLM HSIDPALKVQGAAIPAMSRN NVYRYLGVHVGLTDALGQAN ELLEKASRDARTICASGLEP WQKVVAIKTFILSRLPFFFH NGKIQRGRCQQFDRELRENL RAALRLPVCTTNAFFHSRVA SGGLGILPIAEEQQVYLAAH VFKLLTSPDLSIRAIARHQL AEVTHARHTTPVQDGEASPF FGWLMRGQEVASTTPSGDVS SIWFAAAGAYSRMGWSVRDA LHPTLTVGPGVQFEGRFQRA NVIPALRASAFSRHAVEWSA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LRTQGRAAAYQHAVHPATHH WVHNSAGLTTKEYRFAIKCR LGLLPTRAAPHHRNGPTACR ACSYARETANHVLGHCPATK AEVIARHNRICRALAQAAEA SWTSVLEDVPIPGVDSPLRP DIYCSRPGQCAIIEVAVSYE DAFNASMEGRAKQKTDKYAG LAATVEEQLRLQTRHAAFVV GFSGVVLPASVTATATSLDL PPKTWNVLLKRCVAASIKGS YTAWRRFRRSTP (SEQ ID NO: 1424) |
| NeSL | Utopia-1_AEc | . | Acromyrmex echinatior | GGTGCACAACGGATGCATCA TACGTGTACCGGAGCATACG GGCTGTCACGGCGGCTGCAT GCGCGATCTAGCTCGGAGAT TTTATTTATTTATTTATTAA TTTATTTATTTATTCATCGA GTGTGAGTGTTCGCGTTTTG CCGAGAAGCGATTTCGTTA AGTGATACGCGCCGCGTTCA TAGGTTAG (SEQ ID NO: 1180) | TAAATTATTTTGTCTTTGTC TTGGCCCCCCTTTTTAAAC CAAGCAGGAGAGAGTGGCCC AATGCCCAACTATTATATAT TAACTATTTACTGTGATATT TATTATTTGACTGTTGGGCG GGCCCCTCTCTGCTGGTTTT ATTTATATATATTTTTTACT CGCGTACTTTTTGTACTACT CTATTTTTCTTTTTATTTTA GCTATGCTATTTTTATCTCT TTCTTTGTCTCTATTTTCTT TCTTTTTTCTTTCCTTTTC TTTTCTTTCTTTTATTCTTC TTTTATTTATCTTTTTTTCT TTTCTGTTGTGGGCCCTGA CCGTCCGAGTGTGAATGCCG CGAAAAACAATATTATGTTT TATACGAGTGTGCATGTGCG TGATATATTTATCTATTTTA TTTTTATTTATTTATTATAAT TTATTGCCGCGCGCGCTCCT CCGGGACTTTTATTCGTTGA CAATACTGTGATATTTTCT GCKCAGGCTGGGGGGGCTTG CCCCCCAGCCCCTTAGTTTT AATTGCCTATGCGGGGGGGG CTTTTGTCCCCCGCAAATGT ATATATATATATATTTAGCG CGCGGCTTAGCCGCTTTTGT TTGTATTACCCCAGAGGGGA ATTGTCCCTCTGGGGAAAAA AAATGATTGGAAAAATAAAG TGAGCTAA (SEQ ID NO: 1303) | VCSVRGCRREDSRRFYKFKF PLNFVKVPKTIVIGSAFQKS SVSARSQNHSRSTRVPKTRQ PRTSNTIGRYTAASANNYLT VIITGNYTVPAQWICYRECT WLLSKFVNFFLTIIGYFFQL RLVVIYEGPVILDTFSNCGS SLFMRGQXSKALLVRLNRSA LAMADPQVHYIDYPLPPRVK CVKCFGAEGAGKVKGEYSDP PHLAKHLKKCHPGDTLNYKC SICDLRGTGKYPLRDVKAHY AECHVSPAVDAAGPSTRGSL GECSGAGQPTASRAAKATTR LAETVGGTDKRRAATSGSRQ LTLPFAATPSPSTAAGEARA PRSXSTTPTSRSPSYAAVTA GPPSMRSTTTSTTARSKTVA KGAAPNTTTTTARRSGEAA ATRKPPTTATVSKPRVLSVE TVRLPVDDIQRAGVQNAAKP ARAPSRPPQRTSPEAGGPRT TGAKEKCGEGAYKKLPANSG NPISTRTRRATSVPVEKSEG TARRERVSPHPPPKGIDIIL SSTSEEEGTPYQPGGVGRLR LRRKKVTGPPPKMTPREGVV TRARRSTSAPVEKSALDARL TALDRTSSRATGNPTSQIAG GLYTSRGQPERTPPARLPSL SPTTRGSPSGSLGEIRTPIS PATSLPATLTTCTVTTTTCG SPITSTGFTGGVGRLITPPS LPQTNILPTIGEEGTSPCVA VVTTHPRPTGEDAPCEAPQP VSDHQRQSIGEPRRDTDTHL ACDVATGNAHHLHGDDDHLW KPHNIHGLHRWRGEADNTXE PPPNEHPPDHRGGRNVTVRG GRHHPSLGGRSTSPLILPRP TTPEPERGQEERRLEGAAQP PTTPVVEGDNQWDGQWTVSV RRRARRQQLNDTSPSNSESP PTAGPSRSPRIAPLSALIAA STSRHETSLNLNCTNGNICM DRTPPRNILPVXAERRRETS PQDRVEGDIGYGAGKVSAEH PSAPVNRGVMSRGRATASS IVPPRANRGEGGRQHHSRRR PDAPVGQPSRDHPAPATVAR QRRRERVAARDALLDRAKDV ATIADLEAFAASVAAFFGED ASATGAAARARDRSVRSREA GARRGVKGGERPEREGAGRP GSAPADPGASGEARGDWVRE AKRLQALYRANRRKAVREVL QGPADQCQVPKRQVQEYFER LYSGGEDLAGAGVEAERPDP SSPREVSAVLGPLAEREVDR RLRRMNNSAPGPDGVSYRDL |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | RGADRGARLLTALYNICLRL EAVPASWKTSNTVLIHKKGD RGMLENWRPLALGDTVPKLF AALLADRLTDWAVTRGKLCS AQKGFLRDEGCYEHNFVLQE VLTHAKRSKRQAVVAWLDLS NAFGSIPHATIRRALIRSAV PRGLIAIWDSMYDGCTTRVR TAEGHTAPIPIRSGVRQGCP LSPIIFNLAIDSVVRVAAEX NDGYSLHGNTWSALAYADDI ALLAQTPEGMERMLASVEAE AASVGLRFNPAKCATLHVGA GNGGRVLPTSFQIQGETINP LAQGESYTHLGVPTGFSVDQ TPYAAVGDIVSDLRAVDRSL LAPWQKIEMLGTFILSRLDF LLRGARVFKGPLTAVDLNIR RHVKSWLNLPQRASAEGVYM PPRWGGCGLLPLSDLADVLT VAHAYRMLTVRDGAVRELAW ESLRGVVGRRIGHAPSCEDI ASFLSGSLDGRMRGGGEASL WSSARNAALRQSERLSLRWR WVEATEEMTLECRGPRGAAI KIPPEARGQVVNRLRSAVAE HYASRLLSKPDQGKVFEVSS RSRVSNHFIRGGSFTRFADW RFIHKARLDVLPLNGARRWE ANDKRCRRCGEVSETLPHVL CHCGIHSAAIQLRHDAVLHR LWKATRLPGVVRVNQRVEGV SDELGALRPDLVVRHEPSKS VVICDVTVPPENRWTAFEDA RARKIAKYSPLAEELQRRGY RVVVTAFVVGALGSWDPRNE AVLRLLRVGNQYAAMMRRLI VSDTIRWSRDIYVEHVSGTR QYLAPSRPSGDLATPPRAVR RRWLAEERSAQDAARRGSDS VSVA (SEQ ID NO: 1425) |
| NeSL- 1_AMi | Utopia | . | Alligator mississippiensis | TGCTGGAAAGACGGAGAACC GCTTCCTTTTTCCCTGCGCC TGGCCTGGTATTGCAGTACC TCCAGGATTAGCGCCAACTA GTCCGGCAGACTGTCGGAAT ACAGCAATAGAAAGWGAGCT GACTAGCAGCTTGCTTTCCT TCCTCCGGTGCAGCATGGGT TCTCGTCAGTCMTGACGGGC TAGGGAAGGCGGTGCTGCCA GTACGTCCGAAAGAGTGCCG GTTGCGCAAGCGACCGCGCC ACTCAGGTGAGTAGCCAAGG GTCTTACAGTTCACCGGACC CGAWAACGCGAAAACCCCAA CTCGGGCTAGTAGCCGAAGA CCTGGGTCCCCCCMGGTCA GAGTAGGCGAACGCCWGKGC TCAGAGGACGGAACGCGGAA AACACCCCCAGGTCCCAAGG ACGCCCTGATCCACTGACAA GAACGCTCGAGGCACGCCAG GAGACCCCCAGCTAGGGTGG ACCGCCGACTGCAGGTCCGG AGGACCCTCCCAGGAGGGTG GACCAGCGAACCCAAGTTGG CGACGAACCCTGACGCACCC CCCACGATGTCAGGACCCCG ACAGGCGGCGGTGGACCACT GACCATCGACCGACCCCCAG AGGCAGAGAGACTCTCAGAG | TGAACCCCCCCTCTGCACCA GATGGACCTTCACTTCGAGA GGATTCTTCAGCAATGGACG ACCCCGCTCCACCCGAAGAG GACCCCCGCGATGAGACTCT ATATGGACTGAGACACTTTT TCTTCGAACCACTTCCTCCA CCATTGCGGACCATTGTAAC GGGTTTGTGTGTATCTATCT TCTTTCTCTCTCAGCGTCGC GAACCCCCTCCCTCCCCTTC CCCTCCCCCTCCCCCCCACC CCCGGGCTTAGTTGGCTAAC ATTGTATCTCCTGTAACCTA GTTGCGTTCCCCTCCTCACC CCCATCCCTCTATTGTTAGT CCCTCGCTCGGGCGCTCTGT ATTTCCCTACCGGCTTTGTC ATCTTTTTTGGATTCACAAT CCTAAACATCTACTAATAAA AGTCAATC (SEQ ID NO: 1304) | CHHAGLRPGTPNRTRRPDQT APLPDPRGHPMPPNRRGSRS RPEEPSRREPPXPRACQGLR VWSPPQQRMPTPWQTLWLEE LSRATTFKAFEASVARLTEE LSAAARPGQPRGGNNRPATR RDHRLQPQRRPRRQRYDPAA ASRIQKLYRANRPKAVREIL EGPSAFCQVPRETLFNYFSR VFNPPAEAAAPRPATVEALT PVPPAEGFEDAFTPQEVEAR LKRTRDTAPGRDGIRYSLLK KRDPGCLVLSVLFNRCREFR RTPTTWKRAMTVLIHKKGDP TDPGNWRPIALCSTVAKLYA SCLAARITDWAVTGGAVSRS QKGFMSTEGCYEHNFTLQMA LDNARRTRKQCAVAWLDISN AFGSVPHRHIFGTLRELGLP DGVIDLVRELYHGCTTTVRA TDGETAEIPIRSGVRQGCPL SPIIFNLAMEPLLRAVAGGP GGLDLYGQKLSVLAYADDLV LLAPDATQLQQMLDVTSEAA RWMGLRFNVAKCASLHIDGR QKSRVLDSTLTIQQGQAMRHL RDGEAYCHLGTPTGHRAKQT PEETINGIVQDAHKLDSSLL APWQKIDAVNTFLIPRVAFV LRGSAVPKTPLKKADAEIRR LLKKWLHLPLRASNEVLHIP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CCCGGAACCCCGGCTGACGA GAGCCGCCTCCCGGCGGAGG ACCCCGGAGCCTGAGGATGC CCCCCGGATGACGGCGGAGC GCCCCGAGCGACAGCGGACC CCTCCGGACCCCCACGGCCC CTCGGTGACGATGGCGGGCC CCGAACGACGACGACCCCCG GACCCCGGCGGTCCCGAGGA CGCCCCCCCCGAGGGTCTCC CCACGCTGGTGGAGGAGCCC CGGACCCCCCCGACACCGGA CCCCCCCACGGACGACCCAG GCGAAGGCGTAGACATGACA GCACTCACGTTCCTCCCCTT CCCCCTCCCGGCGAAGCTGT TCTGCCCGACCTGCCACCCG CCAAGACAGTACAGGTCGCA CGGCGACATGAACAAGCACC TACGGCGCTTCCACCAGCTG CGCCTAGCCTTCTACTGCGC CCTCTGCGGCACCGAGTACG AGGCCCTGAAGCTCCTGAAG AACCACCAGAAGGGATGCGA GGGCCACGGAGCCGAGAGGA GACCCGGCACGCTGGTGAGG TCCGCTGCCCCGGCCCGCCG GACCCAGGCCGCGGTGCGAA GGCCCGCCAGACTGGCCACC CCGCCGACAACCCCACCGGA CCAGACCTCCAGGGACCACC CGACGGAGAGACCTGCCCCA GTGA (SEQ ID NO: 1181) | | YRQGGANVPRMGDLCDIAVV THAFRLLTCPDXTVSIIAAS ALEETARKRIGRQPTRRDLA TFLSGSLEGEFSRDGGDFAS LWSRARNATRRLGKRIGCAW TWTEERRELGVSLQPAPHAD RVTVTPRTRTFLERFLKDAV RNKYAGDLRAKPDQGKVFDV TSKWDSSNHFMPSGSFTRFA DWRFLHRARLNCLPLNGAVR FGHRDKRCRRCGYVAETLPH VLCSCKPHARAWQLCHNAVQ DRLVRAIPAAAGEISVNRTV PGCESQMRPDIVITNEEAKK VVIVDVTIPFENRRQAFTDA RARKREKYAPLADILRGRGY DVTVDALIVGTLGAWDPSNE SVLHACRVSRRYAKLMRCLM VSDTIRWSRDIYVEHITGHR QYTDPTRRTAAGPDPEGTA (SEQ ID NO: 1426) |
| NeSL | Utopia-1_CMy | . | Chelonia mydas | CTCTTCTTATGAATACTTGC AACACCTGCACTGAAGATGG ATTCTCCGGCTGCTATTTTT GAAAAACTGATGCTGCTTTG AAGGTGTATTCTGCTGCTGG TACCTTGGAAGGAAATTCTC TCTCTGCTCCTGAGACATCC CCAGCTGCACCGTGTACCAC CACCACCACTGCTGCTGCTC CACAGAAGGTTTCTCGGACA (SEQ ID NO: 1182) | TGAGCCGGTACGACATCGTG CATCAACTATGAGAAAGGGA CTGAGAGACTTTTTCCATTG GACCATATGAACTGGAACCA TAAACTCACTGAACATTAAA TCTCACCAAATGAGGGTAAA TCCATCCTCATCATCGTATC CACTCATTATACTCCACACC TGAACATAGCCATTATATGA ACAACATACCCCCATATCTC AATGTCTGTACTTTGACCCG TTAACCTTTTACCCCCAATC GGGGATATTGCAGATTATGT ATTCCTTACGCCACCCGATC CTAAACCGAATTTCGCACCC CTTGATAATCTGTACCTTAT TCCCTGATAACCAGAAACTT CTATGCTTAAACTCTGTACC GTTTTTTTTTATTTCAACAT CATCTTAATAAAATTATTAA A (SEQ ID NO: 1305) | MTTKKVLGASTTLQTSSTKG KNSGCSKDPLRDAVPGRSWI LRPACRDITTRRNIPPAPQQ QQPPMESPPTLQLQDALRRP SPTPAAAQVADAGGALAALH TIKRGISVDWTSISPKXXQR XTSASPDACPASETTQRDXR XLLDARPAGPLDPTRPHQDE PASDTADAAGTPLLQGNEDT IYLQYPLAADMLICPICSPP QSFHLLGVVTRHLKRCHSKR VAFSCALCSLPFETQKQCKM HQVACRKCLKGTTQSPAPAP SPPAARRPAAPEPQRRKXTS QAAVKKPAPVARPAERDAAI EKVPAASGNITQVLASRRPV SPSHVAKXISMLRRLSAASP PVQHVPVPRRISAPPRIAAR DPVAGRASAAPQTALRTPAA GGASTTPQTALRTPTAGGAS AMPQTTLPXPRRPDWRNQPR SHSKAPGLHRQTDQHGPQVH SAGHCLREISRSSSNRLGSS HSAAATHRRTGGVPATPEPD RVSPTTSNAXIPPEIPPQHP TEGNPDPRDRRQADHTAGSE PAPDEVEDXEGQRPMVRAAT PWQTAWTEELQAAASFDDFD LLVDRLTRELSAEIAPRRSS NQENAPPAHRTPAPNHNTTT RGARSRDASRRYDPAAASRI QKLYRANRSKAMREILDGPS PYCTIPSERLYSYFKDVFDR IARNDAQRPECLRPLPRVDE AGVLETDXTPKEVMARLSKT KNTAPGKDGIPYSLLKKRDP GCLVLATLFNQCKRFCRTPS SWKKAMTVLVYKKGERDDPS NWRPISLCSTMYKLYASCLA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | SRITEWSVSGGAISSIQKGF MSCEGCYEHNFVLQTTIETA RRARRQCAVAWLDLANAFGS MPHHHIFATLQEFGMPENFL RVIREVYEGCSTTIRSVEGE TAEIPIRSGVKQGCPLSPII FNLAMEPLLRAISNGTDGFN LHGERVSVLAYADDLVLTAD DPESLQGMLDATSRAADWMG LRFNAKKCATLHIDGSKRDS VQTTGFQIQGEPVIPLAEGQ AYQHLGTPTGFRVRQTPEDT IQEILQDAAKIDASLLAPWQ KINALNTFLIPRISFVLRGS AVAKVPLNKADKIVRQLVKK WLFLPQRASNELVYIAHRHG GANVPRMGDLCDIAVITHAF RLLTCPDAMVRNIAANALHD ATKKRIGRAPSNQDIATFLS GSLDGEFGRDGRDIASLWSR ARNATRRLGKRIGCRWEWCE ERQELGVLVPQIRSNDNTIV TPSARGMLERTLKAAIHSLY VETLKRKPDQGKAFELTSKW DASQPLPRRGRLHPFRRLAV HPPCPAQLRPAQRSRPPREP RQALQEVRLLQRDPAPRPVQ LQAPLQSLAAAPQCHPEPPG ESHRTAPGGGRRELRHPRYP ASGTPANHFLAGGGFTRFAD WRFIHRARLNCVPLNGAVRH GNRDKRCRKCGYSNETLPHV LCSCKPHSRAWQLRHNAIQN RLVKAIAPRLGEVAVNCAIP GTDSQLRPDVVVTDEAQKKI ILVDVTVSFENRTPAFREAR ARKLEKYAPLADTLRAKGYE VQMDALIVGALGAWDPCNER VLRTCGIGRRYARLMRRLMV SDTIRWSRDIYIEHITGHRQ YQEV (SEQ ID NO: 1427) |
| NeSL | Utopia-1_CPB | . | Chrysemys picta bellii | TTTTTTCTGATGCTTGACTG CAAACACCCATCCAGAAGAT GGAATCTCCTGCAGCCATTT TTGAAAAAATTGATGCTGCT TTAAAGATATACTCCATTCT CCTWKTTTGKAAGAAAACTC TTTTTCAGCTTCAGTATTC TGTCATCGGCTGCTGCTGTT CCTGCTTCCCAGAAAGCTCA GCMAAAACCTATCCTGAAGA CCWCCCTTGGTGCCTCACGG AAGACCCGGASCACCTGCAA GAACCAAAACATTAGGAGCT GGCTGAAGAAACCCCCGTG GATACCTCWGCAGGGAGACC TGGSTCCAGMAGGACACTC TTCGGGACCTCMCATCSAGG AGCAAGAATATCTCAACAGC TCTTCAGGAGGGGGACCCCC GGAGAACCCTGCCCGCTTCC CAGAACCAGGATGCTGATCG CCGCCCCACCGGGAAGGATG CCACCGCAGGAGCCCCCCCA (SEQ ID NO: 1183) | TGAGCCAGAGTGACATCGTT CTCCCACTACGAGAAAGGGA CCAAGTGACCTTCTCCGTTG GATCATATGAACTGGAACCA TAAACTCCCTGAACATTAAA TCTCACCAAATGAGGGTCAA TCCATCCTCATCATCATATC CGAACACAGCCACTCTATGA ACTTCATACCCTCATATCTC AATGTCTGTACTTTGACCCA TCAACCTTTTACCCCCAATC GGGGATATTGCAGATTATGT ATTCCTCATGCCACCTGATC TTAAACCAAACTTTGCACCC TCGATAATCTGTATGTTATT CCCTGATAACCAGAAACTTC TATGCTCAAACTCTGTTCAC TATTTTTTTTAACATCATCT TAATAAAATTTTTAAATCTG TT (SEQ ID NO: 1306) | MTQDQDADCCPAGKDATRGA PPMTQDQDADRCPAAPERDA PEGTTSSTPDPKTTYHPAVR RRAARRGMHLRAQDLDAARC PSGQRDNVASESSAPPRATS PPQASLPDPEESPGESAGTT EIRPTEGEAGEEDRIYLQYP LPTGLLLCPFCLPVHGVQTL AALSKHVRKTYNKRIAFRCS RCDLPFETQKKCKFHQATCR GPPTTAKVNPTDILRVPTLT PTDDLASAPQPASPESQQIR GDQPPTEGSVTPASRTDDAT KRTSPVSRIPTLDPAVRGTT ATSQVNNLTRRLSDLIKTIR HNTDTRRCSAPPQVTSCRPA VGATSIVPQAARRDPANGGA SRSPQIPQPDPAPGRPNTSS KVTQRASDRQKPHAPPRTHQ PDAARRRTRTIPSASKHDRA PTKPSTGASRTPLPPGRSSA ASETPRAALPTTPGPPPQDP PEHRSTVRGTTRPQTVPAAP EPAETTQQEERRPRARVATP WQSAWMEELAKAEDFENFDT LMDRLTAELSAEITARRREP QEAARATRRFPAPSRNNTAR EGRRGDVGRRYDPAAASRIQ KLYRMNRTKAMREILDGTSS YCAIQPERLYSFFKDVFDHE AQTNLRRPECLSPLPRIDLT |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | EDLERDFSPQEVQARLSRTK NTAPGKDGIRYPLLKKRDPG CLVLAAIFNKCKQFHRVPRS WKKSMTVLIHKKGXRDDPGN WRPISLCSTIYKLYASCLAA RITDWSVCGGAVSSVQKGFM SCEGCYEHNFLLQTAIQEAR RSKRQCAVAWLDLTNAFGSI PHHHIFATLGEFGMPETFIQ ILRDLYKDCTTTIRATDGET DAIPIRRGVKQGCPLSPIIF NLAMEPLIRAISSGPTGFDL HGKKLSILAYADDLVLTADD PESLQGMLDATSRATDWMGL RFNAKKCATLHIDGSKRDSV QTTGFQIQGEPVIPLAEGQA YQHLGTPTGFRVRQTPEDTI QEILQDAAKIDASLLAPWQK INALNTFLIPRISFTLRGSA VAKVPLNKADKIIRKLVKKW LFLPQRASNELVYIAHRHGG ANVPRMGDLCDVAVITHAFR LLTCPDATVRNIAANALRDA TEKRIGRAPSNQDIATFLSG SLDGEFGRDGRDIASLWSRT RNATRRLGKRIGCRWEWCEE RQELGIRVPQIRSDDNTIVT PTARGLLERTLKAAIRSLYV ETLKRKPDQGKAFELTSKWD ASNHFLDGGGFTRFADWRFI HRARLNCVPLNGAVRHGNRD KRCRKCGYPNETLPHVLCSC KPHSRAWQLRHNAIQNRLVK AIAPRLGEISVNCTIAGTDS QLRPDVVVTDEAQKKIILVD VTVSFENRTPAFREARARKL EKYAPLADTLRAKGYEVQMD ALIVGALGAWDPCNERVLRT CGIGRRYARLMRRLMVSDAI RWSRDIYIEHITGHRQYQEA (SEQ ID NO: 1428) |
| NeSL | Utopia-1_DYak | . | Drosophila yakuba | AAAGTGTAGTTCTTTTCTGT TTTAGTGTAGTGGGAAGTCT GTTTCTTTTTATTATGTTTT TTACGAAAAGTCCTGGTCT TTGAAATTCATTGTCTAAAT TTTAAATAAAATTATAAAT TTAAAAAGAAAATTAATTAA AGAAGCGATGAAATATCTCT GAAATTCAATCAATCAATTA ATCATGGCGTCTCAGCGAGT GCACGTATTTGCCTACCCCT TCGTGGGACCATTCCGGTGC TCCGTATGCATGGATGCGTC CGGGATGCATCCCACTAGGT CGCTGGGCGAATACGGCACA TACGCTGCGGCATATCAGCA CATAACCCGGCGCCACCCAC AAGTGGTTATTACATACCGT TGCCGGGTCTGTGGCGCTGA (SEQ ID NO: 1184) | TAAAAAATTAAAATGCCTTA AAAATAAATAAATATATCAA AATTTAAAAAAAAAAAAACGAG GAACAAATAAACACAAATTC TGAAAGATTTATATAATTTA AAAWATAAATCGAAAATAAA TGTTGAAAACAAAAAAAAAA TAATAATAATAATAAAAACA CAATAACACTCACCCGGCCT GCCCCAGAGGCAGGTAAACA TTTACTGGCCATATGGCTTT TTTTTTAA (SEQ ID NO: 1307) | YAPGYEAAQSPCGREPPRDH HRRPRDACGSSHSPEPCLTT PRLLPETVSAEPCDDESQRT RYASPHKQARTLHDAEPRDA SREHAPSCAEPRCHRCQWTH WKDCCPHSTNTTDGPEGTDR CADTITSPATAACPQRSPCP LGSSNGCDETAPEKRQPAAD LVHTAPFAVLVRAGPFADLV RAGPFADHHQDDDPLPHRSG SLGPLCSKQKDPRKTHQHRH SGQAGNQTHTDIPRAAPSRR AAICLMANAAATREDLLRAA TSLSEMAAANQPTRSPTGGG EPTSQGRRGPQALADAAKRI QQIYRTNIPRAMRKVLRTLL TAVFSACLRTGHVPDLCKKS RTVLIHKKGDRTDLSNWRPL SMGDTIPKLFAAVMADRLTA FLTNGGRLSEEQKGFLQHEG CHEHNFVLGQVLEESRRQGK DLVMGWLDLSNAFGSIPHAT IMDAVAGMGIPSRIRTIIHQ LATGAATTAKTIDGMSEEIP IEAGVRQGCPASPILFNIAI ERVLRKIKTVNAGYLLYGSR ISPLAYADDLVLIASSPEEM RSLLRAADDAAIEAGLHFNP KKCATLHLTGKKSSRRAVQT GFLVRGTPIPAMTEGDAYEY LGIPLGLKKNQTPRAAMEAI VGDIAKIDDSLLAPWQKIDA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | ARTFVAPKLDFVLRSGATLR APLRHLDTVIKKHIKKWLYL PQRASAEVVYTPLKKGGAGI LPSSILADVLTIAQAHRMVS CPGEVVSRIASEGLREAVKR KINREPSGDEMAHFLSGSTL SGETASFGDAGFWSRVRMAT KRQAVHLGVRWAWRGGELLV ESRGQRNRPVATDSNSRSQL IQRLRCAAQDEFLTILINKP DQGKVAKLSTLTPVSNAFIR DGSFTRFADWRFIHRARLGV LPLNGAIRWGSGDKRCRVCG YQLESVPHVLCHCMHHSNAM QQRHNAVMDRLAKAGSRLGT PRVNCRVEGVAEDMAALRPD LVWRDERSRKIVIVDVTVPF ENGAEAFDNARGEKEEKYRP LAEALRAMGYQVKLEAFIVG ALGSWDPKNERVLKTLGVSR FYAGLMRRLMVADTIRWSRD IYVEHVSGIRQFTLPSGAPS N (SEQ ID NO: 1429) |
| NeSL | Utopia-1_Gav | . | *Gavialis gangeticus* | CGCTGGAAAGACGGAGAACC GCTTCTTTTTCCTGCGCCCG GCCTGGTATTGCACTTCCTC CAGGACCAGCGCCAACCTAG TCCGGCAGACTGCCGGAATA ATAGCCTCAGAAAGAGAGCT GGCTAGCAGCCCTCTTTTCT TTCCTCCGGTGCAGCGTGGG TTCTTGTCAGTCCTGATGGG CTAGGGAAGGCGGTGCCGCC AGTACGTCCGAAAGAGCGCC GGTTGCGCGAGCGACCGCGC CGCTCAGGCGAGTAGCCCAA GGGTCTTACGGTTCGCCGGA CCCGATAACGCGAAAGCCCC GACTCGGGCCAGTAGCCGAA GACCNTGGGCCTCCCTCCCC AGGTCGGAGTAGGCAACGC CCGTGCTCGGAGGACGGAAC GTGGACAAAACACCCCCAGG TCCCAATGACGCCCTGATCC ACTGACAAGAACGCTCGAGG CACNCCAGGAGACCCCCAGC TAGGGCAGACCGCCGACCAC GGGTCGCGGAGGACCCTCCC AGGAGGGTGGACCAGCGAAC CCGAGTCGGCGACGAACCCC GACGCACCCCCCCGCG (SEQ ID NO: 1185) | TGAACCGCCCCCCCTCCGCG CCAGACGGACCTTCACTTCA CTCCGAGAGGATTCTTCGAC CACGGACGACCCCGCTCCAC CCGAAGAGGACCCCCGCGAT GAGACTCTATACGGACTGAG GCACTTCCTTCGAACCACTT CCTCCACCATTGCGGACCAT TGTAACGGGTTTGTGTGTAT CTATCTCCTTTCTCTCTCAG CGTCGCGAACCCCCTCCCCC ACCCCCCACCCCCGGGCTTA GTTGGCTAACATTGTATCTC CTGTAACCTAGTCGCGTTCC CCTCCTCACCCCCCATCCCTC TATTGTTAGTCCCTCGCTCG GGCGATCTGTATTTCCCTAT CGGCTTTGTCATCTTTTTTC TGGATTCCCGATCCTAAACA TTTACTAATAAAAGTCAATC TGTTCTTT (SEQ ID NO: 1308) | MSGPRQAAADPRPSTDPRRQ RDSQSPEPRLTRAASRRRTP DPEDAPRTTAEHPERRRTPP DPRGPSATTAGPERRRPPDP GGPEDDPPEGLPTLVEEPRT PPTPDPPDGRPRRGCRRGSA HVPPLPPPCEAAVPDLPPAK AVQVAQRHEQTPTALPPAAP SVLLLPLRHRVRGPEAPEEP PQGMPGPRGREETRHAGEVR RPTTRAAARRPARPAAPPAT PPDQTSGDRPTERPAPATPP RRSAPRDPRPDVTPRPDGPP PGPPGPPDAPDPPRIPEPPG EPEPPGALQLPSVPGSPGAE TSAQQRMPTPRQALWLEELS RATAFEAFEASVARLTEELS AAARPGQPRRGADNGPTTRR DHRPQPQRRPRRQRYDPAAA SRIQKLYRANRPKAAREILE GPSAFCQVPRETLFNYFSRV FNPPAEAAAPRPATVEALTP VPPAEGFEEAFTPREVEARL KRTRDTAPGRDGIRYGLLKK RDPGCLVLSVLFNRCREFRR TPAAWKRAMTVLIHKKGDPT DPGNWRPIALCSTVAKLYAS CLAARITDWAVTGGAVSRSQ KGFMSTEGCYEHNFTLQMAL DNARRTRKQCAVAWLDISNA FGSVPHRRIFGTLRELGLPD GVIDLVRELYHGCTTTVRAT DGETAEIPIRSGVRQGCPLS PIIFNLAMEPLLRAVAGGPG GLDLYGQKLSVLAYADDLVL LAPDATQLQQMLDVTSEAAR WMGLRFNVAKCASLHIDGRQ KSRVLDSTLTIQGQAMRHLR DGEAYCHLGTPTGHRAKQTP EETINGIVQDAHKLDSSLLA PWQKIDAANTFLIPRVAFVL RGSAVPKTPLKKADAEIRRL LKKWLHLPLRASNEVLHIPY RQGGANVPRMGDLCDIAVVT HAFRLLTCPDATVSIIAASA LEETARKRIARQPTGRDLAT FLSGSLEGEFGRDGGDFASL WSRARNATRRLGKRIGCAWT WTEECRELGVSLQPAPHADR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VTVTPRTRTFLERFLKDAVR NKYAGDLRAKPDQGKVFDVT SKWDASNHFMPSGSFTRFAD WRFLHRARLNCLPLNGAVRF GHRDKRCRRCGYAAETLPHV LCSCKPHARAWQLRHNAVQD RLVRAIPAAAGEISVNRTVP GCESQMRPDIVITNEEAKKV VIVDVTIPFENRRQAFTDAR ARKREKYAPLADTLRGRGYD VTVDALIVGTLGAWDPSNES VLRACRVSRRYAKLMRCLMV SDTIRWSRDIYVEHITGHRQ YSDPTRRAAAGPDPEGTA (SEQ ID NO: 1430) |
| NeSL -1_LV | Utopa | AGCV0 1358106 | Lytechinus variegatus | ATCTACTATC (SEQ ID NO: 1186) | TGAATAGCATTTATATTGTG TTCCAAACAACATACTCATT ATTATATCTAAACATTTTTT TTTCTGTTCCTGACAATCTA CGTAAAGTCTGCTAACCAAC TGGCATGATGAAATAAGATA AAATCCCCTTACACATTAAT TTCTTGTCACATCATAATGC TTTGTCAAAGCAATGTCCTA CATAATATCTCGATGTCACC CCAATTAATTTTACATCCTT CGGTAACCTTTATACCGTTG GATCAACATATATGATTGT AAAACTGTTATTTCTGAGTT TTTTCTATGCTAATAAA (SEQ ID NO: 1309) | MSCPREGSDHLGPDPETPAL HQGSDIRVTSSRLRGSRGKS SRQPSSRHQVPASEASATAQ QTAANECQVCGSSFATSSGL RRHMARLHRAASADPEGAAP ASITEIFDYPLPSRWKCSAC SENFFNQQTLKRHQTRHHPA TTFAYAFRCSSCRSEFDSAR RAANHWQVHKKERSQLSGTE PQASSQARVSMAHSPPPLPN TSWAELASNPAEIPSFVWES PPKNRPSVEEFGSSLPTDVT MMSQSPPPQVQSSPVPALTP LSPAATASSSPPGAARQLTP PTQTNTPVTQRARLQPEADV VPELPPSVTEHPVSDAQHWV DAVSSASDWSEFEAVCDQFV IHAVAVSRPNLARPQQQDRQ RSGDHPPRQQRGQHRPTFDV REASRIQKLYRTSKKRAIRH ILKEKSPSFSGSESDVLDFF REVYSAKEVDEEAVGKLASS LFDVPQGDDSATSLSLPTSA KEIGARLSRMTNSAPGKDRL EYRHIRRADGSFSISEAIFN KCLAEGRIPAPWKTASTILL HKAGPTDDPANFRPIALQSC LYKLFMAVLADRLTKWACEN QYLSPEQKSARPCEGCFEHS FLLSAALKDCRRNQKTICIG WLDLRNAFGSIPHPVIKIVL SSLGVPDSLVTLLMDAYNGA STSFTLTGGQTDTVPIRSGV KQGCPMSPILFNLAIELIIR AVKKNASDNHLGVTVQGKNL SILAYADDLVLLSRDTEGLQ SLLQVAGSSASTLQMQFKPQ KCATLTLDCKRGTNVRQSAH HIQGAAIPSLTEEERYRYLG VPIGLPRLTSLQESSRKLSS DIETISSSLLAPWQKLDAIK TFVIPILQYTLRATEYLKSD LKPLRAAIIKHVKKICHLPV RSSNAFVFASRPSGGLAFVD PGVDADILVVTQAVRTLASD DDTVRAVALGQLTSVVHRTV HSAPSDDCIDKFLSGSSEGP LANSGNSGQASSLWSRTAA SRRLKIRIVGASSGDIKVES GGRAIPSKKVTAGLRSDHHN EMSEKLRSLPDQGKVARALS LDSFANATSWLTSGSFIRFC DWRFIHRARLNCLPTNAAVR RWKQNANTKCRRCDHQLETL PHIINNCRPNMVPIRRRHNS IQERLVKAIHYGDIYQDQHV PGDPNPRERPDITVVEGNKV TIVDITIPFDNGPDALSTAA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | NAKVMKYDTLRQELASRGMD VEVHAFVIGSLGSWHGDNER VLGRLGISRRYRTLMRRLCC IDAIKGSRDIYIEHVTGHRQ Y (SEQ ID NO: 1431) |
| NeSL | Utopa-1_NVit | . | Nasonia vitripennis | CCATTCCTTCGTACGGGTTT TCGTGCCGGCATAGCCGGGT GGGAGACTCGCGCGGGGAG GTCATATCTCACCACCATCC TCGAGCTTTTTGCTGCACCT GA (SEQ ID NO: 1187) | TAGTGGGGCCATAACACCTA GGCCCCACAGTGTGGCGATG TCCATGTGTGTCGTCCTTAC TTATTTATTTATTTGTCCTG TCGAGCTGTTTAATCTATTC ATATGTATGTGTTGTGTGTG TCGTCCCTCGTAGCAGTTTT ATTCCGTCCAACCAGAGGTC GACCAATATTAAAATAAGCA TGGCTTGAAGCAGGCCAAGC GCCGTGTTCTAACCCCGTTT TAGGGGAAGTTACTTAACCT AAAAATACAACTTTTCC (SEQ ID NO: 1310) | SGXTGREVKCITVNVLMEQQ PHTKAIREGDFIVILLPQSD DETLCCPLCVGRGRYSGKTR VECLNRHVKEVHPDLTTTFR CWGCGFAAPGDKKYPRKIVT QHCATCVPEVSSAPSGRVDG ERRVNTRRRLGIAAATEASP VRRTRRNGLASPPVEQNISQ SAAPPEPARVPQHPEIVALG ESADDEVFRSPVNSPPRDWR AAAPQQAASSSPXAVPGITA ATPSNTTRTGNGSAXSILAE HPIPAPPPTNTTEANGRADI PRSGRAPPPGXQAARRRAPT TEQRRIVGLLEAATGREQLE EATTQAMLFLARLTGRRPEP RNAIRPGXRQRHPAQGDVQA QAPDRIXEAKKLQRLYRTSK KRAVQKILAGPXMNCQIDKN TITAHFVELAARRDGGEDWP DVFDREEPTAASGEALCTPI TREEVFRRLKGRNNTSPGPD GITYRDLAKAXPGAHVLAAL YNXIWRIEATPALWGVSNTT LIYKKGDAMDISNWRPISLG DTVPKLFAAILADRIKRWAV ANGRYSASQKGFLEFEGCYE HNFVLQEAIREAKGGRKELV VAWLDLASAFTSVPHSSILQ ALEGHGLPSKARNIISSLYT GMTTRFHTAEGPTDPILIQS GVRQGCPLSPDVFNLTLEVV LREIQRTGEGYTIEGRRISH LAYADDVAILADSPAGMRRL LFAAERGARAVGLTFNPAKC ATLHIAGRGEEAVRPTEFSV QGTPVRALASGEAYEHLGIP TGYQVRQTPINTLRDLLADI GSIDRSLLAXWQKLDAVGTF LLPRLDFTMQGAHIDKGFLT EADKIIKKAAKSWLSLPQRA SAELVFLPPSQGGGGLLTVA HSYKMLYSSDVTVSTIAGST LRRTVSERLKKRASNIDIAR FLSGDLDLPRSTSPSTFWTK VRSAALRIKTKLGLRWSWCQ GGEVLLMACGDPRAPGTRVS PQTKHLVTTSLRRCLNRHYA ESLLAKKDQGKVFEVTRRSG QSNHFLRSGSFTRFCDWRFI HRARLDVLPLNAAKRWQRGM DKRCRRCGSDLETLPHVLSH CGPHSAARQKRHNNIQDRLV KAASRCPGTISVNQTVVGVR GPDAALRPDIVVRDDVNRRV TIVDVAVPFENRLEAFDGVR EAKIAKYTPLARQLTDSGYT VTVEAFVVGALGAWDPRNER VLSLLSISRYYAILMRRLMV SDTIRWSRDIYVEHVSGIRQ YRE (SEQ ID NO: 1432) |
| NeSL | Utopia-1_PCa | . | Phytophthora capsici | GCCCGCCGGTGGAGTAGCCA TGTTGGCCACCACCGCCCAA GTCTCCGCCGCAGCTGCGAC TGCTGCTGCTCATCGAGTCG | TAGACGGCACAGTTCTGGCC CACGTAGGCCGAAAGGGCCC CACCCATGTAGGGAACCGCC CTCGGGAAATCCATTCCGGT | MVVSRITARLEATPAPRWDP PLPRRVIASRIADRLVPATA PCRSALNAAFPSPSRDTVTE SFTQEDRQLEPLTRHVDEET |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CAGTAGTCGCAGCTGCACAA GCACCACCTCCTGCCGGACG CGCCGCCGTGGAGCACCACG CGCGCGCTGAGCCGTACCAA GACCAAGGNTTCCAGGCTCC CGCGCGCGTGGMGCTCCCAG CCAGCGACGCGTTCAGCAGC AGGGTCGGCTGCGGCAGCTC GACGCTGCACGGGACGGCA GCGACGGCAGGCACCAAGAC CACGACGACCAAGCCGTCGC TGCCGTCCCCATGGACGTCG ACCAAGGTGCTCGGTGGCCG ACAGCGGATCAMCACCCGCT GTCGCCGCCACCGGAGCTCC GAGTCGGCGGCAAGCGCCGC CGCCTGAACGACGGCGACGA CGAAGACATCCGCGAGCTGG CCGAGCTTCTGCTGCCCGAC GAGGAGGAGGCCGACGACCA CAAACCAGCGCCCAGGTTAC CCGCGACCAGCGCTCATCCG GCCTCCGTCCTCGCTGTGTA CGCGCACAACGCGCAGCGCT TCAACTGCACGTTGTGCGTG TACACGGCTGCCAGCTTCGC TGCTCTTACGCGACACAGGG ACTCTCGGCACCGGCGCGTG ACCTTCCTGGACAGGTTCTC GGCGGGTTGCGCGTGCGGCA AACCTTTTGCCTCGAGGCTG GCCGCAGCAAGACACGCACA AACGTGCGCCAGCCTCAGCA CCACACTGGTCGCGGTTTCG ACGACAGGAGGAGCATCAAG CCACACTGTCGTCGGAGCCA ACACCACCGTCGCCACGGCG GTCACCGCCGAACCCCCCCT GCTCCACCATCAAGCCTCGG AACTCACTGTGCCCCCCCCC ACGTGTGAGTTCCCCCGACG TCGATGTGCAGCTGCACAGT CCGCCACAGGAAGATCAGCA CGAGGACGCCACCCANCACC CGGAGAGCACGCAACACCAA CCTCCTGAGGCAACCCGCTG GGGTTCGCCGCTCGCGCCCA CGCTCGTTGCCTCCAGGATT GCTCAGCGACTCGGCGAGCT GGAACCTCCACGCTGGGGCC CACCATTACCCCGCGCG (SEQ ID NO: 1188) | GTTCGACTGAAGAGATGCTC CTTCGCCTTGACGGAGGTAC ATCTCGACAGTCGAACTTCA ACTCGCAACATATCCGATAC AGTTACAAACCACAGTTAGA TATCAGATAGGAACCTTCCT TTAGGAAGCTAACGGGTACA CTGGATGGTAAATACACATA CATTTC (SEQ ID NO: 1311) | KDSELPGRAPTVLDEESKDN DATAGEWLLRFDGACRANPG PGGAGAVLFNPSGAASWTCS HFMPGATETNNTAEYTAFLL GARAAADHGATLLRVQGDSQ LVLRQVKGIYGAKSTRLRRL RDAVRAELARVGQFSLHHID RQDNAHADRLANRALDMKST LVECATHPGRNACTTTLTTS AAAESPASPPPVGARDTPMA DAGEERLADVDDGEVYAAMR LGPGEVPERRPRLRLRQLSD EELEAASEMVERLGAALSAK ITDAEDWASAEGYITALPYM LYDKLQSYSQAPRGPQQPVL TRSPRGDDRPASSEPNASST TGGVASEHQPRRRRRGRRK GRRQRRNPRRSGREGATGGH QQHKKHKPRPPRETQHHREH RLDEALDELHALERTDPHNR PAIAKARRRVGRIRSAINQQ LLRHKFDTDEKACVDGILST ARAERAARAATPSPPASGAP TTTVSAPGAIVTNDDGTCPI PSDKLWRHFDAVNTPRLDFD AEAPGSAAFRAAMDHLPAAT RLLDLLKEAPSTDEIETQLQ HVKASSSPGLDVGVGYDVYKR FTIQLLPVLRAAFRCCWLYK KVPQSWKLGVVRLLHKKGPR EDPANWRPICLQQAIYKLYT GILARRLTRWMDANDRHAPG QKGFRAVNGCGEHNFLAATL IDNARRKHRPLYEVWYDFRN AFGSVPFALLWDSLQRLGVP PDYVDMCKGLYNQASFVVGN AVDGSTAPVEQRVGVFQGCP LSPQLFNAAISPLLYALRRL PDTGVQLSSVDRPGASAYAD DLKIFSGTKAGITQQHELVA TFLRWTGMQANPAKCRSMGV RRNTNGAVEADNVHLELDDT PIPSMTHMQSYTYLGIGDGF DHVRRRVELAPKLKTLKHDV TALVESGLAPWQVVKAVKVY LYPRVEYALRHLRPDDQHLE SFDLHLRRGLRHLLRLPKNA TNEFFYAPVSRGGLGLLPLV ELHAALQIAHGWQTLHSPDP AIRRVAREQLYQIADARHRL DKDHWPHRREELCELLLNGE LGTSAHAPPKRRNGDIGSLW VDVRKNLKTFGLKVATAPAN QETGVPAQPLQLRVPHHAEW LDHGNVLRHVKLHIKNLHWQ TWCALSDQGKTARVHGGVGS AFLTRPRGMWESDYRFAVAA RLNVVDTVNTLSRRRLRAHD RCRYPACRWKETLAHVLNHC PGTMDAVRGRHDDALKEIEH TLRASSGDRRELRVNQTVPG LPGPPLRPDIQVYNHDKRTV AVVDLAVAFDEQPSEDPESS GLAKAVQIKKAKYAGIKEHL ENQGWKVHLSAIVYGSLGSV AASNHKVYTEHLGLLKRDAK RLDRQLSSACIQSSRRIWNF HCAKHRARQHEHQAPPSQAT RGRRVTETGGNPSRTDRR (SEQ ID NO: 1433) |
| NesL | Utopia -1_PI | . | Phytophthora infestans | AGCTCGGCCTCGCGGCTGCC TTCCCAGGCGCCGCCGACTT CGCGCTCTGGCGCGGCCCAC | TAAGCTGGTCATCATGACCG ACAGGGCACTACCCAGGTAG GGAACCGCCCTTAAAAAACC | MLADPAALAAGLARAPPPPS APQDPSPAFPAGPAGONPRA AAPARVEVHTVVAPPGRAGG |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | ACGCCGCCGCCGAGCCTCCA AGCGCGCCCGTTGGCTTTCG CAGACGCAGGGCTCGCGGCG ACGGCCCTCGCCAGCCCCCA AGACCCCCCCTACGATGTGG CACCACCCGGCAGGGCGGCC GGCAGGCTGCCCGACTCGGT ATCGCCGGGTGCTACACTCT CAGCCGCCACAGCTCGGGCC TTGGCGGTCCGCCATTGGCC CTTGGAGCTCGACAGCGACA GCAGCGACGACGAGGACGCT CAAGACCCCCACGCCGCCGC CCCAGAACCCCCAGAAGACG TCGCGAGTGTGCTTGCCCCA CCCGGCAGGGCAGGCAGC (SEQ ID NO: 1189) | CAGGAAGACACAAACACCCT CCACTTAGTGACATACATAT TTTAGCCTAGATTTCAGTTA CGGAGAGGTTACTAACTGGT AAATACGAACACATATTCTG TTCTAATCAGTGTGAAAACT GGTTTTCGCCTTTTGGCGGA CTTTTTCACTCGCATTTTTG GGCAATCGTCTGCGGCTAGC TTGCTAGCGGCGGACGAGCG GTCTCCGGGGCGTTCACCT TTCCCCCGCGAGGCCAACTA CACCGATCTTCTCTACACTT TTCTAATTCGCCTCCGTCTT CGGTCTTCGGTTGTCGGGCT TTTTTCTTTTTGACCAATCA GAGCGCGCCATGCGCCTCTT CTGGCCAATCAGAGACCGGG CCCTGTCCTCGGACAGCGAG GCCTCCACGGCCAGCCAATC GAGTCTCGGCAGCGACGCGT CTTTCTATAGCGCAGCTGAC GAGGCCGATCTGGCGGCCCC CGATTGGTCCGACTTTCGGC CAATCAGCGACGACGAGGGG GCAGGGGTTTACACTTTTGC CCCCGTTTCGACTTCAACTT CAGGCCAAAATGGCGATTTG GACCCTCCACGCGCCGTGCC ACTGCTCGGCACCGGCGGCG ATTCAGCGGGTGCAACTTCG GGCACGTGTGCAACACATGC AGCGCCCATTGCACGCCAAG CGGCATCGCGGGACGACGCC TCGGCCGCCCAAGCGCAGCC CCGCCCTTCCAGCACGACCT CGCGCCGTTTGGCGGATCGC CATCAAGACGTGCGAGAGCC AGGCGGGGTCGGGCAAAATA TACTTACTCTAAGTATGCCC GAATCCCTGCCCTCTCAGGC TGAACGCGGCCCCATACTTG ATCTAAGTATGGGAGGATCC CTGGCCTCTCAGGCTGTACG CGAGACCC (SEQ ID NO: 1312) | MLPDPGLVEEPIQATYAHDA AQFECALCPYVAESMAVLVQ HRRSAHRGTRFKDIFTSGCQ CSLVFYARIVAASHAVACAR RNQRAVPPAPTPVAPTRPEA TPQPTGYLAAAMTAAAAAAS SDTVVAAATNMQSAVPAAAK TTGLQLVPPELEPALPQRAS CHAGKRRRLNADEAVTPCTP TARVSPQTEVAMAPHDAPQD DTVLQREAAEPQPDPAATPG AQVQRVEDTTAAQDDTVQQD HDADTAQVSPPRRTPTRWGP RPSSTQEPSPMTGEPAATLA ARRPLTPAATGTRATRWGPC HRAIGAAAIARLVTGLSTEP AQPQRRQPPPPQEPPSQPEP LAAAATAAADIAATVAADIA AAAANAAMDVDGGPAADETW LLRFDGACRRNPGPGGAGAA LFAPSGAVVWTCSHYMPSRS ETNNTAEYTALLLGVQSAVH HGASHLEVEGDSSLVIAQVK GTFACRNARLRQLRNRVRHA LRSVDTHKLRHIDRQANAHA DRLANRALDQRRTSSECGTH GSCMDSCLAVPTALAAQETP PAAPPSTSATPAEGNAMDDI AAEIAARDEGETFPVLPIGP GSAPERQPRLRLRQLSDEER DAAADALQELADTMASKIED ADSWTSGEGYISSIPERIRE VLQPYATAPPQPGRSRRQQR RRPPRVTRNQREHRLDEALD DMAATQQATPRDQRAVRRAR RRVGRVRASMAQQELRHEFA KDESKCVAKILKTASTETAA EDEHPETCPIDAATLHAHFT GVNAPRTDFDYDATSGREFR AAMSDLPPATVEIDAFDAEL TIDEVEDQLTRAAKTSSPGH DGIDYGIYSRFAAQLVPLLH AVFQFCWRHRRVPRLWKVGI VRLIHKKGDPRQPTNWRPIC LQPTIYKLYSGLLAHRLSRW LEGNDRLPMAQKGFRAFNGC HEHNFMATTLLDQTRRQHRK LYQVWYDLRNAFGSLPQQLM WRVLRHLGVDSGFIDRCRDI YRDSAFVVANAADGATDPVR QEVGVYQGCPLSPLLFVAAL VPLVRRLEKLDGVGVPLADG VRPCTTAYADDLKVFSDSAA GIRKCHDTVAGFLAWTGLRA NPGKCASLAVTTNARGNPTR DSSMRLEVHDAAITTLSLHE SYRYLGVGDGYDHVRHRLQL EPKLKQLKREAVALLTSGLA PWQVVRALKVYVYPKVEYAL RHLRPLQSQLQAFDRVVSKG LRHLLSLPRSATSEVLYAPT SSGGLGLQPLVELHRALQLA HAWQMLHSKDPAIQAVARAQ ACQVVRKRYRLQEDHWRGRD DELVRSFLNSELAASPHAEV LRRNGDIASLWSDVQRWLRI YHLRFEHCDETEAHGPLSFR VPHHNKWLTHKTVLRHVKLH LKIRHQTRWKGMVDQGKTVR VHGGVGAKFMTTGAGLSDDD YRFGVKGRLNQVDTNSVLKR KRLRAHTTCRDPTCSSAETL AHVLNHCESNMDAIRQRHDD ALEQIGSKIRGALDRAKSPT |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | ELRLNQTVPEYTGAALRPDI VLRNVAAKTMVIADLAVTFE DQAARARHSSLQLSHDHKTL KYQPIVAELQHKGWRVQTAA IVYGTLGSVQPSNFKAYTEK FKLHKREARQLDLQLSSHCI RASHRIWGWHCRQHRDRQRS GTASRASRGSGGAPRRTSQA PARR (SEQ ID NO: 1434) |
| NeSL | Utopia-1_PMi | . | Patiria miniata | CTGATGTGGATACCTTGGAA TTACTCAACCGTGTCGGAGT CTTTTGTCTTTTGCGCCCAA CACCTCATGGATACCATGCT TGTCGCTGGAGCGACGTTAC AAGCGTGAGGGCGCCCTCCA TGCCGGACAGCTGGTCTGTG CC (SEQ ID NO: 1190) | GATTAGCGAACACTAATATC CTGCCMTAGACGTGATTGCT AATCCGCAAACCAACCGGAT CTACAGCCTGAACACTGAAC TTTAATCTTCACCCATGTCA CATCTGGACACTAGGTTTTT GCTCTGTTTGTGTTTTCCTG CCTTTWCMTTGGAWCTTTCG CMCTGGAATTTATTTGTCGC TTGGATTATTTTTTTCTCA CAATTTGGATCTATTTTCGT TTGTTCACTTCGAACTCTAG CTGCCCTTTCTTCGGACACT GAACTTTAATCTTCGCCATG GCTGTCAGTCGCCGGTTCAC TTGCTGCGGTGGGATCCTGT TGTGATAATCCCCGTGCATT GCCCATGGATTTATTTCGC CTTAGTTGTTCCTAACCTTG GATTTATTGCTGTGGGTGAT GCCCGGGTTTTGTTTACATC GGGATCCCGCTGCGGCTCGG TGTTCCATGCGACTGGCAGC CCCTTTGTTTACTCTSGACT CTATTCATTGTTGTATTTCT TCCACACTGGCCAGTGATCA CACTGCTGTGTTTCCCGGGA AGATATCCTCTGCGGTTTTC ACGCTCTGGGTGTCTCCCCG GGCAACGCACTGGTTGCTTG CTGCGCCATCACCCTTTTCG TTTTATATTCATTTTCAGTCT GCCGTTATCTTGGCCAGCGC TCATTCTTTTGTGATGGCCG TGGACTGACCCTCTGCGGTT TTCTGCGGTCASCACTCTCG GTGAATGCTGTGCCACCATT TTTCATTTGTTTACTTTTTC AGCTACAATTATCCTGGCCA GCTTTCACTCTTTTGTGATG GCCGTGGACGGACCCTCTGC TGGTTTTCACGCTCCGGGTT TGTCTGCGGTCAGCACCCTT GGTGAGTGCTGGTCGTTTGT TTGCTCATTTTGCTTAGTTC ACCATTATCTTTMTTCTCTT TTGTWTGGTTTTCCTAGCGG TTGTCTGGGAGTTGAGCTGC AGTTGTCTGGTCTTGGTTTT ACCCCCATTTGTTTTCTTTT AACGCGGGGCGTATTGCCTT GACCGGCCGTCTCAGCTTTT CTCCTAGAGCAACCTTCCGT TCATCCAACTTTTTAGTTTTC TCAGTTCTTGGCCATTCCGG TTGGTTAATTTTTATTTATA CTTAATTTTATGTTTACATT TTCTGGTTGGAGACCATTTT AGCTTGTTTTAATAGTTTTT CTTCTTTAATTAATACCCTC TGCCATTGAGGGTTTTTATT ACTATTAATTTTGTTTACTC TTTGTAACTTGTTTGATTGA | MCLKSFSSTSGLRRHMARLH RQPSPDASTPSTMTEVFPYP LPKVWPCVVCRENFYHNQTL KRHQKNFHPNVDLTTVYQCS VCGQEFVTGRKASFHFKVHR RMSASAIPTPSAMPSSPMDL IRGLVGEPLPPSPARTPPPL ARYISPAPRSSFSPPWNPSP PPRSPTPLPRPLTPPPRSPS PPPRSPTPPPPVTLTTAPVT EPAVPVALTTAQVTEPSAPA VHTAAPVTLSNAPVTEPATP ATDPATPVTRLHSPVTHISC SISFTASHAPYSCAAPTSPS VYACSPRRRQCSSTIAAVCN SEASSGNPCLLALPVHRHHL PDTSPQRPGLLFHHPGIPPH RPGRPPHCHGHSLHRHDHRA RRPGRQHHLPRSPSPPPRSP SPPSRSPSPPPRSPSPPPRP STPPPRSPSPTPRSPSPPPR PPILPPRSPDSTHRSLTSHA RSPSRPATPPIPVQPRHLRP STPAHPGVDNAVPPSQQSAI DVWLAELSRSADFESFEDVC DRFVEFAAAEGRNNGRPARP AHQPPRDRGNQGPRPQRPPR PHRPGLGPEFDAQEASRLQK LYRTSKKRAIRTILTGSDVR YSGYRGPHPALMSDTAATEV LTSGFLSLEVFSAREVDTDT IATDTSLLFPNSAQARESGQ DLLRPVTQREVSLRLGRMSN SAPGKDRLEYRHIRQVDGAF RVTLEIFNRCLRESRVPSSW KTATTVLIHKKGDATDPANF RPIALQSCLYKLLMAILSDR VTTWALDNDLISSSQKSARP GEGCYEHTFLLSTVVKDARR NQKNMYAAWLDLQNAFGSIP HDAMPFTVLTSIGAPEGLVSL VRDVYTDASTDFVTPTGRTA AVPIHSGVKQGCPISPVLFN LTLELIIRAVNASATRDRSA PVVHGQAVPILAYADDLVIL SRSSDGLQSLLTTASIMATK IQLKFKPAKCASLSLECRRG TKVRPLEFNVQDKIIPALTE EQHYRYLGVPIGLYRTDDSL ETLVAKMTDDIQRIDSSLLA PWQKLDAIRTFVQPCLAYTL RAGDCAKKHLKRLRGQLVKT ARKVCNLPTRATTNYIFADR RAGGLGFIDPNVDADIQIIT QAVRMLSSPDDITRAIATGQ LSSVVHRTIHRAPTQEETDE FLSASMEGDFANSGNSGQAS SLWSRARAAARRLKVTISGS LSGSVITKSTENREMAAKSI TTALRAQSRAHYTHRLLSLP DQGKVGQSLNQDQYMNSSSW MSSGSYILFCDWRFIHRARL NTLPTNATAQRWKPNTSPAC |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | ATATTTTAATAAACCAC (SEQ ID NO: 1313) | RRCQHPQETLPHILNHCPPN MVPIRRRHNLVQQRIVSAVR HGRVFVDQHVPEDPNPRERP DITVVEGDKVTIIDVCCPFD NGRDALMTAAAAKETKYADL KQALVAAGKDVEVFGFAVGS LGSWLPSNERALRRLGIAKR FRTLMRKLLRIDAIKGSRDV YIEHMCGHRQYT (SEQ ID NO: 1435) |
| NeSL | Utopia-1_PS | . | Phytophthora sojae | AGACGAGCAACGCGCTGGGG CCCAAGACCTGGCACGAACG ACACTGCCCAGGCTGTGAAC GACGAGCACGCTGCTAACCC GGCAGCGCACCGGCCTCTGG GCTCCGCTGCACCGGTTACC GGTGCAACACGGTGGGGTCC ACGTCACGGCGCGATCGGGG CAGCGGCTGTAGCTCGCCTG CTCACAGGCCTACCCACGGC ACCAGCACCAGCTACGCGCC GGCCTGCTTCGGCTCGGCGC TGCCCAGACCCGCCCGCTCC CCCCGCGGCCCACGACGACAG CCCCCGATGCG (SEQ ID NO: 1191) | TGAAGCTGCACAAGCGCGAG GCTCGACAGCTGGACCTTCA GCTGTCGAGCCACTGCATCC GCGCCAGCCACCGCACCTGG GGCTGGTACTGCCGGCGCCA CCGCGAAGGACAACGGAGCG GCAACGCCTCGCGAGCGCCG CGTGGGTCTGGGGGGGGCCC GCGGCGCACATCGCAGGCTC GGGCACGGCGGTAAGCTGGT CATTTGACCAACAGGGCACT ACCCAGGTAGGGAACCGCCC TTCAAAAACCCAGGAAGACA CAAACACCCTCCCTTTAGTG ACATGCATATTTTAGCCTAC ATTTCAGTTACGGAGAGGTT ACTAACTGGTAAACACGAAC ACACAT (SEQ ID NO: 1314) | MDVDGGPAMPEPWVLRFDGA CRRNPGPGGAGAALFKPCGT VAWTCSHYMPNSSETNNTAE YTALLLGVQSAVHHGASHLE IEGDSHLVVAQVKGTFACRN PRLRQLRNRVRHALRAVTSL TLKHIDRKANAHADRLANRA LDLKRSLAECGEHQGAMESC LHMNPAAQRQREQPAPPARP ACAPTRAESASDHDEDIDAE IAARDGGEAFPTLPIGPGTA PARQPRLRLRQLTEDEQEAA ASALQAMAEELACKIEDADS WTSGDGYISAIPSRIRQLLQ PFTAAQPHPRPPLQQQRQRP PRVTRTQREHRLDEALDEMA AVQQERPTSRSAVRRARRRV GRIRASMRQQQLRHDFARNE SKCVEDILRAASAETAAEEH PETCPIDSGTLHEHFTAVNS PRINFLPDEACGALFREAMA DVGTPQERRSALTDELTMDE VEDQLMQAATNSSPGHDGVG YDIYKKFAAQLVPLLHAAFQ SCWRHHRVPALWKVGFVRLI HKKGDPNDPANWRPICLQTA IYKLYSGLLARRLSAYLEAN GLLLMAQKGFRAYNGCHEHN FVATTLLDQTRRMRRRLYQV WYDLRNAFGSVHQDMLWYVL RLLGVERAFVERCDDIYEDS YFVVGNAADGATEPVRQEVG VYQGCPLSPLLFIAALVPLL RALEKLDGVGVALADGVRPC TTAYADDLKVFSDSAAGITR CHAVVEKFLEWTVLQANPGK CAFLAVTRNARGNPAHDKDM KLSLHDEEVSSIKLHDSYRY LGVGDGFDHVRHRLQLEPKL QQIKREAVALMQSGLAPWQV VKALKTYVYPKVEYALRHLR PLQSQLQGFDRVVAKGLRHL LRLPRSATNEVLYAPTSSGG LGLQPLVEMHRALQIAHAWQ MLHSKDPAIREVARAQVWQV ARKRHRLREEHWRERDDELV RCFLNSELAASPHAEALRRH GDIGSLWSDVQRWLRIYHLS LVVQDDRNGLDPLGLRVPHH AKWLDHKSVLRHVKLHLKIR HQTRWKGLADQGKTVRAHGG VGAKFMSTWAGLSDDDYRFG VKARLNQIDTNAVLKRKRLR SHKTCRDPTCSSAETLAHVL NHCESNMDAIRQRHDDALEQ IGSKIRNALKRGKSTAELRL NQTVPEYTGAALRPDIVLRI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VAAKKMVIADLAVTFEEHAA GARHSSLQLSHDHKTLKYQP IVAELQLKGWQVQTAAIVYG SLGSVQPSNSTPTRKS (SEQ ID NO: 1436) |
| NeSL | Utopia-1_PU | ADOS01001321 | *Pythium ultimum* | GCGGTGTACGCGCACAACGC CGCGCTCTTCGAGTGCACGT TGTGCGCGCACACCGCGCGG GATCTCGCCGCGCTCCAGCA GCATCGGCGCTCCGCGCACC GCAGCGTCCGCTTTGTGGAT CACTTCCACAGCGGATGCGC GTGCGGCGTGAGCTTCCACT CGCGTGCGGCGGCAACCAAG CACGCGCGCGAATGTCCAGA GAGCGCGTTCTCGGTCGCCG CCGCCGCGCACTGCAGCG GCCAACACCGCAGGTATGTC TCTCGGCGCCGACGAACGCG ACCACCTCGCGTCCGTCGGC GCCTTGCATGATGTTGCATC CCCCGCTTTTGGCAACATTT TGCCGGTTGCGTTTGCGACC GCGGCAGACGCATCAAGCGC CACCGTGATCGCAGACGCAG CCATGCAGCACAGTGCTGTG CCCTCTGCTGCCGCCCAATC CCCTCGGCGTGCGCACGTCC CCCCCGTGCCGCGCGCCACC ACGACACCATCCGCGCTGCG GATTGGTGGCAAACGCCGAC GCCTGAACGACGACGGCGAC AACGAAAACAGCGACGGCCG CGACGCCGACATCGAGATGC GCGCCGACGACACCGACGCA CCAGCGCCGACCAACCCCGC GACCAGTGCGGCTGCAACGC CCGCGCGCACAGCACCAGCA CCAACGGATGCCGCGACCGC GCGCCGCCGCCACACGCG (SEQ ID NO: 1192) | TGATGCGGGTCATATTGACC GAAAGGGCACCATCCACGTA GGACACCGCCCTCAAAAACC CAGTTCAGTTTATTGACACC CTCCACTTAGTGACATGCAT ATTCAAACCGATACATATTC GTTAGGAGAGGTTACTAACT GGTAATATATCACCATTTC (SEQ ID NO: 1315) | MGTQSARERGAPSAPHSHTL GPRTPPRPPACSKHGELESA AGGRDGQCSDGAERERDAER DIRANERDCNGDGDGDDADS DSDDRNDARRRSRRPRATAT TTTSAPTTTTTTTTSATTSA TTPATDSSPWVLRFDGACRR NPGPGGAGAALFEPGGAVVW TVSHYLPGSETNNTAEYSAM LLGVRSAIHHGATRLRVEGD SHLALSQVRGTFACTNRRLR KLRNRVQAALRELGDYRLVH IDRQANAHADRLANRALDLR KTKVDCGPHATTTDACVQPA EILAPTARLSSSSSSSSSSS SDEPMPGLEEPAADDETDAD AEADIAMRDGGEIFPTLQIG PGSAPAQQPRLRLRQLSDDE SEAAARTLEHFANDMASKIA DADDWRSGEGYISAIPVRLR ELLAPYAVPIRSPPPRNASSR PPRPQSRPPRPPRVTRHQRE HRLDEALDDLAAAQRSTSTD QRSIRNARRRVGIRTAQAQ SDLRSQFATNERACVESILR AAKPDGTEPQASAGTCPIDR ATLHAHFAGVNTPRERFDFD DALGADFRAALDVLPPPDQA ADAFADELSLGEVEDQLDRV VASSSPGLDGVGYDVFKRFR LQLLPLLHAAYQCCWRHRRV PATWKVGLVRLLHKKGDRAE PNNWRPICLQQAIYKVYSGL LARRLSRWLEANERFTTAQK GFREFNGCHEHNFVASSLLD QTRRLHRKLYAVWYDLRNAF GSMPQPLMWRVLARLGVDTA FLQRCEDIYADSFFVVGNAA DGATDPVRQEVGVYQGCPLS PLLFISALIPLLRALQRLPG VGVPLADGVRPCTTAYADDL KVFSDSAAGIQQCHGTVARF LRWTGLRANASKCALLPVTT TARGNPAIDDTLQLELHGDA IARLTLQSSYAYLGVGDGFD HVQHRVQLAPKLAELKRDAV ALLRSGLAPWQVLKAIKVYL YPRIEYALRHLRPLQSQLEG FDRAVAKGFRHLLRLPANAT NELLYAPVSSGGLGLLPLVE LHKALQIAHGWQMLHSKDAA VQAIARAQVRQVVQKRYTLD ADHWQGRDDELVQLFLNSEL AASPHATIKRRNGDIGSLWS DVQRHLKTLQLRLETREPTA DAPDSPNGLLHLRVPHHRKW LSHKTVLRHMKLHIRLCHKH KWQSMSDQGRTVRAHGQAGS HFVSRGVGLWDADYRFALQA RLNQLDTNSTLKRRRQRTNA TCRAPNCSRTETLAHVLNHC ETNMDVIRQRHDGALEQIGA AINAAIKGRRTDTEVRLNQT VPEFNGPAWRPDIQVRDARS KTMVIADLAITFEDQPNDQS ASSSLQHSREHKIAKYQPIA AALERQGWRVHTSAIVYGSL RSVHPSNFTVYTELLGLLKR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | DARRLNTTLSCHCIRSSRRV WNWHCGQHRARQHQRCQEGR AHGSGGNQRAEGGTATT (SEQ ID NO: 1437) |
| NeSL | Uto-pia-1_SM | . | Strigamia maritima | GGAGTGTTCTTTTCGGAGAC GCCGCCTACTTTAGAGGAGA GAATCCCCACGGGCATCCTC ATTTGATCTGATCCATCGAG TATCTGCAATAGTCGGCGC ACTCCTTTTGCCATGATCCC GGGGGTCTCATGGTAAAAAG GTTTGTGGCACGGCTTAGTT GACGCCCCTCTTCCACGTCA CTCGGCCTGCATCGATCGAC TGCTCTCTCCTCTTCCTCCC TCCCTCCTCTTCACGCTCTC TTCACGTGACCCCTTCCCAT CCCGCCCCTCGGCTTTTGGC AAAGATCTGTGTGTCCTCCA AAGCACCCATCTACCATTTG CTCGAGTTGCGATTGGTCGA AGCTGCCACGCCACTCGTCT ACTCTGCCTCTCTGACCCCT TCCCCCCTCTCTCCCTCTGC CGCCCTCGCCTCTCGGGTCC CTTCCCATCTCCCTCCTCCC ATCCACGTGCTCCCTCCTCT CGTCACGTGATCGTTGCGGC TCGAC (SEQ ID NO: 1193) | TGATGGGAGAGTGAGGAATC TTCTCCACTGTGCAAAACCA TACAGTCAGAAGATGCTAAC TACTAGTTTGATACCCTGTG CCCCCTGCAATGTCCCGCGT GTCGTACCCAAGCCCGGCTG GCATTGAGACACATTAGGCT CTCGCTCCCCCGTATACTCT CATAATTTCGTGTACGCTAA TCCTACCCTACCCCTCCCTT TGACCACTCACCCAACCATG TGTATAGCTGTGCTGGTGAT CCCGGGGCGGTTATTCACTG GTTATCATATCATTCTAAAA TGATCTTTGATCTCTCAATT AACAACTAACTTATTTCTGT TTGTTTCATTGTTTCACCTC GTAAGAGGAAGTTCATTGTG CGATAAATCAA (SEQ ID NO: 1316) | MATVRLKYPYPPEGILCGPC AANTNAPQTRPYSDKSGLAK HLKLYHKATLWECRHCGHEE SDLRKMKKHISTNHPVAAAA APTVPPRLGPTAPPPPRVIL RPRFIPRPRTPSPSSSSSA SSPASSRRSVSLPPASPPVS SASSPAARSGRNSPDSQGTA PVTPIGTVRNSPAGSPALSY STASPIASTITTPRHLSPAS PALSAGPGSLGASPPVSPTA ATVPPAPPATVPAVMAATVP FVAATTVPSVGSSTVPQRPA GPRRPPPFPIDDWIGRIARV SSLPELDAVSRLLEDEWKRR PPDPNARPASLHPTRRPPPP STRPRPCHGTGGTSVSLAAL TSSCIREDHRGSLPLLCTSG WDSPWPLSPSPSSHCPSSNP CPSSSTPPSSLLGPPRHSHL TWRGSGSTTPSHRHCSRARY HHLLWRLPYPSSPRLPYPPS ALARYPSVPPALDDPLPSLS TIGSEGSPECHLCRNWTPSQ GCSRMKWSRDAPLTPTPDPP HSIRHAALPLHLLALVPAMG PAELQSLWRRSRPRAFAKIT EGASPFCALPVGTVHGHFLQ VHQATAHLPTPVPLPPLRPP RSSDPLVTPISPGEVLDRLR RATDTAPGPDTIIYSEWRAI DPTGRLLSSLFQKVQTFGAP TRWKESTTTLIHKGGDHTAM SSWRPIALLSTVAKIYGSIL SHRLTTWAVQNGRLSLSQKG FLPFRGCLDQNYLVQSCLQD ARRNKKTLSLAFLDLKNAFG SIPHLTIRHSLEWLGLAPSS IDILEASFLGSSTRVRTETG LTPPISLDTGWQGAPLSPIL FNLAIEPLLRTVPSAHSGFS LHGHWSWAYADDLAILAPST PALQSQLDAISGMADWAGLS FNPAKCATVTLTGKDNSRDT LSLQGSPVPSISDGDAYKHL GVPTGTTTFPSGTDAIKKMT TDLQAIDHSDLAPAQKLDAL RTFIMPQLSFPHLSHGSVPKA PLTQLDKKIKRAAKHWLFLP QRASNEILYMSHLHGGQSLL PLSVLADIGQVTHAVALLQS RDPAVADLALRTCREVASKR AKKTVNGPELAQYLSGSTDG IYCTPTSDIPSLWTTARAAT RRLSSTPLTWTSPLPSGVP FLSINGSPLSPFRVQSTLTN AIRHNHLSTLIAKRDQGNSY RTSHDPDPSNYWVKGGDFLR FCDWRFIHRARLNLLPVNGA RRWDANSIKTCRRCGAPNET LAHVLNVCPVGLPEMKKRHD AIHARIKKALRPSPHTWHHD RTVPGCGPLRPDILRISERD KSVAIVDIHVPFDNGTDAVE |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | RAHETKRAKYELIRRHYEHQ GYRVTFDSLVVTALGRLWRG SEAALQALQISSQYSKLLRK LLVADAIHGSRNVYAHHMTG MVM (SEQ ID NO: 1438) |
| NeSL | Uto-pia-1_SP | AAGJ021405 37 | *Strongy locentrotus purpuratus* | AAGGCTCAAACCAGGCTGCC AACCAAGCTGCCAGCTTAGG CACCAACCAAGCTGCCAGTC CAGGCTCCAACCAGGCTGCC CACCAATCTGCCAGCTTAGG CTCCAACCAAGCTGCCCACC TAGCTGCCAGCTTAGGCACC AACCAAGCTGCCAGCCGAGG ATCCAACCAGGCTGCCCACC TAGCTGCCAGCTTAGGCTCC AACCAAGCCGCCAGCCCAGG CTCCAACCAGGTTGCCACCC GAAAGTCTGCCAGTTTAGGC ACCAACCAAGCTGCCAGCCG AGGCTCCAACCAGGCTGCCA CTCGAGGCTCCAACCAGGCT TTCACCCGAAGCATTACCCA GGCTGCCCGTTTAGGCACAA ACCAGGCTGCCAGCCGAGGC TCCAACCAAGCAACCAGCCC AGGTTCCAATCAAGCTGCCA GCCGAGGCTCCAAGTAAGCT GCCAGCCGAGGCTCCAACCA GGCTGCCACTCGAGGCTCCA ACCAGGCTTTCACCCGAAGC ATTACCCAGGCTGCCCGTTT AGGCACAAACCAAGCTGCCA GCCGAGGCTCCAACCAAGCA ACCAGCCCAGGTTCCAATCA AGCTGCCAGCCGAGGCTCCA ACCAAGCTGCCAGCCGAGGC TCCAACCAGGCTGCCACCA AGCTGCCAACTTAGGCTCCA ACCAAGCTGCCAGCCCAGGC TCCAACCAGGTTGCCACCCG AATCTCTGCCAGTTTAGGCA CCAACCAAGCTGCCAGCCTA GGCTCCAACCAGGCTGCCAC TCGAGGCTCCAACCAGGCTT TCACCCGAAGCATCACCCAG GCTGCCCTTTTAGGCACAAA TCAAGCTGCCAGCCGAGGCT CCAACCAAGCAACCAGCCCA GGTTCCAATGAAGCTACCAG CCGAGGCTCCAACCAAGCTG TCAGCCGAGGCTCCAACCAG GCTGCCCACCAAGCTGCCAG CTTAGGTACCAACCAAGCTG CCAGCCCAGGCTCCAACCAG GTTGCCACCCGAAACTCTGC CAGTTTAGGCACCAACCAAG CTGCCAGCCGAGGCTCCAAC CAGGCTGCCACTCGAGGCTC CAACCAGGCTTTCACCCCAA GCATCAACCAGGCTGCCCGT TTAGGCACAAACCAAGCTGC CAGCCGAGGCTCCAACCAGG CCTCCAACCAAGCTACCAGC CGAAGCTCTGCCAGATTAGG CACCAACCAAGCTGCCACCG | TGACGAAATGTTCAATATAT GACATTCTAATGTTCATGTA TTTTTTGTTTGCTTGACAAA GCTAGATGAATATATTCCCT GTCCTACTACATACATCTCG ATGTGCCCTTGCTAGACGAT ATGGATTAACACATGATCT GTAAACAATATATGATTTAC ACAATGTATTTATTGTTTCA ATAAATCTGTTCTTTTCACT TTAATACATGAAACATGACT GTGCCTTCTCCAACTGGAA CCTACATAATTTGTTAAAAT GATATAAATATTTCGAAGAT GAAATTATTATTAATAA (SEQ ID NO: 1317) | MSHSITEVFDYPLPSRWKCT VCLENFFNQQTLKRHQARHH QTTSFLYVFRCSACQAEFDS ARKASNHWQSHKRKPILSQP AVNEIPSSGLDPSPPRSRPP VEVIGSSFPDDVSMLSEPST PSTSLQMDPEVVHPPSRSIS FSPMHLSPTQPASPIQIGVE VSFNSSSLQMDPEVVQPPS PSISFSPMHLSPTQPASPIQ IGVEVSFNSSGSLQMDPEVV QPPSPSISFSPMHLSPTQPV SPIQIGIEVSFTSSSPLQMD PEVVQPPSPSMSYSPMHLSL TQPDSPIPVDIDVIPAAEVP LPDIEIPPSPDRHPAAEVPL PDIEIPPSPDRHPVAEVPLP DIEIPPSPDRHPQSPPRPVM MEQPVHTPPPADTQQANGPQ HWVTVLANATNWEDFGRVCV EFANHAVEAARSRQDAPQVR PAAQRQPRRPTRPRQPTFDV REASRLQKLYKRSKKRAVRH ILRDDAPSFSGSNEQLLDYF KEIYAPPEIDENRAQQLAES LFTDLEEAKESAAALMSPIS QQEISTRLSRMSNSAPGKDR LEYRHIRQADGACRVTHIMF NRCLQEHRIPSAWKEATTIL IHKSGTTDDPANFRPIALQS CLYKLFMGILSDRMTQWACN HNLLSPEQKSARPCEGCHEH TFLLSSVIKDTKRNQKTANI AWLDLRNAFGSIPHQAIHAV LTTIGAPVSLVMLLKDTYTG ASTSFLSTSGETDPIQIQSG VKQGCPMSAILFNLTIELII RAVKKKATDDGLGLVVHGQR LSIMAYADDLVLMSKTPEGL DAILSVASEQAETLRLAFKP TKCASLSLSCRHGTSVLPRE YTVQGHLMPALDEEEQYRYL GVPFGLPRFTNLKDLIGKLK GNIETIASSLLAPWQKLDAI KTFVQPGLSFVLRAADYLKS DLRSLKSAITTNVKKICQLP LRAANAYIFAAKESGGLAFI DPNVDADIQVITQAVRVLSS DDEVVQTIATSQLKSVVHRT IHAVPTEEDIDNYLSGSNEG LLANSGNSGQASSLWSRTRS AARRLHLTLRATTSGTVVVN QQADIDHTRDILPASITRGL RLIQRTTNAEKLKSLPDQGK VARSLSNDPFANGSSWHATG KFIRFCDWRFIHRARLNCLP TNVATKRWKANANGKNGHQQ ETLPHVLNHCLPNMVPIRRR HDNIQQRLVTAIRHGDVFVN QHVPGDPNPRERPDITVIEG |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TTAGAGGCCCAGAGCCCACC AATCCCATAACGTGTGAGAT ATGTGAAGCTTCCTTCCACA CCTCCGCCGGTCTCCGTCGC CACACGGCCAGGCTTCATCG CACCACTGCTGAACACACTG ACGACAGC (SEQ ID NO: 1194) | | NKVTVIDISVPFDNGPNACT TAAQAKVEKYSALRQALRDM GRDVEVHGFIVGALGTWHQG NERALGRLGVSRWYRTLMRK LCCIDAIQASRDIWVEHVTG HRQYE (SEQ ID NO: 1439) |
| NeSL | Utopia-1_TSP | . | Trichinella spiralis | TTTCTGGTATGAATCCCAAG CGGATTCGTTACGAAATTTG CATAAGTTTTTGAAAAAATA GGCATTTGGTCGAGTGCTCG CACCACCATTTGTCGCGGGT CGTCCTGATATTCCACTACA TTCAGGAACGGCCTATTCCC TTCGGGGAATTGTGTTTTAG GAATTGGAATCGGTTTGGTT ACGATCGGTCGAGTGGTTCG TGAGATCGAGTGACAGCCGG GTGGCAGCGACA (SEQ ID NO: 1195) | TGATCCGTCCCGAACCAACG GAACCACATTGCCGCATGAC TTCGATTTCGCTTTTGCTCT TTTTGTATTTAATTTTGCTA TTAACAATTCAGTTTGTTAA CTGTTTTGTATTCATTTGAA GATCCAAATAAAAC (SEQ ID NO: 1318) | MCSAKTPALKSGRRRGKEVN YEGQIVRVERRRGSRSSTSA TDLGTRMVTRGRKKLMEASV REAGHHGGESASTVDVDVVE SKKITGKTARRNRRAPSGDG KRRESCGAECGQAVCGNAVA DRSEASSPRTPNVSKSGRDK CGQPTIKASTPSPPKRKPTT SSSPRTPCLSKRGARSKIPS TPDTPSTSGGSGKQRVLVSP LLRTEKLPDLEVLQRTEEQV TVRATFPIAQAVVCPLGCEK PYTAVRPDGQFAHQTLTRHF MRVHNCHSVQWHYRCRNCNT DFLPADHRYPLRVVNTHVRS CVSRWEITRKLGESEDLHGV RCDLCDYVGVSKRAVGLHRR RHANENIMQNTGTAAQIEAL SKQVGEIRVAGDYSQFKFGK RVRQYVAPTQRRDGLDEEEV HEAEEEEVPAESRTILGEPS TATAIGAEEISATGPVRADT AAQQMICRIGQWCVWPQDYH SIPAPQCWTDTLMDLMIEQI VLQRYPDGAGVSVMSCSAVS AAIHHEISAEFAAQVMSSHD ASLYCIIPVNVRNHWQMIVL DVAERVVHYYCSLREHNTVV LSSLLSLVELSGKHTGCTSW KIETHDGAPVQTNAFDCGPF SCLFLKHLLHGIDMNFGDRE SAALRTDLKFMIDAVSTPVV PATDKLKKKPDGSATQLTQF QQKFLSASDNWQSPDVDLQA VYDEVVESIVSGHNEPSSRN TSRLQKKSPGKGGKGQVRRR SAVTRDPAWLKSASAVQKAF NSAPARTVNAILRRPNACPS FTATQVADHYFNLRPAVTSL APEVIDILPPPATDHSMLVA ELSESESVWEKMQKAPNSAPG ADRITIRMVRMADPGAMILT RFYRACLLRKWVPLQWKQSV CKLLYKDGDKERLANWRPIA LEPVLQRVLSAVVASRVTNW ARANGLISLEAQKGFQPADG TSEHNFVMEVAIQEARRTNA QLAISWLDISNAFGTVSHQL LFSLLERYGLDPTFTSFIQN LYKDATIVVKGANGTHVTAR WSVGVRQGDPCSGILFCLFV EPLLRSVLPSLPCEAETTAV NVLGQPITALAYADDIALFA PSIGVMQQQLCKIQGMASAM GFRFNPKKCASLYLNRAVVN AATFTISGEEIPALVHGDTF RYLGVAAGLGKPQTPFSLLR ENLREAELIFRSKLAPWQKM DAYRTYVLPRLTFQLMIAKF NNIKQSAGQYDRAILRLVKR CFQLPVETSTDFIRAPRQCG GLGVPSLRELYATAKVSRAL KMLWSPCRVVSSLAASQLQR VASAYFAKRLRDVEAADLST FMNAARSTPLDRSGYPTCLW |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | MDARKQMSYLTKVAGVDCYF LVGEAGTSFFIRNGLGQTVS VLSPLRKNKVMSVLGGAIQT RHLDAWLQCKRQGKTASCIV LDRSSSRFITTGRYTSFAAM RFALPARLDLLPCRARSSMR SYQNCRRCGYDRETLPHILQ HCRQFSAPAYQARHDAVQGR LETVMRRRFPNLRVNRALPE IGSNKRPDLVVVDEEKRLVI LLDIAIVFENTAAAFVDART RKWAHYEKEILAYRLRGYSV TYDAIVVGALGTWDPKNDAI LKRIGVVSQRYLRLMKVLVV SEMLEHSSRIYRKHLGLRDL LPDTGTKRRPVGTTETDPPG GDLRQKKRNTISARASGGKC LERRFTSPVGTPSQRGELQC QPCPGPRRPALAGIAPNPPS LQPRKPPPRQHQKPVTKSTA H (SEQ ID NO: 1440) |
| NeSL | Utopia-2_CMy | . | Chelonia mydas | GGCAGAAACTGCACSTTCTA GAAGACTCACTGCCTATCCT GAGGAAGACTACCGCTTTGG AGATGGATTCTACTGCCGCT ATTGTATTTTCTAAATGGAC GCTTCAAAAGAAAATCTTCA TGCTGCTTCGGAGGCTCCAG GACAGASTGAGAAGATGATC GCTCCCTCGCCGATTCCACA GAAACCTTCAACTGCCGCTC GGACCGCTGCTGCTCCACGG AGCGCCCATCGGGGAACAGC CTCTAAGAGACCCTCAGCGC TTCCAGGACATCGCAGATGA GCAGCATCGATTGGAAAAGC AGCGCCTCCCTGAAGAAAAC CCGTGGAGATGCTGCTGCAG GGAWATCTTGCACCTCGGAG ACGGCCTCCCAGGACATCGC AGCCAGGACAAACATCATCT CGCCTGCTCTTCAGGASAAG GATGCCMSAAGAACTTMTCC CACCTCCTCMACTGCCCAGG ATCCTSATGCTGGTCGTCGT CCTGCTGTGCTGGAAGMKAC CCCAACTGGCGAGACCTCAG AAACCACCCAGMWGGACCKC AACATCTCACTAGATGCCTG CCCAGCCGAACCTCTCCATG CWACTCTCCCAGAGCAACSA GAACCATCCAGMGAATCCGC TGATATGACTGAAGCCMATC CAACAGAGGGAGAAGGAAAG GAGAATGACTGCATCTATCT CCAGTATCCCCTCCCTACGG ACACGCTCCTCTKCCCCTTC CGCTATCCGAGGGTTCCAGT ACATTGGCAGTCTCAGCAMA CACCTCAAGAGAATCCATAS CAAGCGGATCACCTTCCGGT GTGCCCTCTSCGACCTGCCT TTCGAGACGCAGATGAAATG TAAGTCTCATCAAGTCACCT GCAAAGGACATCTCGAACTG GAAGAGTCCAACTTTACCAG TCTATGTTGCCGCCACCCCA TCTCTGCTCCGAAAGCAGAA ACACCAC (SEQ ID NO: 1196) | TGAGCTGGAGTGCCGATGAG AAGCGCAGTCGGGAAAGTAA CTGAAATACTTTCCTCATGG ATTGTATTTTCTAAATGGAC AACCTACCTAATTCTCAATT ACTGAGGGACAATCTCCACT CATTGATATATTTTGCTT TCCACAACCAAATCTC TGTCAACTTTTCATGAGTG ATGTACCCGAGTACTTGGAT TCTAATATCTAAACTGTATT GTTAAATCTATTCACCTAAA TTTGGTTATTGCTGATTAT GTACTCTATGTATCATATGA CTTTTAAAACAAACTTTGT ATTTGTGGATAATCTAAGCA CTATACCCAGATGTACGAC ACTCTTTTCCCAACCTATGT ATTATATTTTTTTAACATTA GCTTTAATAAAATTTTTAAA (SEQ ID NO: 1319) | MLQLRLPTPQTLRLLHPSQL PQSHSTKRWSNIYEERARAP KDTTIERVSAASKIPKLDPA KRRIGAPLQLMQGNSISRQL SASSQYVQHNAWRRVSAPPH TGNFTGSCRRKLALPHRPPS ETQPAESYLHCWTTQRDPTL ADQHGLQDHPTGLPPEGSHC IKDPRQNSSTEGQRRSGNSQ ARRIPKRASTAASKTVLPKR TSAALKSVREDTALVLEDPA KWSSQHREGXRQQANPTAVF QPEPAEIEQQPXVRAATPWQ AAWMEELARTASFXDFDLLV DRLTKDLSAEIVSGRKGTQE NTPTAHRQNQNNMREARRRN ISRCYDPAAASRIQKLYRSN RPKAMREILDGPSSYCAIPS ERLFLYFKGVFDRVAQNDMQ RPECLXPXPRVDYAEDXEQD FTSWEVEARLTKTKNTAPGK DGIRYNFLKKRDPGCLVLTA IFNKCKQFRRTPSSWKKSMM VLVYKKGKQDNPNTRRPISL CSTMYKLYASCLAARITDWS VNGGAISSIQKGFMSCKGCY EHNFVLQTAIHMARRAWRQC AIAWLDLANAFGSMPHQHIF DMLREFGMPENFLQLVRELY EGCTTTICSMEGETPEIPIR SGVKQGCPLSPIVFNLAMEP LIRAISSGLGGFDLYDNRVN ILAYADDLVLIADNPESLQQ MLDITSQAANWMGLRFNARK CASLHIDGSRRDSVQATSFQ IQGEPMIFLEDGQAYQHLGT PTGFRVQQTPEDTIAEILRD VARIDSSLLAPWQKINALNT FLIPRISFVLRGSAMVKVPL NKADNTIRQLVKKWMFLPQR ASNELVYISHRQGGANVPRM GDLCDVAVITHAFRLLTCPD AMVRNIAESALQDAVKKRIA RTPSNQDVATYLSGSLEGEF GRDGGDFASLWTRARNATRR LEKRIGCHWTWCEERQELGV LVPQVKNTDHTIITPRARTM LERTLKDAIRCQYVENLKRK PDQGKAFEVTCKWDASNHFL PGGSFTRFADWRFIHRARLN CVPLNGAVRHGNRDKRCRKC |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | GYANETLPHVLCSCKPHSRA WQLRHNAIQDRLARAIPPPV GKVAVNSAIPGTDSQLRPDI VITNEDRKKIIMVDVTVPFE NRTPAFHDARARKVEKYAPL AETLRAKGYQVQTHALIVGA LGAWDPSNERVLRECGIGQR YARLMRQLMVSDAIRWSRDI YIEHITGHRQYQEG (SEQ ID NO: 1441) |
| NeSL | Utopia 2_PCa | . | *Phytophthora capsici* | ACCGCCCAAGTCTCCACCGC AGCTGCGACTGCTGCTGCTC ATCGAGCCGCAGTAGTCGCA GCTGTACAAGCACCACCTCC TACCGGACGCGCCGTCGTGG AGCACCACGCGCGCGCTGAG CCGCNTCAAGACCAAGAATT CCAGGCTCGCGCGCGTGG CGCTTCAAGATGGCGACGCG ACCAGCAGGAGTGGCCGCTC TACTGACGGCGGAGACGAGG CCAAGACCGAGGACAGCGAC GCGGACGCAGCCAAGCGCCA AGCCGCTCAAGCAGCACCGA GACCCCATACCCMGGACACC GCGCCGTACGACGGCCACAG GGACTCGGTGCTGGCTGTGT ACGCACACAACGCACCTGCA TTCACCTGCGCGTTGTGTGT GTACACAGCACGCAACTTCG CCGAGCTGACCAAGCATCGC CATGCAGCGCATCGTCACAC CCGCTTCGTGGATCACTTCC ACAGCGGGTGCACGTGTGGC ATCGGCTTCCAGTCGCGCGC GGCAGCTACGCGACACGCTC AAGCCTGTCAGACAGCACA CACGCCACCGTAGCTGCCTC GCGCGACCCGGCMNCCASTG CSSCCSGNGCCGGMAGCGAS GAGGAGGACCNCGCACCCCC CGGTCCTCTSSTCGCGGCAG CATCTGCAGCTGCAGCAGCC GCATCAAGCGCCACTCCAGC TGCAGATACTGCCACCACGC AGAGCGCCGTGCCCATCGCT ACTCCTGGGCCCCAGTACGC CCCCCACGTGCTGGAGCCAC CTCCAGAGCTCCGAGTTTCC GGCAAACGCCGMCGCCTCAA CACGCCGATCGACCTGCAGC CGCTGGACGTGGACGCGCTG (SEQ ID NO: 1197) | TAAGCTGGTCATTTGACCGA CAGGGCACTACCCAGGTAGG GAACCGCCCTTCAGAAACCC AGGAAGACACAACACCCTC CCTTTAGTGACATACATATT TTAGGCTACATTTCAGTTAC GGAGAGGTTACTAACTGGTA AATAAAAAGCACTTT (SEQ ID NO: 1320) | MQDMEEELLLDVEMETETTE PQTSTAXDATTTTDRPTRWG PHPRAVAAAAIAQLVTGEXA XPALPSRQDRRPAPRSHAPT RSRWGPRHQAVGAAAIASLA TGLPASAAPVSRATKHGEGR RRLQTRWGPRVSIPRAARRP GSRWGPPRAAGASGQLPASA SGATGOLPEHVEAITTTPRV ASDADEGPTPPDPWILRFDG ACRRNPGPGGAGAALFKPSG AVVWTCSHYMPSSNETNNTA EYTALLLGVQSAVHHGATRL DIEGDSSLVIAQVKGTFACR NAKLRQLRNRVRHALRSVEK YTLRHIDRKANAHADRLANR ALDRRSSSSECEPHGSCMER CCGTDTTPAVQGPTPQAAAA VPVQVWPQWQRQTMVAWTTS HGGRCRDCSTRCGRSLPSLA HRPRLSPRRQPRLRLRQLSD EERDXAADALQELSDVMASK IVDADSWDTGEGYISSIPER IREVLQPYTTRPPRPGHQQQ QRRRPPRVTRNQREHRLDEA LDDMQATQQAAPRDQRAIHR ARRRVGRVRASMAKQELRQA FAKDESKCVSKILAGASAET AAEEHVDECPIDAATLHAHF TGTNAPRTDFDYDAACGQEF RGALDSMQPPTVATDAFEEE LTIDEVEDQLTRAAKTSSPG HDGIGYDIYSRFAAQLVPLL HAAYQFCWLHRRVPALWKLG IVRLIHKKGDPMQPTNWRPI CLQPAIYKIYSGLLARRLSR WMEQNQRLPMAQKGFRAFNG CHEHNFVATTLLDQTRRSHR RLYQVWYDLRNAFGSLPQQL MWSVLRHLGVDASFIARCKN IYQDSAFVVANAVDGATDPV RQEVGVYQGCPLSPLLFISA LVPLIRRLEKLDGVGVPLAE GVRPCATAYADDIKVFSDSA AGIRKCHDAVTRFLEWTGLR ANPGKCASLAVTTNARGNPV RDDGVHLELQGEVIAPLSLH DSYRYLGVGDGFDHVRHRLQ LEPKLQQIKREAVALMQSGL AGWQVVKALKTFVYPKVEYA LRHLRPLQSQLQGFDRAVVR GLRHLLRLPQSATTEFFYTP TSGGGLGLQSLVEMHQALQV AHAWQMLHSKDAAVVAVAKE QVCQVARKRYRLQEEHWRGR GDELVRLFLNSELAASPFAD CLRRNGDIGSLWTDVQRTLR LHHLSLTAQDDRDGQDPLAL RVPHHTKWLDHKTVLRHVKL HMKIRHQTRWKGLVDQGKTV RVHGGLGAKFVSTGAGLSDD AYRFGVKARLNQVDTNAVLK RKRLRSSKTCRDPTCSSAET |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LAHALNHCASNMDAIRQRHD DALEQIGSKIRGALERAKST TELRRLNQTVPEYTGAALRPD IVLRNVAAKKMVIADLAVTF EDHAAGARHSSLQLSHDHKT LKYQPIVAELRVQGWQVQTA AIVYGSLGSVQPSNFKTYTE KLKLHKREARQLDLQLSSHC IQASHRIWGWHCRRHREGQR SGNTSRASRGSGGTPRRTSQ VRARR (SEQ ID NO: 1442) |
| NeSL | Utopia-2_PI | . | Phytophthora infestans | GCTCGGCCTCGCGGCTGCCT TCCCAGGCGCCGCCGACTTC GCGCTCTGGCGCGGCCCACA CGCCGCCGCCGAGCCTCCAA GCGCGCCCGTTGGCTTCCGC AGACGCAGGGCTCGCGGCGA CGGCCCTCGCCAGCCCCCAA GACCCCCCCTACGATGTGGC ACCACCCGGCAGGGCGGCCG GCAGGCTGCCCGACTCGGTA TCGCCGGGTGCTACACTCTC AGCCGCCACAGCTCGGGCCT TGGCGGTCCGCCATTGGCCC TTGGAGCTCGACAGCGACAG CAGCGACGACGAGGACGCTC AAGACCCCCACGCCGCCGCC CCAGGACCCCCCGCAGACGT CGCGAGTGTGCTTGCCCCAC CCGGCAAGGCAGGCAGC (SEQ ID NO: 1198) | TAGGCGGAAACCAGGCCCAA GACGGCCGACAGGGCCCCAC CCAGGTAGGGAACCGCCCTA GAAACCCATTTCGGTGGTCG ACTCGAAGGCCTTACCTATT TTTTCCTTAGACATTCAATT AGGTAGCGACCAAATTACAA ATTTGGTAACGAGTAAGCCA AATGGTAATACACAAAACTT TTCTGTTCTAATCAGTGTGA AAACTGGTTTTCGCCTTTTG GCGGACTTTTTCACTCGCAT TTTTGGGCAATCGTCTGCGG CTAGCTTGCTAGCGGCGGAC GAGCGGTCTCCGGGGCGTT CACCTTTCCCCCGCGAGGCC AACTACACCGATCTTCTCTA CACTTTTCTAATTCGCCTCC GTCTTCGGTCTTCGGCTGTC GGATTTTTTTCTTTTTGACC AATCAGAGCGCGCCATGCGA CTCTTCTGGCCAATCAGAGA CCGGGCCCTGTCCTCGGACA GCGAGGCCTCCACGCCAGC CAATCAAGTCTCGGCAGCGA CGCGTCTTTCTATAGCGCAG CTGACGAGGCCGATCTGGCG GCCCCGATTGGTCCGACTT TCGGCCAATCAGCGACGACG AGGGGGCAGGGGTTTACACT TTTGCCCCCGTTTCGACTTC AACTTCAGGCCAAAATGGCG ATTTCGACCCTCCACGCGCC GTGCCACTGCTCGGCACCGG CGGCGATTCAGCGGGTGCAA CTTCGGGCACGTGTGCAACA CATGCAGCGCCATTGCACG CCAAGCGGCATCGCGGGACG ACGCCTCGGCCGCTCAAGCG CAGCCCCGCCCTTCCAGCAC GACCTCGCGCCGTTTGGCGG ATCGCCATCAAGACGTGCGA GAGCCAGGCGGGGTCGGGCA AAATATACTTACTCTAAGTA TGCCCGAATCCCTGCCCTCT CAGGCTGAACGCGGCCCCAT ACTTGATCTAAGTATGGGAG GGATCCCTGGCCTCTCAGGC TGTACGCGAGACCCGTACGG CCGAATCCCTGGCCTCTCA GCCTGTACGCGGGC (SEQ ID NO: 1321) | MLADPAALAAGLARAPPPPS APQDPSPAFPAGPAGQNPRA AAPARVEVHTVVAPPGRAGG MLPDPGLVDSSPAAATAATP APVAATATTARAAARVAVEH HAHAEPNQEHLPMARVLVEP MQVDECSSCDRSTLTADDGS GDDVAAPSSMLSNDVAAPMD VDSGTSCPPTLQQPLQRPRA LHVGSKRRRLDADDGEEAHQ LQEEEEAGIHAPALRLSAAS AQPASVLAVYTHNASRFDCT LCAYTAGSFASLLTHRNSRH RRTAFLDRFSAGCACGVPFA SRLAAARHAQACASLSSAPS AEASSAAGTSSPTADGADST VSAVAHAEPGLPHHNDTELT ASPPLVSSSDVEVQATKTEA TDNRWGAPLPRVLVASRIAG RLAQVPPPRWGPPLPRTTIA ARIATRLAATPAPRWDPPLP RSLVVSRIAARLLPALPDAP ACEEEEAKDSDTMDWAPTWTN EETKESEPHDEAPGQVDEET IDDADGEWLLRFDGACRANP GPGGAGAALFKPSGPVVWTC SHYDPSTTATNNTAEYTALL LGARAAADHGVTKLRIEGDS TLVIQQVRGIFATRSTRLRA LRNKVKLELARVGSFSLHHI DRQANGHADRLANAGLDRRR TKLECSVHPDGRGCTNTSVA TAAPTAPAAPLPSARPPAST AAPSPDDDHSDQGDIDDGEV YAAMCISPDAVPHRRPRLRL RRLTDEESEEAGNVVERLAA SLAAKIADAPDWETAEGYIT ALPYALYDKLQPYSQSQHQP PRQQQQQQRQRPRQQQQTRQ RRQRRCKRGGGSQHRQRKTR RRRPPRVTRHHREHRIDEAL DDLHALESRRPQDRTAISKA RRRVGRIRSALDQHQLRHRF DTDEKACVDGILAAARDKDR AASVTTTAQTAAPPHSAPAS APSSAVDDGICPIPGDLLHA FFTDVNTPRTEFDADSPIGA RFREALAQLPAAIAATELLM EPPSPDEVEDQLQRVRGTSS PGLDVGYDVYKTFTQQLLP ALHAAFSRCWTDQRVPQSWK LGVVRLLFKKGDRQDPANWR PICLQQAVYKLYAGILAHRF TRWLDANTRHADAQKGFRAV NGCGEHNFLAATLTDNARRR RRELHVVWYDIKNAFGSVPH ELLWEVLRRMGVPAQFIACC QGIYDAAAFTVGNAADGTTA PIQLRLGVFQGCPLSPHLFT AVISPLLHALKRLPGTGVQL SAVDRPGASAYADDLKVFSD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | TKDGITRQHQLVTDFLRWTG MVANPSKCSTMSVQRDNRGV LKTANLTLQLDGAQIPALGM TEAYAYLGIGDGFDHVRRRV ELAPKLRELKADTTALMQSG LAPWQVVKALKVYIYPRVEY ALRHLRPFQQQLQGFDRHLA RGLRHLLRLPTSATTEFLYA PTSRGGLGLLPLTEVHGALQ IAHAWQTLHSPDPAIRRIAR VQLRQVADARHRLDAEHWKE RGEELCERLLNSQLGTSAHA PPKRRNCDIGSLWVDVQRHL RSLGLQLQTAPADTHTGAPA QPLQLRVPHHDKWLTHKDVL RHVKLHIKNNHWHRWTSMRD QGKTARAHGGEGSGFLTQPR GMWEADYRFAVAGRLNQVDT YSVLKRRLRSHDRCRQPGC HRAETLAHVLNHCPGTMDAV RGRHDGALKRIERELHASAT DRRDRVELRVNQTVPSLAGP ALRPDLQLYNHTKKTVAVVD LAVAFEEQASDDASSSALSL IASHKRAKYDRIKRHLERQG WKVHLSALVYGSLGAVASGN YQVYTTHLGLLKRDAKRLDR QLSVECIQSSRRIWNLHCSQ HRTRQHQARPSQGPRGSRAT ETGGTPSQTSRR (SEQ ID NO: 1443) |
| NeSL | Utopia-2_PR | . | *Phytophthora ramorum* | TCAAGCCCCGCCGCCAAGCC CAGCTGCGGCTGTTGCCGCC CCTCCAGCAGCAGCAGTCGC AGCTGAACCTACAGCCCCTC CTGCTGATCGCGCCGCCGTG GAGCCCCGCGCGCGCGCCGA GCCGCCCCAAGAACAAGCAC CCCCAGCTAGCGCGCGCGTG GAGCCC (SEQ ID NO: 1199) | TGAGCACCTTGGGTTGCTCA AGCGTGATGCGAAGCGGCTG GACCGGCAGCTCTCGGTGGC GTGCATCCAGTCCAGCCGCC GCATCTGGAACCTGCACTGC AGCCAGCACCGCGCGCGCCA GCACCAAGCACCAGGGGGAA GTCGGGCGGCGGAGACCGGG GGGACTCCGCCGCGCACCGG CCGCCGCTAGACGGCACACA GGCCCACAGCGGCCGACAGG GCCACACCCAGGTAGGGAAC CGCCCTCAAACCCCGCCGGT ACATTATGGTCCGACACCTA TGAGGTGCAACCTGTACACA AGTTACACACCACATAGCGA CTACCAGGTATTTACTACCT GGAAGCCAAGGATTAACCGG TCGGTAATACACATAACTTT (SEQ ID NO: 1322) | MSGDVVSSDGSSRTTDASGD GDDGAGSSDAAGDVGVVAMD VDQGARRQQPPWQRVGGKRR RLNDVDDEDTRELAELLLEE EDEAGDHAPAPRLSAASARP ASVLSVYAHNAQRFQCTLCT YTAASFASLKRHRDSRHRRT AFLDRFSAGCACGAPFASRL AAANHAHACASLNRTLSVAA TPAAGELSPTAGAANATVKA ATVTPDSPRQDPPELAASPP LASSPDVAVQAADMQAPTRW DPPLPRTLVATRVASRLTDL TPPRWGPPLPRATVVSRIAA RLEAAPTPRWGPPLPRVVVA SRIAERLAPPELAADDETKD GEEDQSFTEPVAAARSXGGE DANGEWLLRFDGACRANPGP GGAGAALFKPSGPVVWTCSH YMPSSSETNNTAEYTALLLG MRAAADHGATRVHVEGDSTL VIQQVRGIFATRSTRLRGLR KSVKAEMARMEHVTLHHIDR QANGHADRLANAALDRRKTK LECGLHPDGQGCSSTAATTA VPSVVPDRPPSSTAAAPTPS AEPDETEQGDIDDGEVYAAM CIGPDSIPERRPRLRLRQLS ETEEEEAGAIVERLAATLAG KITDASDWATAEGYITALPY TLYDKLQPFAQHRHQPRPQH RQQPQRDPPLGTHDGDHGQP STSRSRRRRRAKDRLRRRP PRITRHHREHRLDEALDDLR AVEHASPHDRPAVARARRRV GRVNSAIAQQQLRHKFDKDE KACVDGILAAARASRGLATP SASASRHPPPVPSTAADDGS CPIPSDELHAFFTAVNTPAG TFEPMAPVGAPFRSAVAHLP AATSQPELLSDAPTTDDIED QLQRARGSSSPGLDGVGYDI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | YKAFAAQLLPALHAAFACCW RHKQVPQSWKVGVVRLLFKK GERTEPANWRPICLQQAIYK LYAGVLARRLTRWLDANGRH ADTQKGFRAMNGCGEHNFLA ATLVDQARRKRRELHVVWYD FANAFGSVPHDLLWEALERQ GVPSPFIACCRGLYADAVFT VGNAADGTTAPIALRVGVFQ GCPLSPHLFTAAIAPLLHAL KRLPDTGVQLSRVDCLGASA YADDLKIFSGTEGGTKRQHA LVADFLRWTGMRANPAKCCT MSVQRDTRGVLKACNLGLQL DGAPIPALTMSASYAYLGIG DGFDHVRRRIELAPKLQELK HDATALLQSGLAPWQVVKAV KVYLYPRVEYALRHLRPFHQ QLEGFDRHLVRGLRHLLRLP ANATTAFFYAPVSRGGLGLL PLTELHAALQVAHGWQMLNS KDPAIRRIARVQLRQIADAR HRIDAQAWQDREEELAQLLL NSQLGASTGAPPKRRNGDIG SLWVDVQRHLRHLSLKLETA PACAETGTAAAMLQLRVPHH DKWLDHKTVLRHVKLHYKNK HWARWAAMXDQGKTARTHGG AGSGFLTRPRGMWEADYRFA VAARLNQLDTHSVLKRRRLR XHDRCRQPGCTQGGDAGARA QPLRRHHGRGPRPPRRRPQA HRARAARVVAGRPGPRRAPG QPDGAVARRPRATARPPAVQ PHQEDGGGGRPGRGVRGAGE RRPGELGAGTHRRTQAREVC RRQATPRAPRVEGPPLGARV RLARRGAGRQPQGAY (SEQ ID NO: 1444) |
| NeSL | Uto-pia-2_PU | . | *Pythium ultimum* | TGACTGGTGTTTGATCACGA TCAATGAGGTGATTAACATG AGCCGGAGCAGGCCCCTTAC ACGCTGGTGCTGTAATGGTT CAGGAATGCTCTTATAGTA ACTCCACAGTATAATTTTTG TTAGCGGGGGTGAGCGCGTG CGCCGCCCCCACCTTTCTCT TTTCGTTTGTATTTGGTTCC TCTGGAGCGACTTCCGTGGC TTTTGTCGCGCGCTATCGCG CCCGGCATGAGGATCGTCGC TCCTGACGCCATGTGCGCCA GTATATCGGAGCCCCGTGCT CCGCTTGGGTGTGTGTTCCG CCACGACGCCACGCGATTTG CGTGCACGGCATGCGCTGGC GACTTCCGCTCAGTGCGCGA ACTCGCGGTGCATCGTCGAC GTGCGCACCGGTCTCTGGCC TTCCAGGACTGGTATGAGTC GTCGTGCGCGTGCAGAGCGC TCTTCACCGCCCGTCTCGAC GCGTTCGTTCATTCGAGCCG TTGCGACCACAATGCGAACC AATCAGCGAACGCCGTCCCC TCGTCCGCCGCCTCGACAAC GAGAGCGGACGCGGATGCGA CGGCCCCCCCTCCCGCTATC TCTCTTCCGCGGACGGGCTT CCCCCGCCCCTGTCCTAGTT GCGCCGCTCTCCTTCTGGAT GCGGCAACTTGGACGACCCA CGTGCACGCG | TAAGCGGGGGTCCAGACCC CACAAGAGAGAAGCAGGAAT CATGGTCCGCATGGACCAGT AGGGCACGCTCCACAAAGGT TATCGCCCTCAAACCCATCA CACGAAGGATCTAAAAAGAA AGCAACAATCGAAATAGTAA ATAGTAAATAGCTTAGAAAG GTCAACATGCGAAATGCATG AGGAACGTAAGATGGTAATA CATTTTTATA (SEQ ID NO: 1323) | MDYDDSEFFDAICIPDEDAD VLDDGDEGDEGGNDDESSEP LPLAITNAPSAPLHATMLCG TVTQPWLLRFDGACRRNPGP AGAGATLTRPNGIILWTHYR YIPDKTATNNVAEYEALLDG LRCAAHHGVKHLRIEGDSNL VIEQVKGIFACSTSLRPRRD QVREILRHFETYSFRHIDRA LNRQADRLANQALDLLKTVS VCALSQTRVQDDTGAAHGCW HWTPPDASPTDDASTSILTQ DVPVPMDIDDYDPDEPMNAA DDPVSINAEREGGTVYPVLR LGPNVVPERQKRLQIPWLPP REMQKLEKKIEVLGETFASR IRDAPDWFSAEGYITALTSE LATLIRQSTAATTGPNAARP CERTISKEKRRARRTTPLQR ALAEAKHELQIIQPDASRKS VRKAARRVKRISQAQQRHDL RRLFSTNERRCVEKILRDPP VGPSSTSSSLPATDDDRCTI DPADLFAYFQTQATAPTNFD FDDEGGELFRSVLDELPRAD QEVHLLEDEITRDEIEDQLS RISKSTAPGLDGITNAVYVR FKLQLLDALQAAFNACWRYN RVPSMWKAAFVRLIYKKGNR AVPSNWRPICLQQTVYKLYT AILASRLQRWMDANARFTMS QKGFRAFNGCHEHNFVATCL HDQTRRLRKKLAIVWYDLRN AFGSLPHEYLWRVLARLGMP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TGCGCTGCCGCCAGTGCGAC GGCGTTGATCCAGCGTCATC TACACGCCGTTCCTCCCGTA TCGACAGCCAACCGATCTCAA CGGCGATGATAGCCAACCTC CAGACCCGCGTGCCAACATC CAACAGCTTCCAGCCATCCA TTCGACAACGACAACGACAA CGACAACGACGACGACCCGC TGCTCGACGACGTGCTC (SEQ ID NO: 1200) | | PQFVARVRQLYADASFTVES RDGTTDPVQLERGVYQGCPL SPYLFIAALIPLVRALHKLK DQHGIVLAPGVTDCVSAYAD DIKIFARSGTGAKALHEIVV RFLSWTNMAANPAKCALMVT DGARGGDDTDASMTLSIEGE TIPRLTGKEGYVYLGVEDGL AHERRATCLRDSLKAASADV VRLLRSDLAPWQIVRAIKSH VLSRFDYVLRHLRPFLSLFD GFDKMLVRGIKRLCQLPQTA TSEFLFSPTSAGGLGFLPLK ELFAALQIVHALQMLHSKDA NVRAIARHQALQVVRKRYAL QSDHWSDREEELLEEFFNGT LERSPFALAKKVSGDIASLW TDVRVNLTKYGLKFGEAHGR RLQPLVSHTDKQLAPQQWAS AIKTHMRLRHLKRWTTLVDQ GKTARMHERIGSAFLTRPSG VYDASYAFAVRARLNQVDTR SALKRKRIVNNSRCRVSGCS ELETLAHVLNHCRFGSDSIR ARHAETLLLIKTTMERELTR PGRQHQRLLVDATVPEARDP VPSNDAAESNIGAMAPSISH LRPDIQLYDNKTMEAVIIDL AVAFEDQSTDDAASSSSFAR VKGVKTKKYEVIKQFLEYKG YTVHVAALVYGSLGSVDTGN FAVYTERLGLRKGAVRRLEC SLSARHINFAHRMWRRHAIA HTTGLRLIGTNSVQQQGVQR APAEKQQHQRPVQRPSRAQA PRDQPSQQQQSQQSFQQQSQ QSQQSQQSQQSQQSRQRHAP TPTPVPVPVPVPVSTPTLTP TPTPTRRPKPAPSSTQPQQG APAQRRQQREQKKQPACRRR HATAVRETPPAAPTAARTAT PTARPTATTRSTSTTRSTAT ATSTTRSSAPTSRPSAPRPR SSAPRPRSSAPTTRSAAPTT RSAAPTAIATTSVYKSRRTT NAISGATTRRSASSKRAPMQ PRTALTPTQQQRQ (SEQ ID NO: 1445) |
| NeSL | Utopia-3_ PI | . | *Phytophthora infesta* | GTACGGCCGAATCCCTGGCC TCTCAGCCTGTACGCGGGGC TATACTTGGTCTAAGT (SEQ ID NO: 1201) | TAGACGGCAAAGTTCTGGCC CGCGTAGGCCGAAAGGGCCC CGCCCAGGTAGGGTAACGCC CTCGGGAAAACCATTCTGGT GTTTGGCTGTTTTTCAACAG TCGAACTTCAACTCGGACA TATCAGATACACTTACTCAC ACATTTAGATATCAGATAGG GAACCTTTATTAGGGAGATA ACGGGTACACCGGATGGTAA ATATACAAAACCTTCTCTGT TCTAATCAGTGTGAAAACTG GTTTTCGCCTTTTGGCGGAC TTTTTCACTCGCATTTTTGG GCAATCGTCTGCGGCTAGCT TGCTAGCGGCGGACGAGCGG TCTCCGGGGCGTTCACCTT TCCCCCGCGAGGCCAACTAC ACCGATCTTCTCTACACTTT TCTAATTCGCCTCCGTCTTC GGTCTTCGGTTGTCGGGCTT TTTTCTTTTTGACCAATCAG AGCGCGCCATGCGACTCTTC TGGCCAATCAGAGACCGGC CCTGTCCTCGGACAGCGAGG | MPRSLASEPVHSSASRLPSQ APPTSRSGAAHTPPPSLQAR PLASADAGLAATALASPQDP PYDVAPPGRAAGRLPDSVSP GATLSAATARALAVRHWPLE LDSDSSDDEDAQDPHAAAPG PPADVASVLAPPGRAGSMLA DPAALAAGLARAPPPPSAPQ DPSPALPAGPAGQNPRAAAP ARVEVHTVVAPPGRAGGMLP DPGLVDSSPAAATAATPAPV AATATTARVAVEHHAHAEPN QEHLPMARVLVEPMQVDECS SCDRSTLTADDGSGDDVAAP SSMLSNDVAAPMDVDSGTSC PPTLQQPLQRPRALHVGSKR RRLNADDGEEAHQLQEEEEA GIHAPALRLSAASAQPASVL AVYTHNASRFDCTLCAYTAG SFASLKTHRNSRHRRTAFLD RFSAGCACGVPFASRLAAAR HAQACASLSSAPLAEASSAA GASSHTVDGADSTVSAAGHA EPDLPRHNATELTASPPLVS STDVEVQATETEATENRWGT |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | CCTCCACGGCCAGCCAATCA AGTCTCGGCAGCGACGCGTC TTTCTATAGCGCAGCTGACG AGGCCGATCTGGCGGCCCCC GATTGGTCCGACTTTCGCC AATCAGCGACGACGAGGGGG CAGGGGTTTACACTTTTGCC CCCGTTTCGGCTTCAACTTC AGGCCAAAATGGCGATTTGG ACCCTCCACGCGCCGTGCCA CTGCTCGGCACCGGCGGCGA TTCAGCGGGTGCAACTTCGG GCACGTGTGCAACACATGCA GCGCCCATTGCACGCCAAGC GGCATCGCGGGACGACGCCT CGGCCGCTCAAGCGCAGCCC CGCCCTTCCAGCACGACCTC GCGCCGTTTGGCGGATCGCC ATCAAGACGTGCGAGAGCCA GGCGGGGTCGGGCAAAATAT ACTTACTCTAAGTATGCCCG AATCCCTGCCCTCTCAGGCT GTACGCGGCCCCATACTTGA CCTAAGTATGGGAGGATCCC TGGCCTCTCAGGCTGTACGC GRGGACCAAGTACAGCCGAA TCCCTGGCCTCTCAGCCTGT ACGCGGGGCTATACTTGGTC TAAGTATGCCCCGGTCGCTG GCCTCTGAGCCCGTACGC (SEQ ID NO: 1324) | PLPRVLVASRIAGRLAQVPP PRWGPPLPRTTIAGRIATRL AATPAPRWSPPLPRSLVASR IAGRLLPALPDAPACEDEAK DSDEMDWEASEPHVEAPGPV DEETIDDADGEWLLRFDGAC RANPGPGGAGAALFKPSGPV VWTCSHYDPSTTATNNTAEY TALLLGARAAADHGVTKLRV EGDSTLVIQQVRGIFATRST RLRALRNKVKLELARVGSFS LHHIDRQANGHADRLANAGL DRRRTQLECSVHPDGRGCTN TSVATAAPTASAAPSTPTRP PATTAAPFHSDQGHIDEDDE RRADIDDGEIYAPMTLGPDE VPARRPRLRLRQLSDEELEA AGAIVERLSASLSAKITDAE DWGTAEGYITALPHLLYDKL LPYSRTAPRHQRPPRPSRNQ QDHPQPRRDQPQRNVDEQQH AESQQGEDQRQQQPPTRRRR RRGKRRGRRQRRHPRQPGQS TRASQQSRQRPPRPPRVTRH HREHRIDEALDELHTLERAR PQDRSAIDKARRRVGRVRGA INQHLLRHRFDTDEKACVAD ILEKAHAARAARTAQAAGAA TSTGGAATAPTQQAATSALG DADDGTCPILADELWQYFTG TNTPRWEFNPATPVGEAFRT AMARLPPATRLRELLTEAPT ADEIETQLQHVRGSSSPGLD GIGYDVYQRFAQQLLPVLTA SFKRCWTAKMVPQSWQVGVV RLLYKKGAHDDPANWRPICL QQAIYKLYTGVLARRLVRWL DVNDRHAPGQKGFRAVNGCG EHNFLAATLIDQARRKRRSL YEVWYDFRNAFGSVPFQLLW DSLQRLGAPADFIDMCKGLY HQAAFVIGNAADGPTAAIRQ QVGVFQGCPLSPQLFNVAIS PLLFALRRLPETGVQLSGDD RVGVSAYADDLKTFSSTKAG ATKQHELVAAFLAWTGMKAN AAKCSSMGVRRNSNGATEAD NLDLALDGTPIPSMTHMQSY TYLGIGDGFDHVHRRIELAP KLKTLKQDTTALLESGLAPW QVVKAVKVYLYPRVEYALRH LRPEDQLLESFDLHLRAGLR HLLRLPKNANNDFFYSPVSR GGLGLLPLVELHAALQIAHG WQMLNSTDPATRRIAREQLH QIADARHRLDKAHWKERGDE LCQLFLNLDLGTSAHAPPKR RNCDIGSLWVDVRKNLQAFG LKLETAPADAESGTPALPLQ LRVPHHEKWLTHRDVLRHVK QHLKNKHWRAWCAFQDQGRT ARAHGGVGSSFITRPGMWE SDYRFAVAARLNMVDTSATL ARRRLRAHDRCRYPGCRWKE SLEHVLNHCPGTMDAVRGRH DGVLREIEHALRAPSGARRE LRVNQTVPGLPGPALRPDIQ VYNHDQRTVAVVDLAVAFDR QDRDDPETSGLAKAAAEKKA KYTGIQRHLERQGWKVHLSA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LVYGSLGSVAPNNYKVYTEH LGLLKRDAKRLDRTLSVACI QSSRRIWNLHCAKHRARQHQ TPSQSRGRRVTETGGAPSRT DRR (SEQ ID NO: 1446) |
| NeSL | Uto- pia-3_ PR | . | *Phytophthora ramorum* | TGCGCGGCAGACCAAGACGC GCAGCCAACAACAGACCGTG CAGCGTGCGGGTGGAAAGCG CCGCCGCCTGAACGCTGGTG ACGATGAAGACCAGCGAGAG CTGGCCGAGCTCCTGCTCGT GGACGAGGACAAGGCTGGCG CCGAACACCCCGCGCTCAGG CTGCCCACGGCCAGCGCTCA TCCGGCCTCCGTCCTCTCCG TGTACGCGCACGCTGCAACT CGCTTCGACTGCACGCTGTG CACGTACACGGCTGCCAGCC TCGCTTCGCTCAAGCGCCAC CGCTCGTCTCGGCACCGACG CACGGCCTTCCTCGACAAGT TCTTGGCGGGCTGCGCGTGC GGCACGCCCTTCGCATCGAG GTTGGCCGCAGCCAGACACG CGCAAGCGTGCGCCAACCTC TGCACCACCTCGGCGACGAC TTCGACGGCAGCAAAGGCAT CAAGCCCACTGCTGCCGGA GGCAGACCCACCGTCCGTGC AGTGGTCACCGCCGCGCCG ACCTGCCCCGCCAGTATCCC TCGGAGCTCGTTGCGTCCCC CCCGCAGCCGAGCTCCACCA ACGTTGCA (SEQ ID NO: 1202) | TAGACGGCAACACTCTGGCC CGCGTCGGCCGAAAGGGCCC CACCCACGTAGGGAACCGCC CTCGGGAAACCCAGTCTGGT GTTCGGCCAAGAAATGCACC ACCACCACCGGCGGAGGTGCA TTTCGACAGTCGAACTTCAA CCCGACCACATATCGGATATA GGTTACAGCTCTAGTTAGACA TCGGATAGGAACTTCTTAGA AAATTAACGGGTATACCGGA TGGTAAATAAAATAAAAACT TC (SEQ ID NO: 1325) | MQDQVDAEQQARNRWGPPLP RPLVASRVAARLGEVPPPRW GPPLPRGVVVSRIAARLEAV PVPRGGPPLPRSFVATRIAD RLAPPSPDLSLLDEEMKESE PPDPTHHSADEDSTDAETAD AVMEPAFVSDPPTATPREWR LQFDGACRGGPNPGGAGALL YNPEGAVVWTGSHYMPGAKE TNNSAEYTALLIGARAAADH GARQLRIEGDSLLVIRQVKG LYATKSTRLRQLRNAVRHEL ARVGQHSLHHIDRQGNAFAD RLANRALDLKSDKVECKEHP VAGACTTCMGSPSAGPPATP PPTTADIEMADAGSDDELRA DIDDGEVYAPMRLEPGVIPT RRSRLRLRQLTDDEMEAAGE VVERLSAGLSAKIADADDWE TAEGYITALPYMLYDKLQQY TQVRHGTARSPAPHPQRRDV QGQVETHREPRHETIGQPDQ PGEPSPTRRRRRGKRKGRRQ RRHPRRTNCGGGGRQQRKQR HPRPPRGTRHHREHRIDEAI DELHALERARPQARPAIAKA RRRVGRIRSAIDQQLLRHRF DTAEKECVDGILAAARTARD ARTTVRAAAATGTTATPETA VTSGTEQQDDNGTCPIPSEV LWRHFDSVNTPQRDFDPEAP EGAAFRSAMARLPAATRFME LLKEEPSTDGIEVQLQHASS TSSPGLDGVGYDVYKRFASQ LLPVLKAAFKCCWTHKQVPQ SWKLGVVRLLYKKGDREDPA NWRPICLQQAIYKIYTGVLA RRLTRWQDANDRHAPGQKGF RPVNGCGEHNFLAAMLIDHA RRKHRPLYEVWYDFRNAFGS VPLGLLWDALERTGVPAEYI AAVQGLYDHAAFMVGNAVDG STAPILQRVGVFQGCPLSPP LFSAAISPLLHALQLLPSSG VQLSGDDRPGVSAYADDLKT FSGTKAGVTEQHELVAMFLR WTGMADGFDHVRRRVALAPK LKLLKQDATALMESGLAPWQ VVKAVKGYLYPRVEYALRHL RPDDQLLESFDLHLRRGLRH LLRLPKSANNDFVYAPVSRG GLGFLPLVELHAALQIAHGW QMINSPDPAIRRIAREQLHQ VADARHRLDKDHWKQRGDEL CELLLNGELGTSAHAPPKRR NGDIGSLWVDVRKNLKAFGL KLATAPADPESGAPAKPLQL CVPHHAEWLDHRNVLRHVKQ HMKNKRWRAWCSHVDQGRTA RAHGGVGSGFLTRPRGMWES DYRFAVAARLNMLDTVNVLA RRRLRAHDRCRHPGCRWKET LAHVLNHCPGTMDSIRGRHD DALKEIERTLHASSGDRQGR TELRTNQTVPGLAGPALRPD LQVYNHDQRTVAVVDLAIAF DEQPRDDPESSGLAKAAAEK |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | KAKYAGIKRHLERQGWKVHL SALVYGSLGSVAPSNYKVYT EHLGLLKRDAKRLDRQLSVA CIQSSRRIWNLHCAQHRARQ HQDQPAPRGRRVTETGGTPS RTDRR (SEQ ID NO: 1447) |
| NesL | Utopia-4_PI | AATU0 10012 81.1 | Phytophthora infestans | AGCTCGGCCTCGCGGCTGCC TTCCCAGGCGCCGCCGACTT CGCGCTCTGGCGCGGCCCAC ACGCCGCCGCCGAGCCTCCA AGCGCGCCCGTTGGCTTTCG CAGACGCAGGGCTCGCGGCG ACGGCCCTCGCCAGCCCCCA AGACCCCCCCTACGATGTGG CACCACCCGGCAGGGCGGCC GGCAGGCTGCCCGACTCGGT ATCGCCGGGTGCTACACTCT CAGCCGCTACAGCTCGGGCC TTGGCGGTCCGCTATTGCC CTTGGAGCTCGACGGCGACA GCAGCGACGACGAGGACGCT CAAGACCCCCACGCCGCCGC CCCAGAACCCCCAGAAGACG TCGCGAGTGTGCTTGCCCCA CCCGGCAGGGCAGGCAGC (SEQ ID NO: 1203) | TAAACGGGTCACTTGACCGA CAGGGCACCACCCAGGTAGG GAACCGCCCTTTAAAACCCA GGAAGACACAAACACCCTCC ACATAGTGACATACATATTT TAGCCTAGATTTCAGTTACG GAGAGGTTACTAACTGGTAC ATAAAATTACACATTCTGTT CTAATCAGTGTGAAAACTGG TTTTCGCCTTTTGGCGGACT TTTTCACTCGCATTTTTGGG CAATCGTCTGCGGCTAGCTT GCTAGCGGCGGACAGCCGGT CTCCGGGGCGTACACCTTT CCCCCGCAGGACCAACTACA CCGATCTTCTCTACACTTTT CTAATTCGCCTTCGTCTTCG GTCTTCGGCTGTCGGATTTT TTTCTTTTTGACCAATCAGA GTGCGCCATGCGACTCTTCT GGCCAATCAGAGACCGGGCC CTGTCCTCGGACAGCGAGGC CTCCACGGCCAGCCAATCAA GTCTCGGCAGCGACGCGTCT TTCTATAGCGCAGCTGACGA GGCCGATCTGGCGGCCCCCG ATTGGTCCGACTTTCGGCCA ATCAGCGACGACGAGGGGGC AGGAGTTTACACTTTTGCCC CCGTTTCGACATCAACTTCA GGCCAAAATGGCGATTTCGA CCCTCCACGCGCCGTGCCAC TGCTCGGCACCGGCGGCGAT TCAGCGGGTGCAACTTCGGG CACGTGTGCAACACATGCAG CGCCCATTGCACGCCAAGCG GCATCGCGGGACGACGCCTC GGCCGCTCAAGCGCAGCCCC GCCCTTCCAGCACGACCTCG CGCCGTTTGGCGGATCGCCA TCAAGACGTGCGAGAGCCAG GCGGGGTCGGGCAAAATATA CTTACTCTAAGTATGCCCGA ATCCCTGCCCTCTCAGGCTG TACGCGGCCCCATACTTGAT CTAAGTATGGGAGGATCCCT GGCCTCTCAGGCTGTACGCG AGACCCGTACGGCCGAATCC CTGGCTTCTCAGCCTGTACG CGGGGCTATACTTGGTCTAA GTATGCCCCGGTCGCTGCC TCTGAGCCCGTACACA (SEQ ID NO: 1326) | MLADPAALAAGLARAPPPPS APQDPSPAFPAGPAGQNPRA AAPARVEVHTVVAPPGRAGG MLPDPGLVEEPIQATYAHDA AQFECALCPYVAESMAVLVQ HRRSAHRGTRFKDIFTSGCQ CSLVFYARIVAASHAVACAR RNQRAVPPAPTPVAPTRPEA TPQPTGYLAAAMTAAAAAAS SDTVVAAATNMQSAVPAAAK TTGLQLVPPELEPALPQRAS CHAGKRRRLNADEAVTPCTP TARVSPQTEVAMAPHDAPQD DTVLQREAAEPQPDPAATQG AQVQRVEDTTAAQDDTVQQD HDADTAQVSPPRRTPTRWGP RPSSTQEPSPMTGEPAATLA ARRPLTPAATGTRATRWGPC HRAIGAAAIARLVTGLPTEP AQPQRRQPPPPQEPPLQPEP QAAAATVAADIAATVAADIA AAAANAAMDVDGGPAADETW LLRFDGACRRNPGPGGAGAA LFAPSGAVVWTCSHFMPSRS ETNNTAEYTALLLGAQSAVH HGAKRLNIEGDSHLILSQVR GAFACNNKRLRSLRNRVQAS LRQLDWYRLQHIDRKANQHA DRLANRALDLRRTVTECGPH AETRNRCFQTPQPLVEPGET HCVPGSDEVLAANTAMEDAT AVPTEDDEAEVAARDGGEVF PTIAIGPDSAPAKQPRLRLK KLDEDDFDAAAAAVTRVSEE LASKIVDAGDWTSGEGYISA IPERLRAALRPFALPTQPAR PQPREPRMQQPPRRPPRVTR DHLEHRLDEALDTMENVQRS TPQNQKAVRRARRRVGRLRS AMDRTRLRKKFATHERECVA EILRRASTEEAANPSQEKCP IDRATLHEYFTATSTORTPF DYDSAKGTEFRTFLEVMSTP SHETSALTAEPTLDEIEDQL AHVKAGSSPGHDGVGYDVYR RFQVQLLPLLHAAFRFCWRH RRVPALWKVGFVRLLHKKGD PQQPNNWRPICLQTAIYKLY SGLLARRLSKFLEANELLPM AQKGFRAFNGCHEHNFVATT LLDQTRRMHRRLYQVWYDLR NAFGSLPQQLMWGVLRQLGV TEEFVARCSGIYEDSYFVVG NASDGATEPVRQEVGVYQGC PLSPLLFITALVPLLRALEN QDGVGVPLADGVRPCATAYA DDIKVFCDSATGIQRCHALV TRFLEWTGLQANPAKCAFLP VTRSQHSNPTRDRDIELRIH GEAIATLGLQESYRYLGVGD GFDHVRHRLQLEPKLKQIKR EAVALLHSELVPWQILKALK VYIYPKVEYALRHLRPLKSQ LQGFDSAIVRGLRHLLRLPE NSHDGLFFSPTSAGGLGLLS LVELHEALQVAHAWQMLHSK |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | DPAIRAIARTQVGQVARKRF KLVEEHWRGREDDLAQRFLN TELAASPHATETRRNGDIGS LWNDVRDTLQTLGLKFAAGD EEEAPGLLQLRVPHHTKWLS HSTVLRHVKLHMKLRRMDTW KSKVSQGTTVREHGGVGSRF ITAGAGLSDAEYRFAIAPRA HLIDTNSTLKRRLRANDTC RAPGCSYTEPPAHILNKCSP NMDAIRKRHDDALERIADAL RRKVEKSGGRLEVAINKTVP EYDGAALRPDIVLRNTETKR AIIADLAITHENQPTDATTS SALQQSRDNKITKYQTVAAA MMRAGWRVRVTGIVYGSLGS VLPSNFKVYTELLALLKRDA RRLNRQLSSHCIRASARIWS AHCRRHRERQRSGNASRASR GSGGAPRRTSQASARR (SEQ ID NO: 1448) |
| NeSL | Uto pia-4_ PR | . | *Phytophthora ramorum* | CCAGGAATCACCCCGCCGC CCCCAAGCGCTCCGCCGCCG AGCCCAGCTGCGGCTGCTGC CGCCCCACTGGTGACGGCAG TCGCAGCTGCCCCTGCCACC TCTCCTGTTGGCCGCGCCGC CGTGGAGCCCCGCGCGCGCG CCGAGCCGCCCCAAGAACAA GCACCCCCAGCTAGCGCGCG CGTGGAGCCC (SEQ ID NO: 1204) | TAGACGGCACACAGGCCCAC AGCGGCCGACAGGGCCACAC CCAGGTAGGGAACCGCCTTC AAACCCGGCCGGTACATTAT GGTCCGACACCTATGAGGTG CAACCGGTACACAAGTTACA CACCACATAGCGACTACCAG GTATTTACTACCTGGAAGCC AAGGATTAACCGGTCGGTAA TACACATAACTTT (SEQ ID NO: 1327) | MSGDVVSSDGSSRTTDASGD GDDGAGSSDAAGDVGVVAMD VDQGARRQQPPWQRVGGKRR RLNDVDDEDTRELAELLLEE EDEAGDHAPAPRLSAASARP ASVLSVYAHNAQRFQCTLCT YTAASFASLKRHRDSRHRRT AFLDRFSAGCACGVPFASRL AAANHAHACDSLNRTFSVAA APAAGELSPTAGAANATVKA ATVTPDSPRQDPPKLAATPP LASSALVVDPDHAEQQARER WGPPLPRTLVAGRVAARLSE VPAPRWGPPLPRGVVAFRIG HRVLPPEMTSDEETKDDSSV QDGDRQDYPVAAMDVDSGMS GEWLLRFDGACRANPGPGGA GAALSQPDGSVVWTCSHYMP SSSETNNTAEYTALLLGTRA AADHGTTTLRVEGDSTLVIQ QVRGIFATRSVTLRHLRDQV KLELARVGRFSLHHIDRQAN AHADRLANRALDLRRTVSEC GVHPDGNGCTPTAIDDRPLA PTQQPPDAPPPPPAADIEME DPDDEDLADIDDGEVYAAMR VGPNATPQRRRGRSGTAKK HRRQRPPRVTRHHREHRLDE ALDDLHAVERSTPSDRTTVR RARRRVGRVNSAIEQQRLRH RFDTDEKACVTDILAKACAT REAARTTASGGDPPAGPATP AAGSADDGTCPILGEELWRF FDSVNTPRQEFAPDAPVGAA FRSALARLPAATSCKELLTA APSAGEVEDQLQHVRGASSP GLDGVGYDVYQHFAAQLLPA LTAAFKACWTAKRVPQSWKL GVVRLLHKKGAREDPANWRP ICLQQAIYKLYTGLLARRLV RWLDANDRHAPGQKGFRAVN GCGEHNFLAATLVDQARRKR RTLFEVWYDFRNAFGSVPFA LLWDALARLGVPDDYVTMCK GLYESAAFVVGNAIDGTTDP IALRVGVFQGCPLSPQLFNA AISPLLFALQRLPATGVQLS GDDCPGASAYADDLKIFSGT EDGIKRQHALVADFLRWTGM AANPNKCCTMSVQRDGRGVL KTDDLQLDLAGTPIPALSMS ASYTYLGIGDGFDHVRRRVE |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LAPALKQLKDDATTLLQSGL APWQVVKAVKTYLYPRVEYA LRHLRPFQQQLEGFDRHLAR GLRHLLRLPGNATAECFYAP VSRGGLGLLPLTELHAALQV AHGWQLLNSKDPAIRRIARV QLRQIADARHRIDSRAWEGR DEELCELLLNSQLGTSPDAP PKRRNGDIGSLWVDVQRHLR TLGLKFATAPACADAGSAAT TLQLRVPHHDKWLDHRTVLR HVKLHVKHRHWSKWAAMRDQ GKTARAHGGAGSGFLTRPRG MWEADYRFAVAARLNQLDTH SVLKRRRLRAHDHCRQPGCS RAETLAHVLNHCAGTMDAVR GRHDDALKHIERALHASSPG GQDRVELRVNQTVPSLAGPA LRPDLQLYNHTKKMVAVVDL AVAFEEQASDDPESSALARI AAHKRAKYAGVKRHLERQGW KVHLSALVYGSLGAVPAGNH KVLTEHLGLLKRDAKRLDRQ LSVACIQSSRRIWNLHCSQH RARQHQAPGGSRAAETGGTP PRTGRR (SEQ ID NO: 1449) |
| NeSL | Uto- pia-5_ PI | . | *Phytophthora infestans* | CTCAAGCCTAGCAGCGGCTA CCGCAGCTACTCCAGCTCCG GTAGCTGCTACTGCTACAAC TGCTCGCGCTGCTGCTCGCG TCGCCGTGGAGCACCACGCG CACGCTGAACCGAACCAAGA ACATCTACCG (SEQ ID NO: 1205) | TGACGCACCGTGACATAGTG CGGCACGTGAAGATGCACAT GAAGCTCCGACACTGGGCCA AGTGGGCGGCCATGCGCGAC CAAGGCAAGACAGCTCGTGC ACATGGTGGGGTTGGTAGTG GCTTCCTCACACGGCCGCGA GGCCTGTGGGAAGCCGACTA CCGGTTCGCGGTGGCCGGCC GCTTAAACCAGGTAGACACG CACAGTGTCCTCAAGCGCCG GCGCTCCGAGCACATGACGA GGTGCAGACACCCAGGATGC ACGCGCTCCGAGACGCTGGC GCATGTGCTTAACCACTGCG ACGGAACCATGGACGCAGTC CGTGGCCGGCCATGACGCCG CACTCAAGATTATTGAGCGT GCGCTCCTCGCATCGTCGGC CGACCAGCAGGACCGTGCTG AGCTCCGCGTGAACCAGACC GTGCCGTCACTCGCCGGCCC CGCGCTACGGCCCGACCTTC AGCTCTACAACCACACCAAG AAGACGGTGGCGGTGGTCGA CCTGGCCGTGGCGTTGAGGA GCAGGCGAGTGACGACGCGA GTAGCTCGGCACTGTCCCGG ATCGCCAACCACAAGCGAGC CAAGTACGACCACATCAAGC TACACCTCGAGCGCCAAGGA TGGAAGGTACACCTCTCGGC ACTCGTGTACGGGTCGCTTG GGGCGGTCGCTAGTGGCAAC TACCAGGTGTACACCACACA CCTGGGGCTACTCAAGCGCG ATGCAAAGCGGCTGGACCGG CAGCTGTCTGCCTAATGCAT CCAGTCCAGCCGCCGCATCT AGAATCTACACTGCAGCCAG CACCGGACTCGCCAACACCA GGCGAGGCCCAGCCAAGGAC CAAGAGGCAGCCGGGCGACG GAGACCGGGGGGACTCCGTC CCAGACAAGCCGCCGCTAGG CGGAAACCAGGCCCAAGACG | MARVLVEPMQVDECSSCDRS TLTADDGSGDDVAAPSSLNS NDVAAPMDVDSGTDCPPALQ QPPQRPRALHVGSKRRRLDA DDEEEARQLQEEEEAGIHAP ALRLSAASAQPASVLAVYTH NASRFDCTLYAYTAGSFASL KTHRNSRHRRTAFLDRFSAG CACGVPFASRLAAARHAQAC ASLSSAPLAEASSAAGASSH TVDEADSTVSAAGHTEPDLP RHNATELTASPPLVSSPDVE VQAPETEATENRWGTPLPRV LVASRIAGRLAQVPPPRWGP PLPRTTIAGRIATRLAATPA PRWDPLPRSLVVSRIAARL LPALPDAPACEEEAKDSDTM DWAPTWTNEETKDSEPHDEA PGQVDEETIDDADGEWLLRF DGACRANPGPGGAGAALFKP SGPVVWTCSHYDPSTTATNN TAEYTALLLGARAAADHGVT KLRVEGDSTLVIQQVRGIFA TRSTRLRALRNKVKLELARV GSFSLHHIDRQANGHADRLA NAGLDRRRTKLECSVHPDGR GCTNTSVATAAPTAPAAPLP PARPPATTAAPSHDDDHSVQ GDIDDGEVYAAMCIGPDAVP HRRPRLRLRHLTDEESEEAG DVVERLAASLAAKIADAPDW ETAEGYITALPYALYDKLQP YSQAQPQPPSQQQQQQQQRP RQQQQTRQRRQRRGKRGGGS QRRQRKTRRRRPPRVTRHHR EHRIDEALDDLHAIESRRPQ DRTAISKARRRVGIRSALD QHQLRHRFDTDEKVCVDAIL AGARASQGATTAPPSATTDP PAPMDDSRCPIPGDDLWRFF DSVNTPRRSFDAEAPDGAAF REAMACLPAATRAQELLTEA PTVDEVEDQIQHARASSSPG LDGVGYDIYKQFAAHLLPAL HTAFVCCWNHKRVPQSWKLG VVRLLHKKGDRQDPANWRPI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | GCCGACAGGGCCCCACCCAG GTAGGGAACCGCCCTAGAAA CCCATTTCGGTGGTCGACTC GCAAGCCTTACCTATATTTT AGACGTAGCGACCAAATTAC AAATTTGGTAACGAGTAAGC CAAATGGTAATACACAAAAC TTT (SEQ ID NO: 1328) | CLQQTIYKLYAGILSRRFVR WLDANARHAEAQKGFRAMNG CGEHNFLAATLVDHARRKRK ELHVVWYDLANAFGSVPHDL LWETLARQGVPPTFVDCCRG IYSDAAFTIGNAADGTTAPI RLRVGVFQGCPLSPHLFTAA IAPLLHALKRLPVTGVQLTG VDRPGAAAYADDLKTFSSSV DGIKRQHELVATFLRWTGMA ANLSKCSAMSVQRDSRGVLK TGDLCLKLNDAEIPALSMTA SYAYLGIGDGFDHVRRRLEL APMMKQLKHDATALMQSGLA SWQVVKAVKVYLYPRIEYAL RHLRPFKQQLEAFDEHLRRG LRHLLRLPTNATSAFFSAPT SRGGLGLLPLTELHAALQIA HGWQILNSPDGATQRIAREQ LREIPDARHRLDTAHWRNRD AELCELLLNSQLGQSSHAPP KRRNCDIGSLWIDIRRQLGT LGLKFETAPGRRSHQPARPA IAAFACRTTTSG (SEQ ID NO: 1450) |
| NeSL | Uto-pia-5_PR | . | *Phytophthora ramorum* | CCAGGCATCACCCCCGCCGC CCCCAAGCGCTCCGCCGCCG AGCGCAGCTGCGGCTGCTGC CGCCCCACTGGTGACGGCAG TCGCAGCTGCCCCTGCCACC TCTCCTGTTGGCCGCGCGCG CGTGGAGCCCCGCGCGCGCG CCGAGCCGCCCCAAGAACAA GCACCCCAGCTAGCGCGCG CGCGGAGCCC (SEQ ID NO: 1206) | TGATGCCCGCCAACTACAAG GTGCTTACTGAGCACCTTGG GCTGCTCAAGCGTGATGCGA AGCGGCTGGACCGGCAGCTG TCGGTGGCGTGCATCCAGTC CAGCGCCGCCATCTGGAACC CAGCGCCGCCATCTGGAACC TGCACTGCGCGCAGCATCGA GCACGGCAGCACCAGGGCCA AGCGCCAAGGGGCAGTCGGG CGGCGGAGCCGGGGGGACT CCGCCACAGAGCGGCCGCCG CTAAGCGGACATCGGGCCCG TAGCGGCCGACAGGGCCACA CCCATGTAGGGAACCGCCCT CTAAACCCGCCCGGTACATT ATGGTCCGACACCTATGAGG TGCAACCGGTACACAAGTTA CACACCACATAGCGACTACC AGGTATTTACTACCTGGAAG CCAAGGATTAACCGGTCGGT AATACACATAACTTT (SEQ ID NO: 1329) | MSGDWSSDGSSRTTDVSGDG DDGADGAGSSDAAGDVGVVA MDVDQGARRQRPPWQRVGGK RRRLNDVDDEDTRELAELLL EEEDEVGAQAPALRLFAASA HPASVLSVYAHNAQRFVCTL CAYTAASFASLKRHRDSRHR RVSFVDKFSAGCACGTPFGS RLAAARHAQACASLSIPRTV TAPAAAGDLSPTATGANATA SAAATSPDLPRPASPELAAS PPQTSPFDVAIQADAAEQTA WTRWDPPLTRAAVAARVASR LAWPAPRWGPPLSRTLVASR IAARLDAQTSRWGPPLPPAM VASRIASRLAAMPAPRWGPP LLRTVIASRIADRLLPPELA ADEETKDDDVHMDNAASVDV DEESEVADVVMTDHDGEWLL RFDGACRANPGPGGAGAALF KPSGPWWACSRYMPSSSATN NTAEYTALLLGARAAADHGA THLRVEGDSTLVIQQVRGIF AARSTRMRALRNQVQSELAR VGSFSLHHIDRQDNAHADRL ANRALDLRRTVIECGIHCDG VGCTATTTEVQSSSAPEIPT RPVADDHDEHEWDVVDVCGV CGVCGDRGTCGVCDVSGDI DDGEVYAAMRTGPDAVPARR PRLRLRKLTDEEQEEAGTLA ERLGATLAAKIADARDWESA EGYITALPYLLYDKLLPYSQ GPARSLPVRQHQRQQQPDG QFQRPTQSRSAARRQRRQRH RARRRPPRVTRHHREHRLDE ALDDLHAVERATPSDRRSIR RARRRVGRVNSAVEQQRLRH HFDTNEKGCVEILLAKARAQ RSTTVARTAVGEPNSGAAED DGTCPIPSERLHRHFTEVNT PGSSFDAMAPVGAPFRAALA HLPAATEASELLTEAPTPDE IEDQLQRAKGTTSPGLDGVG YDVYKAFSTQLLPVLHAAFQ CCWQHHRVPQSRKQGIVRLL YKKGPREDPANWRPICLQQV IYKTYAGVLARRFTRWLAAN |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | GRHADAQKGFRTVNGCGEHN FLASTLIDHARRSRRELHMV WYDLKNAFGSVPQELLWEVL QRMGVPPAFVEVCQGLYQDA AFTVGNAADGPTDLVRQLVG VFQGCPLSPHLFTAAISPLL HALDRLKDTGVRLSADDRPG ASAYADDLKIFSGTADGVKR QHALVADFLRWTGMVANPNK CCTMSVQRDGRGVLKACDLE LQLDGARIPSLIMNASYAYL GTGDGFDHVRRRIELVPALM QLKDDATALLQSGLAPCQVV KAVKTYLFPRVEYALRHLRP FQQQLEGFNRHLVCGLRHLL RLPVSATTSFFFVPVSRGGL GLLPLTELHAAPADRRPAPP PRPRPLEGAGGENMRAADQL AARDVGPRPTQAPQRRHRLV VGRRPAPPPRTRPQARDRAG VRGDRHRGGDAAASRAAPRE VAGPPHGPAAGEAAHEEQAL AAVGRDEGPRQDRPHPWWCR ERLPHAASRPMGDRLPLCSG GSAQPAGHAQRAEAPAPPRA RPVSTAGLLPCRDTGTRAES LRRHHGRGPRPPRRCAQDHR ARAHRVVRAARTAPSSGSTR PCPRSPAPRCGPTSSSSTTP RRRWRWSTWPWRSRSRRATT PRALRWRASPRTSEPSTPAS SGTSSAKGGRSTSRRSCTAR WAR (SEQ ID NO: 1451) |
| NeSL | YURECi | . | Ciona intestinalis | ATCAACCCACTACTACACCC TCTACAAAGAACCCACTACA GCAAGATCTTGGCGACCAAC TACACCTGCAGCCTCCCGTC GACTCTTCACCACCTGCGCA CCTCCCTCCGACTCCAAGCG GCAGACAGTGGCACCACCAG CACTCCAAGGGTCCACAGCC AGAAGAGTGCACCCCCCACT GCTAGGAAGAGCTAGGCCAT TGCCCGCTGTGGGCCTTGTG CTGGCTGTCTGCCGCTGATT GGCACGTTAGGGAGTGTGCG CTGAGCACGATAGGGAGGCT GCTGAAGCCGAAGAACCCGC GCCGGGGACTTTAGGACTTT AACTAAAATCTGTAACACTA AAATTGGAATACTGGATTAC TATTGGATTACTACTGGACA ATAACCTGATCTACAACAAC CAATTGGATTACAGAACCAA ATTACAATCTCAACTACAAA CAAAAAGTGAGTCCCCGGCC GGGTTTCTATATTACCCAAT TACTGTTTTTACAATTTTAA AATTTTATAGTATTTTACTA ATTTTTCCGCCCCGCTAGCA CTTAAATTGGCACCCCCCCC CCCCSTCCAAAAAAAAATAG ATAACCCTCCACCACCTAAA CCCCGGTCACCCCCTCAGAA CTAATTGGAACCCGGATCTT TTCCCTCTATCAAATTTCCG GTTCAGTTTGGCTTAATTAC CTAAAACCCGTCTTTATTTT ATCCCTTATTGCCCCTTAA ACCAAATTATTCAAATTGAA ATCCGGCCAAATTGCCTTGC TGAACCACCATTTTTGTTTT | TAGCCAAAAGATTTGGTGTT CTTGGCGAGCTGCAGTCCCG GCAGAGTAGGCGAGATCGTG AGCTCTACACCGCTTCACGA TTTGACGAGTTCTTCTTGAG TCGATCCCCAACGGCAACGC ACTCCAAATTTAACGACCGC ATGGCGACGCCACTGATCTC CCAGTCATCCGTGCTCCGAG GGCACTTAAGGGGAACCGAT TCACTGATGCTGCAAGTTGG CGGGGGCGCACTCACCAATG GAAGATGAGGGAGCCCAACG ATGCCCCGAACTACCGCACC GTCCCCAGCACCGTGTCCTT GTGAGTAATTATTTTCACTA ATCCAGGGACGGGGCCATGA ACTGAACTATGTCTGCACGC TGCCCCGCCTAGCCTCGGCC ACAAATAAATAGTCAAGCCG CGGATTTGGCGGGGCCCATC ACGCGCCTCCGCCCCCACAC ACAAAAACACTTTTAAACTC TTCGGTTCCCCAACCACTAC AACAAAGCGAGCGGCCCCTC TTAGATCCAATTTTAAAATT TTAAATCAGTGCACTCAACT TTTTTACGTGTTGTGTTTTI IGTATTTTTCCCACAGATT CCCCGGTCACCCCCTCAGAA TTGTATTTTTATATTATATT TTATATACACAACACTAATTT TIATACACTACCTTGCACTG TCCCACITTTGTAATTATC ACCTTTTACCTTTTATGCCG CTCGCTGAGCTCCTTTGCACG GATGACCAGACAAACTTTTA TAAAATTATAACATTGTTTT AATTGTCGCGGGGTATCAGT | MATSSSSVSSGNVQTEVRCV YHGKGDLLLECPVAHCPSIH PTVATITKHLKKHHTPQFEQ ITTKNLTITYTCSQCSFSTT GLTQHHISKHYKTCKGVGAV QEGNKGRFCCPACGTRWALL CKARHHFNNVHFEYDTPPIA AFSGTPYKLKKRKFTIINKA LTYSCPLPLNQLLCPLWSCS LTILNKPLSSVQQETAHGDG SQGQSYVPTQLRQVLRARCH CGNPPIGKGHWASCQGKRPL SSPKGGRSSPTPPANLTLHF LNYLPFQLPSQSSSPQSSTL DPTACKARVPIPSFLRGDCE VTFFIIPSVNFYRPYLSYPL RMFWRNRTSSGHCSLHRWRG FVRERLVPHPRSKSPARTPL EFLCEFRLAGVFPDPGKVAS LRPVPAPLTLCLSPPVAGPM ISCEDHSAPPSVRSSSPIPN SPASVSSVEAHLSDLLDKVS SGELRPLSPTLPSSGFFGPL LPPTPPPRPTPSAEKASPSG LSYLPCREVKIASIARPSPA SQRVGCDADRTGPSLNPNYQ QTSPPSTPSFSPIVRPPKFP RSGAKVNSKSKPPGVRPRRA KPIEPGTESASPVDVDTISS SVQEPCTPENRTPEFFYERK WLVSILNIHEREGSNFFQFN RDLEYWTQLLSGSQKGGRAK RASYNRGAANQAMKNRDSGR KDFDPRPVAGHSSGGGTELG SRPRYPKGARLRADFWRDMK GTVRKLLDGSNGERRCGIPL DIIERKFRQVSMPGWIDHRR YAAGASPSLVTQAETDVAIT SEEVEAVLSGLNVQSAPGSD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TCTTATAAAGTAAATTTTT CAACAACCCAAAATCATAAA ATTAAAACTGTTATCTGATT AGTCTAAATTCTGTTATTGA CAAAAACCTCCATACCAACC TTAATCTTATCATTATCTTC ACCCAGACTGCTCAATCTAG TTCTTTTTTCAATCAATAAG GAGGTGTTTTCTTTGGTCTG TTGTTTTATAGTTTACCGTT ATAATAGTCTGTTGTCCTAT AGTTTTCCGTGGTGTATTTC TGGTCTACTATAGTTGGTGC CTCTAAAACATTATTATACC GAAGAGTGCTAGCGATTTCT ATTATTAACTCACCCACCAG TACTGCTGTGCATCCACGCA GCACCACGCCTGCCATCACG TACAGTGCGCTTGCTGCCTT GTGTTTTGTTTGCAGACAC CACTGGACGATAG (SEQ ID NO: 1207) | GGCGCCCCCTTGCGGCCGTG AAAGCCCTTTTCACCTTAAT TCGCCCCTTAGTCCAAATTT TTCCCCATTGCCTGTAAAAG TGCGTTGCCGTCGACTCGAA CTCGTCCTTTTTACCGCCTC TCTGTTACTGAACTATGACC AGCTTGGCTGTTGAAGTCGG CTTTAATTCGCCGGCTTCAC ATTATATTTTTTTGTTGGGT AATCTGTTTTTTTTCATATA TAAAACCATTCGGCTTAAAA TCACCAATCCCCATCATCCA CCCTGGTCACCCATTGAAAC ATCTCTTTTTAGTCAATTAT TTTTTCAGATTACCCCTCCC AAATTGTCATATAGTTTAAC ACCCCGTTTGCCAAGTTGGT CTTTTCCCCATCCCCTTCTG TCCTTCCGGTAATCCCATAA CATTTTATTCTTTAATTCGG CCCCATAAATAGTGTAATCT TAAGACGAAGTCCCCAGAGG CCCGGTCCCCCCTTCTTTG TCATGGACCGGGCCAGCCCC CCTGTTACCACAACAACCCA CCATTTTATTCTTTCTTTCT TTTTATTAGTATTTATTTAT ATTGCCGCCCAACTGTCGTG TCGTGGCGCAGGGGGGTCC CTCTGTCGGCCCAGTGGACG ACCGTCTAAAAAACAGGCAG AGGCAGCAGGCACTTATCAC CCGGTACCTCCGGGTACCGG AGGCTGGTTTTCAGCGCACT GTACGTGATGGCCAATTTTA TTCATTGCATTTTATCCGCG TCGTGGTGTTTGCGTGGATG CATTAATAAAGATGAAATT CC (SEQ ID NO: 1330) | GLSYRFWKGLDPSGRLLSCL FEIVRRHGRIPGAWPTCSVI LLCKDAQGDVQDVGNWRPIT ICRTLYKLYAAVIARRIQTW AKQGGVLSRLQKGFMPVEGV FEHVFMLDTVLSDAKLRRKN LLAVFLDVRNAFGSVRHECL LKVLRHFDAPHYLVELVRDI YTGATCRVRSSVGETGDIPC DRGVRQGYPLSGILFNLVTE VLIPGLSAGNDGYRMACLGG KLTQVLAYADDLVWTENRDQ MLRQLGVCEEFGRWAGLAFN QRKCGLIGWRTLRGGRRVAL EDPLLLNGVEIPLLRPGEHY KYLGAMTGVMSVPRTGSQLI KDFRARLQRLFTSFLTPHQK LIALKRFLLPSLSFHLRVRP IARSELIALDRRVRECLRVA FRLTKPSCQAVFHTPTDMDG LGVPSVCSESSILTIAQGFK VLTSPDGTVSATASARVKLY AAKFGGLTEAGPSDWARYLS GDDVNGNSTRKPGANLPSGL WTRVRCASRQLGAVWRVCPE NGITVRVRNSVITSRDRRKL IRSFHDCSNQQWKEQWMQHP NQEKTAAAHMAYADANRWVK QPSVMEPHTYFFALRARLNL LPTRVSRAIYSRDQHPDILC RRCGASVESLPHVLNHCPPN MSIILGRHNLVLQEVLNAVD KTQFKEISVDRTVPEHMSET GEALRPDIVARRNDGSWVVD VACPFDQKANFDEAAKRKLL KYDKLCCNIAASTGKPVECH SIWGSLGSLAEGLSTSLRAL GITDFARSKLVACHQG (SEQ ID NO: 1452) |
| R2 | PERER E-9 | BN000 800 | Schistosoma mansoni | ATCTCACGTTTTAATTTATT TTGAACTACTGCAGTCTGA GCTTCTAACGACCCGAAG GCTCAGAAACTACCCACTTC TTGAACTGCTACTTTTTGCT GTTTATCCACAACAACAGTT GTGATTCTATTCTCCANATA TTCCTTGTGCTTTTGTCAAC ATTATTCTATACCAACTGTA CCACCTACTTCTTCATCTCA CGTTTTAATTCTGGTCTTAT TTTCTCATCATTAGTCACGG AGAGGGCCTATGAACGGTCC GTGACGCGAAATTCTATCCG CGATTTCGACCTCTCCTGCT AGTGGTCCCCGAAGTACGGT TCCTCTGGCCTGTCAGTTGT GTTAAAACTATATAATAACG (SEQ ID NO: 1208) | TAACGGCTGAACGAATAGCC CCCTTCACTCTTAGACATTC CCCCACTGTTGTTGCTTATC TTCATGCTCTTGTGTTAATT GACTGCTCTCTTCTGGGTTG ACGTCTGATTGTCTCTCT CTTTCCATATTGCTTGCTCT GCCCGCTTACTTCCAATAGT TGTCATATTATGTCTTTGTT TACTTGCCATGTCTAACGAC AATTACTTTATCTACCTTAG TTTGTCCTCTTGGTTTCGAT TGCCTTCATATGTTCATGGC GGAATCTGATGTTTATAATG ACTATTCCTATTACCACCAC TACAACTACTATTATTTT TCATTACTATTAACATTATT ATAAACATTATTACTATTAT TATTATTACTATTATTACTT CTACAATTAATATTATGGCT ACTCCTCTCAGCACACCAAT AAAATATCAATCAAACATCT CAATTATATCCACCTATTAA ACTCTCTATTTCCCCTGA GTTATAAACTTACAATTCAG TCTAACCGAATATCTCTCTT TTACAAATCTTAAGTATGTA ATTTTGTGCCAAACCCATTT GGGTCTGTACAATTTGATAC TTAAAAATAAATGTTATTAG CC (SEQ ID NO: 1331) | MPVSTGAETDITSSLPIPAS SIVSPNYTLPDSSSTCLICF AIFPTHNILLSHATAIHHIS CPPTPVQDGSQQMSCVLCAA AFSSNRGLTQHIRRHISEY NELIRQRIAVQPTSRIWSPF DDASLLSIANHEAHRFPTKN DLCQHISTILTRRTAEAVKR RLLHLQWSRSPTAITTSSNN HTITDIPNTEARYIFPVDLD EHPPLSDATTPNASTHPLPE LLVILTPLPSPTRLQNISES QTSHESNKNSMHTPPTYACD PDETLGATPSSTIPSCFHSY QDPLAEQRGKLLRASASLLQ SSCTRIRSSSLLAFLQNEST LMDEEHVSTFLNSHAEFVPP RTWTPSRPKHPSHAPANVSR KKRRKIEYAHIQRLFHHRPK DASNTVLDGRWRNPYVANHS MIPDFDCFWTTVFTKTNSPD SREITPIIPMTPSLIDPILP SDVTWALKEMHGTAGGIDRL TSYDLMRFGKNGLAGYLNML LALAYLPTNLSTARVTFVPK SSSPVSPEDFRPISVAPVAT RCLHKILAKRWMPLFPQERL QFAFLNRDGCFEAVNLLHSV IRHVHTRHTGASFALLDISR AFDTVSHDSIIRAAKRYGAP ELLCRYLNNYYRRSTSCVNR TELHPTCGVKQGDPLSPLLF |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | IMVLDEVLEGLDPMTHLTVD GESLNYIAYADDLVVFAPNA ELLQRKLDRISILLHEAGWS VNPEKSRTLDLISGGHSKIT ALSQTEFTIAGMRIPPLSAA DTFDYLGIKFNFKGRCPVAH IDLLNNYLTEISCAPLKPQQ RMKILKDNLLPRLLYPLTLG IVHLKTLKSMDRNIHTAIRK WLRLPSDTPLAYFHSPVAAG GLGILHLSSSVPFHRRKRLE TLLSSPNRLLHKLPTSPTLA SYSHLSQLPVRIGHETVTSR EEASNSWVRRLHSSCDGKGL LLAPLSTESHAWLRYPQSIF PSVYINAVKLRGGLLSTKVR RSRGGRVTNGLNCRGGCAHH ETIHHILQHCALTHDIRCKR HNELCNLVAKKLRRQKIHFL QEPCIPLEKTYCKPDFIIIR DSIAYVLDVTVSDDGNTHAS RLLKISKYGNERTVASIKRF LTSSGYIITSVRQTPVVLTF RGILDRASSQSLRRLCFSSR DLGDLCLSAIQGSIKIYNTY MRGT (SEQ ID NO: 1453) |
| R2 | R2-1_BTe | . | Bombus terrestris | TCAATAGTTACTCGGGGCA GGCGGGATATTGGTCTTGCC TTGCCCAAGTCACACTCCTA CCTCCTCGTGGTACCGCCGG TAACACGCGCACGTCCACAT CAGCGAGGGGCGTACTCCCC CGGATGTGGCGGCGCGTGGC TAAACGGAGTGTGGCGACGA AGGAGCGAAAGACTAACAAC TATAACGGTCTTCCGTAACG GCTACTTGGAGCCGTGAATA ATGGAGCCTATATTAAACCC TGGAACTCGTTCCTTCGTTC TGTTGACGACTGGAACGGCA AAGGACATGATTTGGATAAC AATTGGAAACTTAATATCGA ATTCACAATTAA (SEQ ID NO: 1209) | TGAAAACACGATAACGATTA TGAATCAAAATAAGAAAGTA AACATCCCAGAAATTGTCTA CGTCTTATTTGTTATCTATT TATTTGTTTA (SEQ ID NO: 1332) | IAKFDNNTNSASDAAPLSPG GAVADLSASEGTTDNDQAMS PAMSLXTVPLVGNRVACPXC EKREANLFFLNLSDLDRHLT QHHPDAPIXWSCIDCAKCFP KLHGARCHIPKCGGASSQAR TGEFQCEACPMSFGSRRGLS THERHAHPAVRNIKRRGADP PEENTKSWKVEXVARLKGLW EIFKDHKYPNKEISKFLTTK TVDXXKYQRKKLNLIGXESP QEATSLATEGGCDLVSSGNA SFGSPVGRNENEEELIHEWK LSLKNEINKPTEVPPILKEV YNRLMLIWEEHQDDRDSLTE SLDHFIRTALYELINKINKN QTDLKTKRAAKTKSPKNNRN SRKRFSYARCQELPHECPRR LADAVVNNDQAYLEPARQPP GSEEVRGLYEKLWGQVGSTY VPAPVTRVPKLSLSEIFPPI AAEDVGERIGKIRKKAAAGP DGLQRDHLTIPGLPIIMAKI YNILVYCSYPPSAWKENRTT LIPKINKPCSLVENWRPITI SPILGRIFSSIIDGRIRRGT VLNMRQKGFTSENGCKINIE LLNSALNYSKRNSGGIFTIV DISKVFDTVPHAALKPCLAK KGVPALIVDLIDEMYKNVKT TIKTKDGGVEIMIRRGVKQG DPLSPLLFNLCLEPLLEEIE EQASGINVSEHRKVSVLAFA DDIVLLGADAREAQHQINVL TDYLQSLMMNLSIEKCQTFE VVAKKDTWFIKEPGLKIGNQ IMPTVDPDEAFKYLGAKIGP WKGVHCGVIVPELLSVVKRV RKLSLKPGQKVELLTKYIFP RYIYHLLVSPPSDTVLKLLD SEVRQEVKTILHLVPSTATG FFYTPKACGGIGIPRFEHII KLGTLKSAIKIANSIDPAVA GLIDDAAIKKLKQTANSLRI NWPASLEDIEKARKRLRKEH ISQWADLKCQGQGVPDFIKN |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | KTGNLWLEDHSLLKPSRLID ALRLRTNTFGTRSVLARADK NIDVTCRRCRAQPETLGHIL GLCQHTKGLRIKRHDEVKSL LEGRLKSKKNNEVFVEPTIK AGGSLFKPDLVIKNGERVLV VDVTVRYENKNYLALAEKEK IEKYRPCLRALKEIFNAKGG EILPVVLGSRGTITPNTEKV LKRLGIANNDIKTILLNVLR SSIELCNIFIDD (SEQ ID NO: 1454) |
| R2 | R2-1_Crp | . | Crocodylus porosus | AGGCGTCTCCTTTAAGGGCA ACGGTCTGGTTACGCGGTCG CAGCAGKCTTGCKCCAGGTA CCTCCWCGTGGTTCCCGCCG GGTGCCGMAGMCCCAGGSCT GTCGGTAGCTCGATCCTGGC ACAGTAMGGCCAGGGGAGTK CTTCCTTGCTGCWGGTGCCC CACAAGCGTKTGGCAGSMCM CCTGCTTCWTCGCAAMAATM ASAGKGTSMTCAGTAGTCGG CCCCGCCGCTAGCCAAAACT GTTCGCCACSCAGTTACAGA TGGTGCCTGTGCTGACCKGK KGCCCCGTGGGCTCGGWGGT GCAGGGGWGGCCGGCCCATG GCTGGGCAGACSTGGGCCK TGGAGCCCGCTCCCAMCCCA GAGTTCCCCCTCAAMGCCGC CAGGKCAGMAMCAKCCGGGG AGKGMCACGGCCCCGGCCGT GA (SEQ ID NO: 1210) | TGAATCCCACTCTGGGGACC CCCAAAAATTAGAAAAACCC AAAACAGTTGTGTTTAAGTG TGTTCTTGTTTGTCCCTTTG GCTTCACCTCCAAGTTGCGA TCCCCCATCTCCCCTGCGCT GTCTTTCTGAATGACCAGTG GTGTTGAGGCTGGTGTGACC TCGGTCACCTCCAAGGCCAA GTGCCCTGGCCCCGAGTAGG ACCAGGTGGCCCAGCTTGCT GGGCACCCGTCACCGCCCAG GGCAAATGGAAGGGATCTAT CCTGACCACTACCAGGCTAA GTGTGGTGCTGCCTAGCCTG CCGTAAGGTCAAGCGCCCTG CTGCCGCTCGGGTAKCAGTC CTCGTTCACTCGTCCCTCCT AGTACCCTCCGCMTCTGCGC TTCTGCTATCCACTGTGGCC GGWGATGCCGAGGWTGSWMC AWCCTCGACACCTCCAGGGC CAAGCGCCTTGGCCMCAGGT AGGACCTGGCACCTGCCCAG GGGGCCAGACACTGCCTGCG GCAAGGGAAAGGGAGCCGTC CCTGACCGTTACCGGGCTTG ATGGTGCTGGCTAGCCCGCC GTATGTCAAGCACTCCACAG CTGCTCGAGTTCGCTGGCTT CACCTTCATCCCWCCTAGTG CCTTCCGCCTCTGCGCTATT TTCGTCCCGACTCGTACCTC CCCACCTCTGCGCTACMGCT ATCCCTGMAAGGACCAAGTG GGCAGGGGSGTTCGCCCCCC GCCCGCAGGAGGCTCGGCGT ATCCGTGGCKTCWTGCCTCC ACCGTCTTTGTGCCGCTAGAG GGGTACCTCMGAGACCGGCG CAACACGACCTTGACGSTTA GACAGTAGGGTGMAACAKCC CTGCTGCAGGCSTGAAGGGC CAAACGGCTGTGCCATGAGA GGGGAACCTTGAAGACCGGG SCAGTCAGCCAGTTAGTCAG TTGGGCGAAACAATCCCAGC TGCAGGCCCAMMAGGGCTGT CAGGTGAGGGGGTATCCCCA WCCACCCCCCGCCGCCGACT ACGGAGGCAKGAAGTCCCTA GTGACTTCKGACCCCCACGT CTTGTGCCGGGAGAGGGGAA CCTTGAAGATCGGGGCAAGC CGCACTTGATAGTTAGCCAG TCKGGTGAAACAATCCCAGC TGCGGGTCCGAAAGGGCCGA CTWCCAGGCGAGGGGGGCCT GCGGAAAMCCCCCTCCATGG TACGGAGKTCTGGCGTCCTM ACCGACWCCTTGCCACCAAC | VPPGAEARGRYHHPRXEXAR QGEPPSXRVFLVXLPDSNPP CPICGDHVXXXSVLALHCVE GHXWAXVQYQCTHCGILCHI PRCQGRVXEXTGKDXXCPEC PASFDEKAGLSQHKRHTVTX SXERVAGXLLRAXLRHGCWS VEEEETLTRLDAMFXGARNI NQLIAAEXVSKMXKQISDKW RXLXLXPEQTTXGGXAESAS VVXXESMTPEMEAQSPAXPP GKIRKIFTGQDGHAGGXAWE NQEDFHWTRWARRWLKRGQX LSDKVQEVLGXWVEGQPRIX AWVDXVSLDVLTLFLGVPPG PQRAPSKKGPXEGGKPTSWM NKRAIKWGTFLRYQHLFGAN RKLLAAXILDGAXRNQXTLL LEEVXQXYXGKWEAEPPFEG LGRFGXXRDVDSFAFEALIT XEEAVKHMMXMAXXSAPGPD KLTLRDLRRADPEGDALAEL FSLWXITGVVPDRLKEXQXV LIPKAVDFEKLRQLGNWRPI TIXSIVLQLXSRVLTARLTA ACPIXPHQQGFISAPXCAEN LKXPELIXRKVKXDRRPLGV AFVDXARAFDSVSHDXISWV LKAKGVDQHIVNLIEDSYQK VTMRVQVFSGSTPPISIKXG VKQGDPMSPLLFNIAMDPLI XKLKTVRQGVKVGSASLTTL AFADGLXLLXDSWEGMQHNI TTSXTPGRACNTTSRHPRGL LQPHGPTSATXKMXGVLLES XMRLLYGEQLRGLEDXRPXX HDAXARRADTISGLEXRSLG WDXQTRFGYATXLLAREDGD CXAQTNAEALCWXSXPFPGC AXRPXYANXGWVASEALDSM SRRXVKEWFHLPACTDXLLX SRHRDGGLGLLRLARXXLAA XVRRPIRVATSSDEVTRKVS YACGISDEVERLXLAXGGDX SNVPRFEDPXAPKSXXVQGP HEAAQETPRVVRTQAIPWPS NWRAEEHSKWAQLSCQGERV ELFCNDPVSNGWINSRGQLA ERLWIMALKLRSNIYPTREF LGRGQAGTNIGCRHCTHPRE TLGHILGICPAMQEARILRH NKLCKILAAEGKNCEWTVYY EPHLHNAAGELRKPDLIFVR DGTALVVDITVWYEGGPATL LSTTAEKATKYLDLNTQIQE LTGAEQVTYFGFPIGARGKW HADNWRVLSELGLSNSRKER VTRLLSWRALLGSVDMVNIF VSKHRQENLLDEHCTPAEQV VSSYAS (SEQ ID NO: 1455) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | GTCTTGTGCCGGGAGAGGGG AACCTTGAAGATCGGGSCAA GCTGCACTTGATGGTTAGTC AGTCGGGTGAAATAATCCCA GCWGCCCCCGCTGTGACTGC TAAGMCWGGTCCCCAAGGGG CATGAGGCATSTGCGCTGAG CCGGSAGGGGTGACACMCGG CGATCGGCGCAGCACAKAST GAAGGGAGGCACTTGCTGAG ACTGCTTCTGAGGCCCCAGA CTTGGGGTGGTGCAGCCTTG TCTGGGGTATGGTACAGCAC CCTACTGCTCCCTTTGGKCA GCAGAATTCGTCCCGACCTC TTACCCACCCGAGTCTGCGC CTTGTTCCGCTATCCTGCAT CTCCGATCCACCTCGCTGTC TCCCCGCTGCGCTGCTTTTC TCTCAAGTGGGTTAAATCTT GTCATGATTACCTCCCACGT TTCCGCTCAAGGGCAATGCC CAAMATGACGGGGATCGCTG GTGCATGGCAGTCATGAGAC CATCCGGACCCTCCGGTGGT CGCTATAGTCATTTTKTGTT GCATGGGCATSCTGAGTCA CTTAACCGAAAGACTCWAAA TAACTCAAAAGAGGKAMCCT CTGSGGTTCGGTAAA (SEQ ID NO: 1333) | |
| R2 | R2-1_DWi | . | Drosophila willistoni | GAAGCTGGGTCGGATGAGCG CAGAAGGGGTGTTCTTTGGA ACACTGTAATTCATAAGTCG TAAGTCTGATCAAGTCGACT CGAAACCTCCTCGTGGTGTT TCCTGGGTGCTGTTGAGTTC CTAGTCTCTAGGTTCTTTTC AGTAGCTAA (SEQ ID NO: 1211) | TAGATGTACTAACCTCTAGC TTTTCTTATACTTTTGCCTG CTACCTTGGCATTACATCTA AAAAGGTACAAACATCGCAT TGTCATAAAGAGGTGGTTTT AGTACGTAGGCGCTGTGGGA CTTCATTGTCCCGGTGATGC AGTGAATCGTGCATACGAGA TTGTCCAGTAGTTGGTTGCT CGTATCTTTAGAAGATTCC TTCCTCGGCGATCAAAAAAA AAAAAAAAAAAAAAA (SEQ ID NO: 1334) | FERRSNSWGYRPLEPRSVGT ESNNNSPRSNITITSATSRP GDQPREAIAVVNLAGEIPCA VCGRLFNTRRGLGVHMSHQH KDELDTQRQREDVKLRWSEE EAWMMARKEVELEASGNLRF PNKKLAEVFTHRSSEAIKCF RKRGEYKAKLEQIRGQSTPT PEALDSITSQPRPSLLERNH QVSSSEAQPINPSEEQSNWE IMRILQGYRPVECSPRWRAQ VLQTIVDRAQAVGKETTLQC LSNYLLEVFPLPNEPHTIGR SNLRRPRTRRQLRQQEYAQV QRRWDKNTGRCIKSLLDGTD ESVMPNQEIMEPYWKQVMTN PSTCSCDNTRFRMEHSLETV WSAITPRDLRENKLKLSSAP GPDGITPRTARSVPLGIMLR IMNLILWCGKIPFSTRLART IFIPKTVTANRPQDFRPITV PSVLVRQLNAVLASRLASKV NWDPRQRGFLPTDGCADNAT LVDLILREHHKRWKSCYLAT VDVSKAFDSVSHQAIIKTLQ AYGAPTNFVSFIEEQYKGGG TSLNGAGWSSEVFIPARGVK QGDPLSPLLFNLIIDRLLRS YPREIGAKVGNTMTSAAAFA DDLVLFAETPMGLQTLLDTT VGFLASVGLSLNADKCFTVS IKGQAKQKCTVVERRSFCVG ERECPSLKRTEEWKYLGIRF TADGRARYSPADDLGPKLLR LTRAPLKPQQKLFALRTVLI PQLYHQLTLGSVMIGVLRKC DRLVRQFVRRWLDLPLDVPV AYFHAPHTCGGLGIPSIRWI APMLRLKRLSNIKWPHLEQS EVASSFIDDELQRARDRLKA ENVQLCSRPEIDSYFANRLY MSVDGCGLREAGHYGPQHGW |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VSQPTRLLTGKEYLHGVKLR INALPSKSRTTRGRHELERR CRAGCDAPETTNHILQKCYR THGRRVARHNSVVNAVKRGL ERKGCVVHVEPSLQCDSGLN KPDLVGIRQNHIYVIDVQVV TDGHSLDQAHQRKVERYDRA DIRSQMRRFFGATGEIEFHS VTLNWRGIWSGQSVKRLIAK DLLIAEDTKLISVRAVNGGV TSFKYFMYCAGYTRS (SEQ ID NO: 1456) |
| R2 | R2-1_Gav | . | Gavialis gangeticus | AGGCATCTCCTTKAAGGGTA ATGGTCTGGTTACATGGTCA TAGCAGGTTTTGTGTCAGGTA CCTCCCAGTGGTTCCCGCCG GGTGSCAMAGCCCCAGGGCT GTCGGTAGCTCGATCTGGT ACAGTACGGCCAAGGGAGTT CTTCCTTGCTGTCGGGTGCC TCGCAAGCACKTGGCAGCCC CAATCGCTTCATTGCGAAAA ACACAAACGTCCTAAGGGGA TGATCAGCTAGTCAGTTCTG CCGCTAGCCAAAACTGTTTT CCACCCAGTTACAGATAGCC TCTGTGCTGA (SEQ ID NO: 1212) | TGAGAAGTTGCGAGTTCTTA TGCAAGTTGAATACCACTCT KGKGACCCCAAAAAAWWAAA CCCCAAAACAGTTGTGTTTA AGTGTGTTCTTGTTCGTCCC TTTTGGCTTCACCTCSAAGTT GCGATCCCCCCATCTCCCCT GCGCTGCCTTTCAGAACGGC CGGTGGTGTCGAGGCTGGCG CGACTCGGTCACCTCCAAG GCCAAGTGCCCTGGCCCCGA GTAGGACTGAGTGGCCCAGC TCGCTGGGCACCCGTCACCA TCTGGGCAAATGGAAGGGA TCTGTCCTGACCACTACCAG GCTAAGTGTGGTGCGGCCTA GCCTGCCGTAAGGTCAAGCG CCCTGCTGCCACTCAGGTAT CAGTCCTCGTTCACTTGTCC CTCCTAGTACCCTCTGCCTC TGCTCTTTTGCTATCCACTA TGGCCAGTGATGTTGAGGTT GGTGCATCCTTGGTCACCTC CAGGGCCAAGCGCCTTGGCC ACAGGTAGGACCTGGCACCT GCCCAGGGGGCCAGACACTG CCTGTGGCAAGGGAAAGGGA GCCGTCCCTGACCGTTACCA GGCTTGAGATGGTGCTGGCT AGCCCACCATATGTCAAGCA CTCCACAGCTGCTTGAGTTT GTTGGCTTCACCTTCATCCC ACCTAGTGTCTTCTGCCTCT GCACTATTTTCATCCCAACT CGTACCTCCCCATCTCTGCG CTCCTGCTATCCTGCAAGG ACCAAGTAGGCAGGGGGGTT CATCCCCCTACCTGCAGGAG ACTCAGCATATCCATGACTT CTTGCCTCCACCGTCTTGTG GCGCTAGAGGGGTACCTCAG AGACCGGCACAACATGACCT TGACGGTTAGACAGTAGGGT CAAACAACCCTGCTGCAGGC CCAAAGGGCAACAGCTGTG CCACGAGAGGGGAACCTTGA AGACTGGGGCAGTCTGACCA TGCTGGTTAGTCAGTTGGGT GAAATAATCCCAGCTGCAGG CCCAAAAGGGCTGACAGTCA GGTGAGGGGTATCTCCATC TGCTCCCCACTGCCAACTAC GGAGGCATGAAGTCCGTAGT GACTTCTGACCCCCACGTCT TGTGCCATGAGAAGGGAACC TTGAAGATTGGGACAAACCG CACTTGAAAGTTACTCAGCC GGGTGAAAATAAGTCCCAGT TGCGGGCCCCTCGGGGCTGA | PAAPRAWGAVEAGPWPGRTR AVEPAPSPESSPSEAARAAP AGEGHGPGHESPSVQRPEAD TTAPGVSAPTREGEPPSTRV FLVRLPDSNPPCPICRDHVG KPSALALHCVESHAWADVQY QCTHCKKVSANKHSILCHIP CCQGRVPEWTGKDWACPECP ASFNKKVGLSQHKRHVPVT RNVERVAGSLSRAGLRPQTR RGCWSVEEEETLTCLDAMFR GARNINQLIAAEMVTKMPKQ ISDKRRQLGLCPEQTTLGGD AESTSVVEEESMTPEMETQS PINPPGKIRKILAQRARRWL KKGQGLSDKVREVLGAWVEG QPRIHAWVDSVSLDVLTLFL GVPSGPQRAPNKKRPKEGGK PTSWMNKCAVKWGTFLRYQH LFGANRKLLVAIVLDGADRN QCTLLLEEVFQAYREKWGLE EVLRAYRGKWEVESSFEGLG RFGVRRDADNFAFKALITPE EVVKHMMAMASKSAPGPDKL TLRDLRRADPEGDALAELFS LWLITGTVPDGLKECRSVLI PKTVDREKLGQLGNWRPITI GSIVLRLFSRVLTARLAAAC PINPRQRGFIAAPGCAENLK VLELLLRKRKRDRQPLGVVF VDLARAFDSVSHDHISWVLK AKGVDEHIVNLIEDSYQKVT TRVQVFNGVTPPISIKTGVK QGDPMSPLLFNIAMDPLIAK LETDGQGVKVGSASLTTLAF ADDLVLLSDSWEGMLKNISI LEDFCNLTGLRVQPKKCQGF FLNPTCDSFTVNNCEAWKIA GREITMLGPGESTRYLGLNV GPWVGIDKPDLGTQLSSWLE RIGTAPLKPMQKLSLLVQYA IPRLNYQADYAGIGRVALEA LDSMNRRKVKEWFHLPACTS DGLLHSRHRDGGLGLPRLAK AIPEAQVRRLIRVATSSDEV TRKVSYACGISDEVERLWLA RGGDMSSVPRFEDPEAPRSP GVQGPCEAAQEIPSVVRKLA IPRPSNWRSKKHSKWAQLSC QGEGMELFCNDPVSNGWNNS RGQLAEHLQIVALKLRSNIY PTREFLGRSQASTNVGCRHC THPHETLGHILGICPAVQEA RIIRHNKLCKILAAEGKKCE WTVYYELQLLNAAGELCKPD LIFVRDGTXLVVNVTVGYEG GPAXLLSTAAEKATKYLDXN AQIQELTGAEQVTYFGFPIG ARGKWHADNXRVLSELGLSN |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | CAGTCAGGTGAGGAGGGCTG CAAAGCCCATCTCCTGACTC CAGAGGCCTGGCGTCCTAAC CGACTTCTTGCCACCAATGT CTTGCGCCAGGAGAGGGCAA CCTTGAAGATCGGGGCAAGC CGCACTTGATAGTTAGCCAG TCGAGTGAAACAATCTCAGC TGCGGGTCCGAAAGGACTGA CTTCCAGGCGAGGGGGGGGC CTGCGGAAAACCCCCTCCAT GGTACGGAGGTCTGGCATCC TAACCGACACCTTGCCACCA ATGTCTTGTGCCAGGAGAGG GGAACCTTGAAGACTGGGGC AAGCCGCAGTTGATGGTTAG TCAGTCGGGTGAAATAATCC CGGCTGCACCCTGCTGTGAC TGCTAAGCCCGGTCCCCAAG GGGCATGAGGCATGTGCGCT GAGACGGGAGGGGTGACATC TGGCGATCAGCACAGCACAG ACTGAAGGGAGGCACTTGCC GAGAATGCTTCTGAGGCCCC AGACTTGGGGTGGTGCAGCT TTGTCTCGTGTATAGTACAG CACCCTACTGCTCCCTTTGG GCAGCAGAATTTGTCCTGAC CTCTTACCCACCCGAGTCTG CGCTTTTGTTCCACCTCGCT GTCTCCCTGCTGTGCTGTTT TTCTCTCAAGTGGGTTAAAT CTCAACATGATTATCTCCCA CGTTTCCGCTCAAGGGCAAT GCCCAACATGACGGAGATCG TTGGTGCATGGTAGTCACGA GACCATCCGGACCCTCCAGT GGTCGCTATAGTCATTTTGT GTTGCATGGGCATGCTGAG TCACTTAACCGAAAGACTGT AAATAACTCAAAAGAGGTAC CCTCCGGGGTTCGGTAAA (SEQ ID NO: 1335) | SRKERVARLLXWRALLGSVD MVNIFASKHRQENLSDXALS PS (SEQ ID NO: 1457) |
| R2 | R2-1_IS | . | Ixodes scapularis | GTTCCAAAGGAAGGCACTCC TTTGGTTCGTGATGAGATGT TCATGGTGCTTGCCTAGCTG GAGAAATCCGACTCACACCT GCACGTGGTCCCTGCCGCCT GCCAGTATGCCGAGGAAACG GGTGCAACTTAATCCGTGGA TACTGGTAGCAACGTGAGCA ACGGTACGGTCCTTCGCGGA CCACCCTGGGCGTTCGGGTT GCCAGCCCGTTCGCCCGAAA TATCTTGGCCCTGAAACTAA AAGAAAA (SEQ ID NO: 1213) | TAGTGTGACGGAGTCCTCAA GCCCCCACAAGTGCCTGCCA GGTGGCAGGAAAGGGCAACT ACTGGTGAGCGACCCAAGCA AGGCGGAGCCAAGACCAAGC TGGAGCCAAGAGCAACTCCA GGAGGCAGGGGTGGATATCA AGAGCAACCCCAAGGGACAC AGACCACGGGCAACTACTGG TGAGCGCCCAAGACAGGGGT GGATATTAAGAACAGCCCCA CAAAGTGTTACCTATATTAA CAATAAAGTTGAAGCCTCAA CCACGCATTGCGGGTTAGAT GGCGTGGCTTGGCCCGCCGC CATGATGAGCTGGAACCCTC CACCTGGTGGGCCGCACGAG ACCACCGGCTCTTTCTACTA AGGCCGGTCTCCGTGACTGC GGTTGGGATAAACTCCAAGC ACTGAGCGGTAAAAAAAAAA AAAAAAAAAAAAAAAA (SEQ ID NO: 1336) | MQCTSRLADAPRFARVGVEG EGVGASGNGTDAQLWYGCTG CDEAFSSLRGLRIHAAQKKH GNQDGLLRLPAGRPRKRRVG KSTTAGASDRVTTDPVPAPV PESPGLLPGLPGPSLPGCSD LPPGVLPGGWSASPGPLSWP PSLDAGPLPGPSRVSPGPSR PSPGKPTGPPSLDAGPLPGP SRVSPGPSRPSPGKPPGTPE PLPGSPGGRRGVSPGQPGSR TDPSSSAGAGHFVCPQCSRA FSSKIGMSQHQKHAHLEEYN AGINITRTKARWDPEETYLL ARLEATLNPDHKNINQTLHA ALPRGSCRTLESIKAHRKQA AYRDLVTSLRSARESSEAQH VPDRPLETPEPQTPANPQRD SKQAVIEALQSLIGRAPPGS FQGARLWDIARQATRGTNIL PLLNSYLRDVFTLPTKPTRK KPAVRPARSRRKQKKQEYAR TQDLFRKKQSDCARAVLDGP TSSSVPGTGAFLQTWREIMT GPSPALEAPPLPTRGEVDLF FPATAQEIQSAEIAVNSAAG PDGFSARLLKSVPALLLRVM VNLLLLVRRVPAALRDARTT FIPKVPDAVDPSQFRPITVA SVLQRLLHRILAKRALEAIP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LNFRQRAFQPVDGCAENIWL LSTALNEARTRRRPLHMASV DLTKAFDRVTTDAILRGARR AGLSGEFIGYLKELYTTSRT LLQFQGESLLVEPTTGVRQG DPLSPILFNLVLDEYLSSLD PDISFVSGDLRLDAMAFADD LIVFASTPAGLQDRLDALVE FFDPRGLRVNVKKSFTLSLQ PGRDKKVKVVCDQIFTIGGT PLPASKVATPWRYLGMTFTP QGSINKGTSEQLDLLLTRTS KAPLKPQQRLVVLRNYLLPR LYHRLVLGPWSAALLLKMDT TIRGAIRRWMDLPHDTPLGF FHAPVTEGGLGINSLRASIP AMVLQRLDGLHFSTHPGAEV AIQLPFLTGLHRRAEAAAQY QGQRLLSKADVHRMWSARLH GSCDGRPLRESKRVPAAHRW AAEGTRLLSGRDFISITKLK INALPTLERTSRGQHKDIQC RAGCQAVESLGHVLQACHRG HRGRIRRHDNIARYVCGRLT QIGWAVKWEPHYSVAGRTLK PDIVAHRGAETVVLDAQVVG TSMRLGFHHAQKKEKYSLPD LLHQVCEGRRDAARVSTITL NFRGVWAPESAQDLKSLGLT DNDLKLLTVRCLQGGAQCFR LHRRMTTVVKATGDEANALP AHSGLPPTQLGGRTLGPSAH NQSARTT (SEQ ID NO: 1458) |
| R2 | R2-1_MLe | . | Mnemiopsis leidyi | TGGGGGCCCCTTGGACTTGC TCCCTGGGGCAGGACACCAG TGAAAGGAGATCCTCAAGAC AGGACAGAGAGACAGGCACA CCAACCCTTCGAACCTGAGG AGACACCCAGATCTGGTTAC CCCATTCCTGTAACCATGGT TGCTCTCCGTGCGCTGTTAA GGAAACCCAGCCTAGTACCC TCGGGGAAAGGTTGCGTAGT ACTTAGCAGTGTGCGGATCA AACCTCTACCGGTCTCTCTA GCGATGAAAGTTTCTCCGAC TGGAACTTGAGGGACTGGCT AGCCCAGCTAGCCTGTAGAG CAATGCGTATACGATGCCTT GGCGACAATGGCGACCGCTG CTTAGCAGACGGAGGTTAGT GAAAGGGCGACTTGCTGTTC ATAGTCACGTGAGTCGTCTA GAAACTTATACGCACCCAGA GACTGCACCGATGCTGCCCT CTGTTCCAGGAGAAGGACAG TGGAGGACTAAATCGTAGCG CGAGCGGTGTT (SEQ ID NO: 1214) | CCATGCTCTTACCAGGCCAC TTGACGGCGCTACACCGGTC TGTAGGAGGGTATCTCAGCG ACTTGGACAAAATGGATCTT GACTGCCTGAGGGCGCTTAT CGAGTGACCCAGAGTAAGCT GGTAGGAAGAATCTTGCAGT TGAGAGGGCTAGTAGGGCCA GCCTCTGCTCGTCAACTGTC CTAGGCGTTAACGTGTGCCT CCCTATGAGGTAACCGTGAA GTATTACTTGTTTCCCTGTA GAGACCATATAACTAGCTGA GAAACGCCCTGCGGGTTAAT ATATAGTGACGAGAAAAGTC GCTTTATCCTTACATAACAG TGTGATAGTCATCCTTATCA CAACTGTCCTGGCGAACAAA ATGGCAGAGGGATAGTACTC GGTCCAACCAGAAGGAAGCC CACACGATGCCAAACTTGCT GTAACCCACGTGAGCGGAAA ACATCCTCCGAGTATAGTAT GATGGAAGGATACAGGATGT GGACCGCTCTAGGCGGCGGA CGGTGTAGACGGCGACCTTA CCATAGCTGCGACTGCTGTG CGATCCGGAACGGGCCTTTC TCACTTACCTCAAGCACCGT GTCGGATCGCGGGGTGGGCG CGGGATTCCTGCTGGGAAGT TGTCTGCACCCAAGTCGTCA GCTAACTGTCGGTCAGTTAC CGCCGTCCTGCATCCCCGAG TTGTGACCAGCGTACAGCCA TGTACCACGGCACTTCCAGC ATTCTCTGGTCTAAGAATGT ATCAGCTGGCCCGCCGAAAG ATAGAGCGACCCCGCCTCTA | MSNTSHSKLNLKMDNKLKTS LETPSGVRADSIITRVRTSS NRGEHSNGVTYPRCEQGVAP LDTHGGICDAPPQVTVPATE TDKQKKCEYCEFTYLKPRQI GTHMRKRHPQEWNDIKRTKF LSEKRQKRWLDEDFELLCIG QEEYLVLSSIGKQGKGINQY IQTKYFPTLSTDAIKSQRKS RRFSEYSEKRSRELQPCNTS SDPEELPNEAVTENSPLSFD PLDRDVVKKISSKDHGDQIL LVQEHLINGRYQEANTLAKA IFEKLSGKFPNLKTGDHRPG KQQTARKVGKKRVRGSGKKL SPSKQNRRELYAIVQKQWRT KKRSKVINQILTGNLNKEQS YTHTPDQLAQFWSTLFGRVS PRDDRPINHRRSVIPELDKP LSVEEVEAALKGAKDAATGI DGVPISHLKHLGSAALTILY NGLYVTGSIPDPWKRARTIL IPKSNPPASPGDYRPISISS YFYRIYTSAISKRLASAVSL DDRQKGFIKEDGIRDNLSLI DTLINETKAGSKSLFMTFMD VKKAFDSVSHYAIARSLEWA GVPDGMRSVIADLYQDCTTD ICGRSVKVTRGVKQGDPLSS TLFNLVIEMVMSNVPERLGI QFQGHRLFYLAFADDLVLLT RGPTANQKLVSLVHEQLARV GLELHPGKCKSIAIMADPKR KTTFVDQGSSVLIGGEPVSS LGPQEWYKYLGIKLGSGGMP QGIYRDQLADLLAKTDSAPL KPQQRLYILRSHILPKFNHR LMFERVTCQTLEGLDKLIRT HVRKWLKLPKDTPGPAFYAD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | TCACTAGAGTAAGCAGGCAC GCGAAATATATGCAGGACGC CTTGGCTCAGTAGCTCTGGT ACTGAGTATAGCATGGCTGA ACGCCCTTTAAGTTCGGTG GCCCAGAGACTCTCCGAGAC TTCCCAGTCCTGGAGAGGGT ACACCTTTACCAGAACTTTC TGTGGTCGGTTG (SEQ ID NO: 1337) | KGSGGLGLITLRYRVPLLKL RRHKKMADSPDPVIRLIPNA EPTISLLARWTKMCSLYGKQ YQHKSELSKIIRDKYWTMCD GKGLRTEVPPDTAKKTLSLL FEDRTPLKPGQLIGAIGVRL NTLGTPARNNRAKGYSPEAN ICDKCPGNRQATLGHISQTC PATHGRRVKRHDKIVNRIAK ALKERGSVKNILTEPHLRHD KLPLRKPDLIVHTEKSVEII DVQVVADQGISRHEDEDQQK KIVKYDVDGYKRAAYKMLGI DYGSIPCNVSAFTITWRGNL APHSLKLASRLQFSPVLKYI VADSLVDTWGAFLIWGKTS (SEQ ID NO: 1459) |
| R2 | R2-1_PM | . | Petromyzon marinus | CTATTAATGGGATGAAGAAG GGGGACACGAGTTTGTGTGT GCATCCAGTTTCCATGGTGC ATGCAGGAGTGGTGGTTTAA ATGGCGAGACTCTACAGGGC TTCCATGGCTACACGGGATG CAAGGCATCAGACATTTTGG CACAGGCAATCCTTTTGGTC TCTACCGCAATCATGTCTTA GACCTCAGTAGCGACCACTA CAACCACAGTGGTGACTGCT GTTGAGTGAAGGACGACTGA GCGCTGGATAACAACTTTCT TGCGTGGCCCAACATCGAAG CAACCACTTCGGAGCTGGCA CAAGGCAAGAGGGCAGCCCA AGGTGTGAATCATCTCAACT TCACTGCAGGAAGAAATGCT GTGCAAGGATGAGTGTGAAC GACACCAACGGGATTGTTGC TGACCAGGAGGTGCCAACCA AATTTGAATGGATTGACTTT GGGCCTGGTTTCTCCTGCGT GTATTGCACGGAAAAACAAG TGGCTACACGTGTGGCCGTC GTGTCCTGGGGTTTCGCAAC ACAACTCCACAAGATCGACA ACTATGAGGATGACAATGTA CTTAAAGAACAAAGAGACTG ACGCCAAAGGGGATTTAAAC CGCCAAATCGTACATTGGGT CTCACTACAATTTTTTTACG TGTATTTATTTTCCTAAGTG TCTGTACTTGCCATTCTTCG CTGCTTTTTCTGCATTAATT GCATATCGTATGCAAATAAG CGAATTAACCACCACCGTGC AACTATATGCAGATGTTACA GCTGAGCCCTCTATCATACC GGTGTACTAATCTGGTATGG TGTTGGCATGCTATGCTTGC GTAACGACCTTTGCTGATTG GTTCAGTCGGCTGATGGTGG GTTCAGGCGAAACATTTGTA TATTGGTTTAATCAAACCGA AACACTAAAATTTGAACAC AGTTTTCCATTACACCAGTT GTATTGCTAGAAGTGCAAAT CGAAGGAGTCAATTTTGACC GACGATTAGCTGCCGATGTG | TAATTTAAGGTAAAATCGTG GGATTGTTTTGATGGCAATC TGCCTAGTCGCGGCCTTCCA TTTTGGGTAGGCAGCAGACC CATCTATATAACAAACTACT TTGCCTTTCATAGGGGTACC CGACCTACCAACTTTCGGG GAAGTAAAAGAAA (SEQ ID NO: 1338) | MNERLTDELTTEFILSDMFL WDYPCTDQNKCYPCNLVFLD HRTWSSHMARVHPHANKTYK CRICNRTADSIHKIASHYGR TCKSLIGKTNAITTTIDETL FSCLHCSRGFTTKTGLGVHT RRTHPTEHEAILQQNTPGRK VRWGEEEVEIMAHKEAQQKD EDINMNQLIQNSVMPHRTLE AIKGKRRNIKYKELVRTLKE TTYKVENQCLVNLVLPTTSE ITTTPSEGDQPAIRAEKEQS PTAAEDLQVIINDLKSQNFS HNQALLLLNSHVEKFLNRSK PIKRKDHVNQQEIDENRHRR QSKQTKYRRYQYLYHTNKKA LLDEITSDRSGPSIYPTEES IRGTFVTLFESNSPPDNIPS KLKNDQSCIDIVKAITLDEL IKTLAIMKDKSPGQDNITLS DLRTLPIKYLLDILNIILYI QDIPQIWKQHRTRLIPKTKE ELEKPSNWRPITISSIVIRL LHKILSYRLGQQLKLNYRQK AFLPVDGCFENSALLHFIIH NARQKHENTQIVSIDLSKAF DSVSHESIIRALNRFNLSKE SITYLTNIYKCNLTDIVFGS TIMRNINLKRGVKQGDPLSP LLFNMIMDELLDNLPTYIGV NVGNQKVNSMMFADDLILFA ETECGMNKLLDITTKFLDDR HLKININKCNSLRFIKYGKQ KTFSVATTSSYFINNEPINP VSYVKGFKYLGIEFDPRGKR SISCNLLAAMLNKLTRAPLK PEKKVYLINNNLIPRIIHQL VLGKVTKGLLMSLDSEIRKT VKLLLRLPHDTPDSFFYTSV SNGGMGIRNLCDSVALSIIN RHNKLITSDDLVIRALSQQS YTIATLKQAHIIAGSKFPSK SLNQNKWSNKLYQTTDGRGL VYCQSQTENNSWITGNHRTI KSYNYIDMVKLRINALPTKS RCNRGTLETKQCRFKCRSIN NQISEETLAHILQKCDRSHY SRIARHDSLVQFLATAAQKL NWEVIKEPTLPSDTNKAKPD LILVRDSHVLIVDVAVPWES |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CGGTGAAAAAGCTGATCACA<br>ATAGCATACACTTGGGCCGA<br>CAACCCCGTGTGCTATAAAC<br>GTAAGTCGCGAATTATAAAG<br>AAAACAAACCGGACGGACTA<br>CTCGGTGACGAACTAACATC<br>GCTC<br>(SEQ ID NO: 1215) | | RSLAHAYDFKVKKYATDKKM<br>QAYLKTIYPEKEIRTEALII<br>SARGGWCALNNMVTKKVGLS<br>SAWVKLALIKVMEGSVKIWR<br>SWSKG<br>(SEQ ID NO: 1460) |
| R2 | R2-1_SM | . | Schmidtea mediterranea | CAGTGCTATTCGAATGTCAA<br>TGTGAAGAAATTCAACTAAG<br>CTCTGGTTAACGGCGGGAGT<br>AACTATGACTCTCTTAAGGA<br>ATTAAGAATTTACCTGCCKT<br>AKTAAAARTGAAATCMGTTG<br>TTCATWGCAAGTGGTATTGT<br>ACACCTTCCCGCGGTGCTAG<br>TCGTTTAAAACTAAGTTACA<br>AACCACGAGGGGCGTCCTGA<br>CGGACTGSAAAAGCATTGAG<br>RGTCMTGAAGAGAGGCTCTT<br>ATTGTACGAATCTCTTCAAC<br>GATCGAAGTCTGGACCGATA<br>TGAGAACTAATACATTAGTT<br>GACAGGTGAAAAATACTGTT<br>GATTACTTAGTTCTCAGTCA<br>TGTGGTATATTGCCAGTCAA<br>TTACTACATWAATATTAGTG<br>TGGCTCTCAAAGGAACACGA<br>TTGRTCGGCAGTCCAATGCG<br>CGACTGGCGGGCTTGTTGTT<br>TGCATTTGTTACCGGCTACT<br>TGAAAAGGTTATATATAGCA<br>GACGCTTAAAGCGCGACTGT<br>AATTTCATATYTCATTGCCCA<br>GTATTTGTCTTTTGTCAGAT<br>TTAGCAAAATTTCATATTTT<br>GTTAATTACCTTAACTGGTT<br>AAACGATCCCATAATTGCTT<br>GCAATTATTATAAAGTAATT<br>CAGGTAAAAATTACATATCT<br>GGCTGATCCTGCCAGTAGTC<br>ATTTTACTTCCGCCGCGCTA<br>TAAAACAGTTTAAAAACTGA<br>ATAGGAATCAAAAAGAACAT<br>GGCAAGCGACTATATGTAAC<br>TGGGCATTCAACATTCCCTA<br>TTAGTATCACCAGTCATGGT<br>GCCATATCTTTKGATAAAGA<br>TACAGTTTAAAACTGCGATG<br>ATACTAATAGAGATCCTCTT<br>AGACCTTCGTAAAGAAGTGG<br>GGATTGATGACATTAGCATT<br>GGAAGAATTAAATCTCCAAG<br>GAAATGAGTAACTTCAATG<br>AAGTCCCACAACCCCGTTGA<br>AGGGCTGGGTTCGAGTATCG<br>AGAGAAAACTCTAAATTCTC<br>TTCGGTTMTGTCCAACGGAG<br>GGGACATTACTGTAAAATAT<br>CCTCTAAAAACAACT<br>(SEQ ID NO: 1216) | GGCCACGCGCGTCGTCCTTG<br>TTTGATCACTAGTGGATCAC<br>CCTTCGACTCCCCGGAACTG<br>TGGGAGTGGCGGAAGAAAGG<br>CCAGAGGATGTCCTGAAACC<br>ATATATTTATTTATAGAAGT<br>TTTACTTCATCCTATTTACG<br>TATTTCAGTATGAAAATGAG<br>TAAAGTTCTCGACTCGATGA<br>GTTGGGGCAACCATTGGGG<br>GTCCTGAAGAGAGGCTCTCA<br>CTGTAAAAAATCTCTTCGTG<br>TCTGTTTATTCCTAGGCACN<br>TGCTGCATTATGAAGCGGWG<br>AAAGTAAAGTTAGAGCTGAG<br>AGATAGGTACTTGCTGCATT<br>ATGAAGCGGAGAAAGGCCTC<br>GAATAAATAGGGTGTTAGAG<br>TTATTGATGGAGAGTATACT<br>AGTAAGCTTAAGCTGCGCCT<br>CGCGCGGTGCCCAAAAATAT<br>ACTTAATGAGAGCAATAACT<br>CAAGGNGAGTTTAATTCATA<br>TGCGCATGCGGCACCAAGGT<br>NRGVKQGDPLSPALFNNVID<br>GCTGAATGGCATCGATTAAA<br>CCTCTCCTGTTGTAGAAGCA<br>GGTCATAAATGGAGGRGGGC<br>AACCACTGAAACTTATGAGC<br>CAGAAGAAGCTTAACTACAW<br>AAGTTTTAGGCAATTACTGA<br>ACGGAGTTAACTGTTAGTTA<br>ACACTACCATGTAGTTGTTT<br>ATAAAGCAAATATCAGGTTT<br>CAGTCTATATACTAAAAGTA<br>TTTTTTGATACCGTGGTATA<br>TAGGCAACTAGTTAGGAAAT<br>AGTAACATATGGTGGTCCT<br>GGGGGGATGACGCATTGTCT<br>CGTCTGTTTTATATAATGGG<br>TCTTTATGGTACTGAGGAAA<br>CTTATCGACTCGCGAGTACC<br>CGGGAAGTGGATCTGGATGA<br>AACCCGTAAACCGATCGATY<br>TAGCCTATAAGTACCAGCGA<br>CAGTTAAACCATCTTACGCG<br>AGGGGTAAAACCTGAGGACC<br>GATTATGGTATAACTTCTCA<br>AGATTAGCACAAATGCGAG<br>TGCAACTTGAGGAGGAGGAT<br>TTGAGTGTTAATTCATAATG<br>TACTAATCTAATTAAACTGT<br>GACGGGAATTGCAGCTTCGG<br>CTGTAATTACTTTGAGGCCT<br>ATCACGGATTGTAAGGAACA<br>TATTGACACCGTAAGTCTAA<br>CGTGTTCCCGATTTCCAACC<br>AGGTCATATGAAGGGCTGCC<br>CTTGATAAGGCGGATTTGAC<br>CCAATTCTTCATATGAGAGG<br>CTTATTCCAGCCTTCCCGTA<br>GTACCGTGAGGTTTTCCCGC<br>CTCGAACGGAACAATGTTGC | MKKVLNNETEKLPGSNLTFM<br>CGFCDREFDTARGRGVHESR<br>GHLVERDAAVQSRVKAVVSK<br>KYYYSNEEDVALAKMQLKHA<br>DLAKSEXLEAMYLALGKGRT<br>REAIEQHIRKSLRYKGVLEE<br>QRKLLETARGNVRQNNVGVP<br>ASNATKNLORFLESLPLGTN<br>RREERLDRIIRSNSIESQRL<br>ELIHYCNDMCQDFVQLDCQX<br>NPINAIRRRNPKRLSKKQLK<br>RAKFSALQRLWIRDRKAAAQ<br>LVLKDKLDSLLSNKEDSKDL<br>GSYWQQVFERESELDRRPIP<br>QVVENEELNSPVLEKEVEWA<br>VKNIKKSTAAGPDGLTALAL<br>KKIPYSELVKLFNIILLVGF<br>LPDVLKNSRTILIPEVDNPQ<br>GGGDYRPISINSVLTRTLNK<br>ILAKRVSEGDFGINGQKGFK<br>SVDGCLENLATVESILADAR<br>MKKNKLAVVFLDMSKAFDSV<br>NHESIVRAGEIKGYPKLLMT<br>YVKECYNDATTNVAGVTAKF<br>NRGVKQGDPLSPALFNNVID<br>LAIERVSGTGIGYNMGGKKY<br>SVVAYADDLVLFGESREGLQ<br>IALTALLEELKLNGLTPNPA<br>KSASLTFERSGPHWFASTDT<br>VTALGDQIPAMGNIETYKYL<br>GIKFNSCGVVKGSLPGIYTK<br>KLELISKAPLKPQQRLAMLT<br>DFLIPGVLHQAVFGQTNAGD<br>LRSLDKRTRRAVRSWCHLPS<br>DTSTAFIHAKAKDGGMGIPS<br>IRAEVQFGKLDRFGKLPNVK<br>DERSKVLADNAHIKKKMLEK<br>LGVGIPIKGVRCKNKLEFYN<br>KMREELIKSNDGIGLKEASL<br>VPSANTWLKLSDLHMSGRTF<br>VGCLKTRGNLMATVVRTSRG<br>GQNPGIELNCKKGCQYQGSL<br>NHIVQKCPVVKGLRIKRHDE<br>VVKYVEEITKKAGWSATMEP<br>IIPFEGSHRKPDLVLVRGDL<br>GKVVDIQIVSDHCGLDEKNS<br>CKIGKYDNDIIRNYVRGLGP<br>SRVEVAAITLNWRGVWSRDS<br>FNLIKRLGMTEMDAKIISMR<br>VLASTAKMFKTCKKVLEPVC<br>RTKTADCDGYGPEETSARPC<br>HELNLKESSGT*<br>(SEQ ID NO: 1461) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | AGGGTAATTAAGTACATCGG GCTATATMGCGATATTTAAC GTTTTA (SEQ ID NO: 1339) | |
| R2 | R2-1_SP | . | Strongy locentrotus purpuratus | TCTCGCGACGCGTTCTTCTG CCTGATGAAGTCACGTCAGG TAATAGACTTAGAAGGTTGA TGAGCGTTCCTCTCCTGGAC CGGGGGTGAGGATGTGTTCT ACTGAATCATCGTTCCGGTT GTGAGGTCCGCTGCAAATAG GCCTTGGGGTGGTCTACCTC CGGGTCGCTACTCCTTTTGA GCTAGTCGATCCAGGTGAGA GTCGGGGAAGCCCACTTAGG TGGGCCAGCTAAGCAGATCA CCCCCCCAGCACGACAGTGC GCTGTAATATAGCCTGTTGA GAGTGCACCCATTTATAA GTTATAAAAGTATAAATGGT TCTTAGCTAACCTATCCAAT GATTTTTATTGTTATGTATA ATACTGACCACTTTAGTCTA GTGTCATGTAAGGATCCAG ACAATAGCCTATGTCTCTAG TCTAGCAATAACACAAGAGG GATAATCCACCTCCCTACTC CAGCCACCACCTTTACCTTT CTTATCTTCCATATAGATGC CAACCAGACGGGTCGATGGG CAGTGAGAAACAAGAATGGG GATAATTTGGAATTTGACAT TCTTTCCTAAAGCAGACCTG AAGGGTTAAGAGTCACAAGC GGAGTCCGGACTGTCTTTAT AAACAGACAATATTTTCTTA TTTTACCACCTATATGGGGA TATTTCCCAACTCGTAATAT AGGGCCCACTGTCAAGTGGC TGGTATAAGTTACCCTGTGG GTAACAAATAAATTCAAACA AAGA (SEQ ID NO: 1217) | TAAACCTTGCCTCCCCGGGC CCCCCTCAGTGACTAAGACA ACTTTCACCGTAATAATCAT ATATTTGTATACCATGTATT AATCTAGGTAACAATTGAAA GTAACATTGAACCGTATTCA TACTTTAATGAGTACAATAG TGAAGGGAACTGTATATTAC ATACCTCGAGATAGAGGTTT TTGTACCTTAAGGGTTCGTG AGAATCCATACTGCATAAAG GGGTTAACTTGTAACTCAAC CCCAGGGAGACAAGCCGACA AATTCGGCATTACTATGTGA GGGTCATAAGTGTTAAAGGA CCCATTGTATATAACTTGTA AATGTACAGAGAATTCGAGT TGAGTTCGAAGAATAAACAA ACAAAAAGAAAACAAAGAG AATTCGTTCGTCCATAGAAG CGGAAAAAGCGCAAAAAGGC GTCCTAACCTCACGGTCTAA CCCAGAAACATTTAAGGGGG GGGGGATGGGATAACCCCGG AAAGAGAGGGATCTTTAGAT AGTGGATGGAAGGGGTGGGA CGTTGAATCCAACCATGCCG TTTTTATGTTCCCGATAAAG AAGGATAAGGTCACTCCAGC CTGACACACAAAGTGGGGTA AAAGAACTCCGCTCGTACGG ACTCCAAATAGAA (SEQ ID NO: 1340) | MENSFAWEGTSSAEGRTTVE DSPSSSDDFVSNVGFKVAKA DPTVWEEANMSEDNTIIEDP PSSSDDFANNVGFKVTRADP TAWEEASTSTETEDLPSSSN FIDNVETQIDMAGPTAWEDA DSNEDNIDEGTPNNINNNLA IVRGRADAYACSCCERNFIS LKAIGTHLKETHNKKVVFEC AKCQHTFVKAHGLACHVPKC KEDADTPMLNRLLHGCGECG LAFNTRRGLSQHERHRHPSA CLSTRRRSRLDGIARKKSLR NRRDIWTNDEIRLLKQLMIQ YEHAKKINIKIAEHFNHKNA KQVMHKRRSLREKDMALGAP HDAPPPLAEEPIIEVVEGAR EELEQAPVDVILPDLEALTV NDGRGGGSPVLTEGGESTRD MEENGGTDTRSPSPREERAG STPWERGWQPRVDRGRGEYK GYGGERGDRHTVSLSQRGES GVDPLTPGGVVEDYDDSYLE DYFPGWDEDEHMHIIGRLDL SDESEQGEAAVSPRLGSFGD LLEEVNAMEGKDNLSEALAE TLGLVLHEGHRVEYIKEKMN INVKQMATEILAHGANKGNP KRRKEAVAAKRNPGTRLDRA QRDNQAKAKAKEKKRIFSET QTQYKKNPHRLVEKLLDGKG DERCSVSLEVIQRTYMNRFS RESKEVDIGAYVDPETVEDN QGIVDPISKAEIERAISTTK KGSAPGPDGVTYDALKAYGN CQLYLLIMYNTWLAMGKVPS EAKTYRSILIPKGQGDPMDI NNFRPLTLANVISRLYSKIL TRRLDGAVSVCPRQRGFTHK ASIEDNTLILRELIMKSKRN KECLAVVLLDLAKAFDTVSH DLIIKALRRHRVHEHLISVI MDLYEGGTTSFTTDEGTTCP IAIRSEVKQGDSLSPVLFNL ALDPLLATLEQRGKGVEIGG HTFVSLAYADDTALVSSSHL DMTANLDITVEYLNATGLSL NVRKCQGFLLTPINKSFLVN EAESWVVEREAIPWVEPGDT AKYLGVQVGPWSRPWPSIQP VIKRLTAYCESIDKAALKPR QRIHILTTYIAPRIAFEIAE GGYSTLVDCRGGIQYTRIRE VDMTIRNYVRKWLFLPACLS NSFLYTRRGEGGLGLVSFYD YVPTERMRKLVRVCDSEDPV IAGAAASLGLRERAAKISAQ TGLPVPVKPKGAHNAWRKVQ KKKWKAQPTQGKGVSCYQHR LGNKWLGAPSFLTENDYIWA IKLRTNLVPTREAMGRGIIG RNQVECRHCHTTIETMGHIS GYCQMVLDIRLIRHNRICKA LIKAATATGLRVTEEPRIVG TDGKNYLPDLIFSAGAGEPC YVVDPTVVWDDDPKNLREAW |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | RGKVRKYTPIIPAVEAMLHP SSVQIFGFVCGARGTWCPMN DDIAKIVGLKNSGISRTLQI VLCDTIRMVKAFMAR (SEQ ID NO: 1462) |
| R2 | R2-1_SSa | AGKD 01072 455 | Salmo salar | AATCTTTAACCCCGGACTCT TGGGGTTCTTACGACTCTGT ATGAGGAACAGTCGAAGAGA GGGCGCTACCAATCCAAGTA TATGTCCCAAGAGGGCTGGG ACAGGGTGGAAGAGTGCACC TCGCGATCTGGGGCAGGGAA GGAATGGAGAGAAGTCGAAG AAGGCTTGTAGAGAAGGGGC TCTCCTAGATCCTAACCTGT ATGACGCCCGTAAAACGGTG ACCCCAGTAGCGAATAAAGG AGGCAGGTGACAATAGAGGG CAGGGCCGACTTCCCAGGTT TACATTGTTGTACTTGTCAA CATAAAGAGGTGTCTCAATA GTTTGAATCAACAAGGGAGA GGAATACCGACCTGCTCCCT TGGGGCGGGGGTACTGGTCT TAGCCCGGTTCCCCGCAAGT TTCCTTTGCCTGGGATGTGC CTGACTGGCTCCATCCCCTT TCCCCATTAGGCACGGCTAG ATGACGCACCGATGGGCGGG TGTGTAGGTCGCTACCGAAG GGGACTGGGGGTGTCCGGTG AACCAGGACTTCCCAAAATG GTCTCACATTTTTAAGCGGC TTGAGTATCGCCCAGTATCC TCGCGCGGCACTGGGAACCC AGTCAACCGCTCTGTGCCCC GGCGCAGGCGGGGGTTTAAT GTCTCCCCGGCTTCACCGGC GCTTCGGCGACGACGCAGAG GAGCACCCGGAGGCCCCCAT GAACTTAAACCAACCTATCT TGAAATATGGCCTCTCGTTC GGGTGAAGGGCAGGTGGGAA GAGAGGGCTGCCTCACGATA AACACCTAGTCAATAGCCAG TCGGGAAAAATGTGGAATGT TAGGACAGGGAGGTAAGGGA GGCGGCTTTTTCGTAAGGCT CCTTCAACCCCTACCTGTAG TCCACCTATTGCAGGTGTTG ACAACATGCAAGATGACCTG CCTCGTTACGGGTCGCGTAT CATTGCTACAGGTCGTGTGC CGCTTCAAGAGGATAGTAA GGAGAGGTTATAGGGAGGTC CTGTTAGGGCTTCCTCAACC CCTCTCTATGCGATTCCTTA CAGGAGTGGATCGAGAAGTC CCGGACGTAATACACCCTGG AGGTAAGGGAGTGGCCTTCT AGTAGGGCTGCTTCAACCCC TCTGATGGGAGTGTACCGGG AACCTCGACTTGTAAGCACA GGTTAGTATGGGACAAGAAG GGGGAGCCGTAATGGGCTTC TCTTTCACCTGCTTACATAA TACCTGTGGTGCATGTATCT AGGTCTTGGCGGGAGAGTAC TGAGAGACAAGGTTGAGACC CCAAGATTGGGTCTCCCTAG CCTCTATAGCTGCGACTCTT AGCGGGGATATGGAGTAACA TGTACCAAGGGAGTGAATAA | TAGATCCGTTTGTTATGATT GGAGGGAGCCTGCCGAGTGG TATGAGCGCTCCAACTATTG AACCCATATGATTCCCGAGG CCTGGCCAGACGCCTAGATG CCTGCCACAATTGAACGCAG CCCTAGCTTGCTAGGAGATC CATAGGAACTGGCCTATGGG GCGTCATGACGGTTGAAGTT CCTCCATAGCGTGCTTGGGA GGGGACGACAATGACGAGTC ATGACGTACCGAGAGAACCC CAACCCAGGTTGGGGGAGAG CAACCCAGAAGAGCGGAGATG CTTGGTATACCAAGCTAGCA GAGAGAGGGTTGAAGAGGAT GACTACTGGGCTCAGAGTCA TCTCACCCTAAAAGGCGGTG GGGCATCGGTTGAACACCTA CCCATACCGGGATGGGAGGT GGTAGGCCGAAAAAGAACAG GAAGATGGTGGAGTAAGTTG AGAGCGGTTGCTCGGAAGT TATGTTGTGATAACTCCATT AAGGCCGGTGGGCATGGTGC GGATAATGGAAACTATAAAA ACAATAAAAGAAAGACCAA AAAAATGTTCTGTTATGATG CCTTACACATGTCTGGGAGA CCCCATAAGGGTCTCCCCTT ATACTTCACTGGGAAACCCC ATAAGGGTATCCCCCTATAT TTACTGGGAGACCCCCATAAG GGTCTCCCCCTATAGATGTA GAGCGTAAGGGGTCTCCAAA GTACCGGCCGATATGGCCTT ATGGCAAACTCTGGTGGTAG GGACAAGGAGGTAAGGGCAG TGCCAACCCCTACTTGATCG GGACCATCCAGGGAATGCCA TCCTCCCGCGAAGGTGATGT GGTGAGGTAAGGGGGAGCC CGTCTTCGAGTTTCCCCAAC CCCTACCCACAGGTGAGAGG AGGAGAAGAGGAATCTGTCC CCAACGGGAGGAGGGTGAGG TGTAAGGGGAGACCTTCTA GTAGGGTCTTCTCAGTCGCC TGACGTCCTGACTGTGGGGT GGATCAGTACCCTACAGGTG AGACCGGTGAGGTAAGGGTG TGGCCCTCTTGAGGGCTGCG CCAACCCCTACTCGAGGTAA CCTGAGGGAGTGGTGGAATG GCGCATGTTAGTGCTGGGA CTTGATTGCGAGGGTTTAAT GAGAGTGGCCTGCTGAGAGC AACACTTGTGGTGCTTAAAG CGGGCGCCCCATGACCACC GTGAGATAGGACACTGCACA GTGCAGCCATGAGGTTCTG GAGGATGATGCGATGAGGTG GGGGCCTCATCAGCCCCTCC TGGCAGGCGTCGGCCAGGG AAACTAAATGTCTCTAGCAT GTCAGTGCAGTGAGGTAAGG GGAGAGCACTCTAGTAGGGC TCTTCCAACCCCTACCTGTA | MSGKRIVEMSGCDEKICQNK HCLKRRWAWISGPKGETSPP RKRGTCENVSFQDKSHASDP DPLKAPEAREDAGSVAPQWV GEIKTPSLTSRDGVSEVVLP PQPVHAEGVSPASDSKDKAT KITLLISLPVCDLRCGRCER PLETVGKAVRHFAVAHPTVS VVFKCQKCEKSSKNSHSISC HIPKCKGMTETRTDVEGDHG CDHCQEKFTTAMGLTQHKRH RHIVQYCKEKEGEMTARRKG EVEAVKWSEWEESEVARLSD GLAGLKMINRRIADSLGTGK TAEQVRQKRRRMRPEKVRCD KPKEAKDKSNLIKMLSIPSA TPTPQTGLKGFLLGELNGVA TKGEVQIGGVTLSLRGVEQD SALLNTSALELQRLLGGRAG SANPLSLQRERETTLPSERR KTKQGEYRRVQKMFRSNEKK IAKYILDGNGDGEAASPPLE IALAFKSRWEEVETFHGLGQ FYSRGEADGVVFRSLISMSE VCENLGAIKNNTAAGPDGIT KPALLEWDPTGAKLAAIFSI WLTSGTLPGPFKKCRTTLIP KTDDPILLTQVAGWRPLTIG SVVLRLYSRILTHRLERACP INPRQRGFISSPGCSENLMI LGGLIKRSWAKGERLAVVLV DFARAFDSVSHSHILEILRQ RGLDEHIIGIVGDSYTDVTT TITVSGEQSPPIDMRVGVKQ GDPMSPLLFNLALDPMIDTL ERYGLGYRMGEQQITALAFA DDLVLVSDSWEGMACNIRIL EEFCRLTGLRIQPRKCHGFL IQKIQRARSVNLCKPWIVCG EELHMVGPEESVSYLGMKVS PWHGIMEPDPVERLCNWISS IGRSPLKPSQKVRMLNVYAA PRMTYQADHGGLGPIVLNVL DGMIRKAVKVWLHLPLCTCD GLLYSRCQDGGLGIVKLACQ IPSIQARRVYRLWHSKEAIT RVVTRRTVEAEEYRGMWLRA GGSEAGLPPLEDREEGAVQC TDTAGSVKPKNPVIPDWRRA EFLKWQNLTAQGVGVQVFGG DKNSNHWMANPETLGSKERH YIAGLQLRANVYPTREALSR GRPDLPKVCRQCLAGTESCA HILGQCPAVKDSRIRRHHKL CDLLASEAESAGWTVIREMC CRTRAGALRRPDLVFVKTGF ALVVDVTVRYEMAYDTLMGA AAEKVARYTPITPYVAMTLK ARRVKVFGPPLGARGKWPGS NDRLLKAMGVGGGRRKQLAK LFSRRALLYSLDVLRDFYRA EGETGDLDDESVDDHL (SEQ ID NO: 1463) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TAAAGGAATTGACGGGGTAC AAGTGACTGTTGGCCCGAAT CCTAGCCACTTGATGACCAG GGATATATTACAGACTGAGA GCGAATCTAGAGACGTGAGA ATAAAGTGAGAATTGGTTGA GCGAATACAGAGGAAG (SEQ ID NO: 1218) | GGTCACCTGGTCCAGGTGTC GATGATGTGAAAACAAGAGC TACTTTGGTACCGGTCTGTT GCAAAAGGGTTCTGCAGAG GACGACGGCTATCCCTATCG GGAGGGAATAGTCGGTCCCA GGTAGTGGAAAATGGGGCTT TCCACTGAGCATGAAAATGT GGTAGAGGTTGCGTCCAACC CAATGATTTGCAGCAGAGCT CTTGGACACGAAGTCTGTAT AGTCCCATGCAGGCAGCCAA CCAGAGAATGGTGGCAAGAC CCCAGCTCCGTATGGGAGGG GAGGGCCAAGATATACGGAA CGGCTGCTAAAGCGTTCTGC CGGTGTCAGTCTAATCACAG ACAGCTGTGACGAAACAAAG TATGGGTTCCGACATGCTTG GTCAGCTCTTAGCCGCAAGG CTTAAATCGAACGCAGCCCG CCGAGAGTGAACATTAAACG GGGATGGAATGTGTCTAGCG GTTACGTACTACCAGGGCTC AGGTTCGCCTGAGCCGAGGC TCTACACGTCATGGTGGGAG TTCTCCCCACGCTCGTGAGG GCATGTAGTGGGATGGCATG TGGCGGACCATCAGCTGGCA CTACCAGGCCTCGGGCTTGC CCGAGTGCGGGACCTCACAC ATTGTAGGTGTGCTTGTCCC CCCTACGTTCGAAGACTTGA GGCGGAGAATACTCATAGGC CCCACGGCAAAGGGACACAA CACGGAGGCTTGTGTCCGAC GAGCCGTGGACTCCTATAGA CAGCCCGGGATATCACTGGG CACGCTCATACTGAAGAAAT TCGATGAACCGGGCCTACCG GAGCAAATGCACTCTAATCG CCTTTGTGGGCGACTGTGGC CCCCTCATGCGAGTGAGGAA TATCATAAACTGCAATGGTT CAAAAAGTGATTCCTATGGC TCGTCGGGGAGGGCTGACTG GGGCAAGCAAATGATTGAAA GGGGAAGAACCTTTTTCAAC TGTTTCTTGCCAAGCCCGGT TGATGGTGGCGCTAGTAATT GCGACGGGAAAATGCGGTTT AAGTCTCCGAAGTAGTGCGT AGCACCGGATGTCGACCGGG TGTAAAAGCCCTTCGTAAAG TCCCTGGGGAGGTCAGTCCT GGGGCTACTGATGCGCAGTA TGTAATTCGCAGAATAGGGC CATCGATACCGCCTGCGTGA CTCGACTGGGTTTCCACTTG AGGATATCCGACCGTAGCGT GCACCCTCTTGTAGTTGCGC CGGAAACGGCTGTGTTCCCT CACGTATGTGAGGAAACTCA ACAATGTGAGTGGGTAAACG GCGGGACGAACTATGGCTCT CGT (SEQ ID NO: 1341) | |
| R2 | R2-1_TCas | . | Tribolium castaneum | AGTCATAGAGCCAGAACCTC CTCGTGGTCCCGCTGGGCAC AGGGATTAATTTTTCTGTGG CAAATTTGACTGGCTTCAGA GAGCGTTTTTCGAAGTGGWC | TGAAAAGAGTGGCAGTTGTG GAGACTTCCTTCGGACGTCG GGTCGGATTTTCGGACGCCA GGGTACCTCCACCGCTGGGT TCACAAACTAGGCGAACATC | MSRRPGKSNEPPVRSRAMGL TTLSGTKTSNSGAQGPSTSA PMQNMAGGFVCDCGRSYALK TSLARHKKECGKNNAECRWC GTRFNTLAGTRQHERKAHFV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TGTGTGACTGCGTTCCCCCC TTAGTTGCTATWTCCGCTKM GATTAACATCTCACCTCGAC GTWTAAGATCATT (SEQ ID NO: 1219) | TGCCGATACCCTCTTTAGGT CATAGGACCACATGTCTCTG CACGAGATTAACCCA (SEQ ID NO: 1342) | QYQSDLAKALPQPESELMEK IAIVEARSXNGIFYKEMMAS TGLTHQQVRSRREKPEYKGF LERARRSLAQTNIRAGSISP ASTXAGSLESASPKAGCSSS ASPGPTTRSRAPTKGVPXRS SNSARIVVEAQVHTRAPPNT GETEVALRESRRTVPRLGXN PSRPCGISPLMAIAIDEDSV LGGLRVQAGPSPTAVHSVEA FPGTSSMTPMETDRVHNKSG IDPILEHNGTRQVRREESST REDPVEQWSPNYPKTPVTMP NITTTADAXXTSYNRTPQTL PGNRRRRSRSLPPVQRKSAS DXLESVDSLGPWAVFLQDQV DAGSLSGNDSLADLVRVALT KSDRGVLNDAVNRYLAQRAE SLRIRKRGSKGKRKSKTGRH YGQTTSGSGQRAALFKKHQD LFLKNRRGLAETILSGKEDF GPRPEPPVTSVEEFYGGIFE SPSPPDNEPPEVRATGVEDP PPLTSPWTKRTLRSPCYWRR RPPPTYITMDEIKAARAGWQ ISAPGSDQIPVAAVKTMSEL ELAILFNIILFRNVQPSAWG VLRTTLVPKDGDLRNPANWR PITISSALQRLLHRVLAARL SKLVSLSSSQRGFTEIDGTL ANALILHEYLQYRRQTGRTY XVVSLDVRKAFDTVSHCSVS RALGRFGIPSVIREYILATF GAQTTIKCGSVTTRPIRMLR GVRQGDPLSPVLFNLVMDEL LEKVNEKYEGGSLOSGERCA IMAFADDLILIADRDQDVPA MFDDVSTFLERRGMSVNPAK CRALIAGAVSGRSVVRTGSS YKIHNTPIPNVDALDAFKYL GLEFGHKGVERPTIHNLSVW LNNLRRAPLKPDQKCLFIRQ YVIPRLLYGMQNPQVTSRVL READRLIRRHLKTYYHLNVH TPDSLIHASVSDGGLGIMEL RKAIPRIFLGRLVKLLNKNK DSVLSSVLQSNRVRTLMGKL STMAGEVPESTFWRNQIASG PLSKGLEQAAEDSASRLWIS EKPSGWSGRDHVRAVQLRTG NLPTKAIPSVPVGQRRCRHG CACDESISHVLQMCPLTHAD RIRRHDEVVKKVARHCTSRG WTVEVEPHIRSRCGRLFKPD LAVHQPGGAIVIADVQVSWD SESLTVPYERKRAKYDVPQF HQAAQHAWPGKALTFAPVIV GARGIWPRINNDRSAALQIP PVVRRACVNSVVKWGSSIHA TFMRSVWANRLNPRPLRA (SEQ ID NO: 1464) |
| R2 | R2-1_TGut | . | Tinamus guttatus | CTGGGGACCGTGGTTACAAC CCGGGCTTAGCTGCAGAGAC AGTACCTCCCCGTGGTTCCC GCCGGACCCGTAACATCGG GTGACTGAATCTGTCTCTG CCCGGGAGTAGTTCCTCCTT GCCCTATTGACCAGCGGTCG CCGGCTGCTCAATAGTATTC TAGGCGTGAAATATAGCGAT AGTCCTAGTGGTTGTCTTAC TGGGCCATAGCCCCTTGCTT CAGGGGTCATTCGCGAAGTC | TAGGGGGCTTGGCATTTCTC ATTGCCTGCTCCTGAAAGGA TATGGGTCCTGCGTCGCGTG GTAGGCAGACCCATTCGTCC GAGTAGGGGCTTGGCAGTN TCCATTGCCTGTGCCCGAAA GGACGTGGGTCATCTGGTCT GTCTGCCTACACCTCTCTAG ACTTGTAACATCTAGTCGT CAACAAGATCAAAATTCTTC ACACAGACGACCGAGCTTGC TCAGTCTTCCTGTACCCGCA | MGSWIVNFVSVATQTGEFPV DTARRAPVPVTSYPESECHX PLPLTFCNSDVTIWGGVRPE PVDCLGDLPEXYDALPGVAG PREXVGGSPPGEGVRSPGIA SPSGTAVQHDFGSPILVPGA EAAEVSTPVVKVPQDHPACP CCGTRVVKVTALSEHLRRAH GRKRVLFQCSRCGRMNEKHH SIACHFPKCRGPPVEEGPLG APEWCCEECGQKFNTKSGLS QHKRSVHPLTRNVERIEAAR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TCTCAGGAGAACTGGGGGTG GTGTTCTTCTGGGTATAGCT AAACCCCCTAGACTGTGTCC GATCC (SEQ ID NO: 1220) | GAATTTTGCTCTTGCTCTCC TTTTGGCTGTGTCCTGGACGT GGGACTATTCCATCTCGTCC CAAATGCCGCGTCCAATTAT ACCGGATTTGACAAAGCGGA CGGCCCGCTTTATAAGCCGG AAAAGGTGCCTTGTAAAATT GCAAGGTTCATTAAATAG (SEQ ID NO: 1343) | PKGKGKRGAHKGCWTEAEVA QLIELEGRFKNQRFINKLIA EHLPSKSAKQISDKRRQLAA ATKTSSPEKRVTSSTSGESS PEVEKVEGIKREYRRRVGEW LCAGSLXDQTSFQKILEDVE SGSEIVTGPLEELASFARGK LAAARVRHHRKHPAEAVPAR EEQRWMKRRVGRRGLYLRFQ RLFALDRRKLAGIILDDVES IKCPLPMEEVADVFRRRWEE VAPFTGSGSFRSLGKADNGA FKPMISAKEVMKNVXEMSRR SAXGPDGLSLRDLMKIDPQG SRMAELFNLWLLAGRVPDQV KAGRTVLIPKSADPGKIGNI DNWRPITIGSVXLRMFSRIL SARLRRACPINRRQRGFIAA PGCSENLKLLQALIKSAKRD HRTLGVVFVDLAKAFDSVNH QHIFQVLVQKGVDGHIIDIL RDLYTNAGTYLESGSQRSGF IKILRGVKQGDPLSPILFNL ALDPLLCRLEDRGLGYKYGD QQIXSLAFADDLALLSDSWE GMQQSIRVVEEFCQRTGLRV QAPKCHGFLIRPTKESYTIN DCDPWTIADMQLDMIDPGSS EKYLGLGIDPWIGLSRPELS EVLTRWVKNIGGAPLKPLQK VDILRSYALPRLLFIADHAG LSATCLHSLDLSIRSAVKGW LHLPPSTCDAIIYVSYKDGG LGLPRLASLIPNVQARRLVR IAQSEDDVIRSVVLQEGIQE EIRKVWISAGGRPEKVPSVT GEFPVMEAQAADEALSEWER RAPRTIYPIPCKWRKREMEN WTNLKSQGHGIRNFENDRIS NDWLLHYGRIPHRKLITAIQ LRANVYPTREFLARGLGEGA PRGCRHCPAEWESCSHIIGY CPAVQEARIKRHNDICGVLA EEARKLGWVIFIEPHLRDNT NELFKPDLVLVKGSCAKVVD VTIRYESGLTTLSDAAAEKA RKYQHLAGEVRALTSATTVD FLGFPIGARGKWYVGNNGLL SDLGFSTSRVVRIARALSKK ALLSSVDIIHIFASRARQAQ TSE (SEQ ID NO: 1465) |
| R2 | R2-1_TSP | . | Trichinella spiralis | CTCCTGACTAACCTGATTTC GTCCGTGCGGCGGCGTTTTC TTTTCGCTCTCCGCTCGTCG AAATTTGCTGTAGTTGATTC GCTTTTCTTTGCGTTTTCTT CTACTTTCGCAGTTTTTTCT GCATTGCCACG (SEQ ID NO: 1221) | TGAGGTTTTTGTTTTCTTTT TTCCTTTTACCATTCTTGTT CCATTGTTGTTATTTGCTTT AATCCTGTATTTTACCGCCG GCAATTCCATTGTTATTATT ACTGTTACTGTTATTATTGT TACTATTGTTTTTACTTTTA CTTACTACTGTTATTATACT TTAATTCGTTAACTTACGTT ATTGTTACCACTACTTACTT TGCTCTCTCGCAAACGTTCG TTGTTGTTTCTTTTGGACCA GGTTTAGAGAAATCGCACGC ACAGCGGAACTGGACCGCTT AAGCCAGAAATAGTAAAGTA ACAA (SEQ ID NO: 1344) | MSNRLANTAAAGGVPEKTSG TLDIPGQPSSSGEKRAISYP GPFGCNSCSFTSTTWLSLEL HFKSVHNIRDFVFLCSKCKK SWPSINSVASHYPRCKGSVK AAVVPTSLANTCTTCGSSFG TFSGLQLHRKRAHPDVFAAS CSKKTKARWSNDEFTLLARL EAGLDPACKNINQVLAERLM EYNITRGVEMIKGQRRKDQY KALVRQLRSNSETQQCVGLA GSMDSNVPANDTSSSVASEV SITYPEYGAVMSCDLIKEAT GMAIVDINELQSNLRKAFLS GRKLPMKFHGARETAQKKMA NPRVAKFKRFQRLFRSNRRK LASHIFDKASLEQFGGSIDE ASDHLEKFLSPRPLESDSYS VISGDKSIGVAHPILAEEVE LELKASRPTAVGPDGIALED IKKLNTYDIASLFNLWLKAG |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | DLPASVKASRTIFLPKSDGT TDISNCRPITIASAMYRLFS RIITRRLAARLELNVRQKAF RPEMNGVFENSAILYALIKD AKVRSREICVTTLDLAKAFD TVPHSRILRALRKNNVDPES VDLISKMLTGTTYAEIKGLQ GKLIPIRNGVRQGDPLSPLL FSLFIDEIIGRLQACGPAYD FHGEKICILAFADDLTLVAD SAAGMKILLKAACDFLEESG MSLNAEKCRTLCITRSPRSR KTFVNPAAKFIISDWKTGIS SEIPSLCATDTFRFLGHTFD GEGKIHIDTEEIRSMLKSVK SAPLKPEQKVALIRSHLLPR LQFLFSTAEADSRKAWLIDS IIRGCVKEILHSVKAGMCTD IFYIPSRDGGMGFTSLGEFS LFSRQKALAKMAGSSDPLSK RVAEFFIERWNIARDPKVIE AARRVYQKKRYQRFFQTYQS GGWNEFSGNTIGNAWLTNGR ARGRNFIMAVKFRSNTAATR AENLRGRPGTKECRFCKSAT ETLAHICQRCPANHGLVIQR HDAVVTFLGEVARKEGYQVM IEPKVSTPVGALKPDLLLIK ADTAFIVDVGIAWEGGRPLK LVNKMKCDKYKTAIPAILET FHVGHAETYGVILGSRGCWL KSNDKALASIGLNITRKMKE HLSWLTFEIIFITQISRIYN SFMKK (SEQ ID NO: 1466) |
| R2 | R2-1_TUr | scaffold_6 | Tetranychus urticae | CTCTCTTATTTTAACATATT CGATGTACTCGTACATTGAA TATGCTTTTATTTTTTTCA AAGTTTTTTGGGTGCATACC CCTGGAAAATTCTGAGATGT ATAAATCTCCCATCAGCTTT GGCTGAAACGTTGGCTAAGT TTTGTAGGTTGTTTGCCCCC TACTACTTAGTCGCAAATGG TATTTGCTAACAGTTGTTAA ATTGTTACATTTACAAGTCC TATCCAGTGCCTCCTCGTGG CGCTACCCGGTAACACTTAG AGTAATCTGAGTGGCTAAAC TGGAAGGGCGGAAAATGCAA ACAGGCGGTTGGTAGATGCT TCGGCATTTTGCCAAAAATC CACGGCTTTTTAGCCCAACA ACATCAGGGTGATGGACCCG CCAGCTTGTGGTCAGGATCC CATCCATGAATAAAGCATGG CTCTGCTTCTGGTGCATCCT CAACGGGATCGGCTTCGGCT GGATGTAAGTCTTGCGGAGG C (SEQ ID NO: 1222) | TGATGTATCCCTTCAATATA TTGTAATCCTCATTCGTCCC TATCCTTTCATTTGATAAAA GAAACTTTGTTGCTCCTTTT AATAGTTGGTCCCTCCTGTC CCTTTTCTGGAACCTGGTTG TATCGATTATTGAAAGTTGC AATAAACGGATTTAA (SEQ ID NO: 1345) | MCILGGLTSHSREGGLSRGS SQLKTVKPQNEEDNGTTQLK AGSADSFPRPSGDLNPEEPL SIDICPVCFROMKSYLGVRV HMQKMHLEEYNASIPDPVVS HTRWSDEEAAQLAFTEAKIE VDKLLPRGKGINKFLLELLP GRTLESIKSHRKRQSHKDLV RKYVKEFVDTLAADNDDDTI ICQDNGDIFNDPIVGATDSQ SETETVADPAEFKTFIELAD DPTKPKVVAKLRNLIKDKPK SEILGSDILVRILRRTLHGL PVEDELDQYLEVYFTGKIKQ RRSKTQTALSKKQIKQRDYG RLQELYSRSRKRCANEILNP TSMSGGFGHQELSEFWTKTF GPDEQPTLGEVEIIPKENCW WDIFSPISSDEIKASYPSIG KAAGPDNFSAYQLRKVPVWH LECLYNIFAFYKDIPSRLKD AKTILIPKKDNAESPGDFRP ITLSSIITRHFHKILATRVN NFVRFHPMQRGFIQSDGCLE NTALIQTVIREAKVRRKQVH ITFCDVRKAFDSVRYDSIIA AIAKKGAPGSFIMYLSNLYR GNKTTLLTAGGETRITPTRG VRQGDPLSPILFNCVMDQIL TALPSRTGFTLSAGDESVNV NCLAFADDIILISKTKNGHQ ELLDVTQRILKENGLDLNPD KCCSLSLIPHSKTKKIKVVR ADFVVNGVKVRSMSIGDSTC YLGVSINVTGQVAPVKMYQA LCEKLDSAAIKPHQRLYILK HFVITKMFHPLILSTIAAHK IKNLDLISRRYVRKWLHLPH |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | DCGSGMIHAKVSDGGLGVPL LFRTIADLKVRRKEKLQVHE NPIFRILAKLSTVSKELENC KKIASKTTDIQEKTFKEMLA TYDGLSLKEARAVPEVHKWV DSYDKRYKFAGRDFVQVIQA RFNALPTRSRVWRGRGADEK SLRCRAGCNARETLNHVSQS CFRTHRVRTARHDKILDFIC ERLDVVGVKYVREKPISFPG KKLIPDLIVENTDQALVLDL QIVGDNSELPLDERGKNKVI KYNCSEMQELYKRKKKTLAV KALTLHYKGLMAPETSNILR SFGFKSKDLEKMAYMALFGT VAAWGIFNRSTETMRSVANW PRPEEL (SEQ ID NO: 1467) |
| R2 | R2-2_DWi | . | Drosophila willistoni | GAAGCTGGGAAGCTGGGTCG GATGAGCGCAGAAGGGGTGT TCTTCGGAGCACTGTAATTC ATAAGTCGTAAGTCTGATCA AGTCGACTCGGAACCTCTTC GTGGTGTTTCCTGGGTGCTG TTGAGTTCCTAGTCTCTAGG TTCTCTCCAGTAGCTAA (SEQ ID NO: 1223) | TAGATGTACTAACCTCTAGT TTCTCTATACTTTTGCCTGC TACCTTGGCATTACATCTAA AAAGGTACAAACATCGCATT GGCAAAAGAGGTGGTTTTA GTACATAGGCGCTGTGGGAC TTCATTGTCCCGATGATGCA GCGAATCGTGCATACGAGAT TGTCCAGTAGTTGGTTGCTC GTATCTTTAGAAGATTTCCT TCCTCGGCGATCAAAANAAA AAAAAAAAAAAAAA (SEQ ID NO: 1346) | FERRSNSWGYQNLEPSNVGQ DMNTVPRINNTTTTPATSRP GDQPREAIAVVNLAGEIPCA VCGRLFNTRRGFGVHMSHQH KDELDTQRQREDVKLRWSEE EAWMMARKEVELEASGNLRF PNKKLAEVFTHRSSEAIKCF RKRGEYKAKLEQIRGQSTPT PEALDSITSQPRPSLLERNH QVSSSEAQPINPSEEQSNWE IMRILQGYRPVECSPRWRAQ VLQTIVDRAQAVGKETTLQC LSNYLLEVFPLPNEPHTIGR SNLRRPRTRRQLRQQEYAQV QRRWDKNTGRCIKSLLDGTD ESVMPNQEIMEPYWKQVMTN PSTCSCENTRFRMEHSLETV WSAITPRDLRENKLKLSSAP GPDGITPRTARSVPLGIMLR IMNLILWCGKIPFSTRLART IFIPKTVTANRPQDFRPITV PSVLVRQLNAVLASRLASKV NWDPRQRGFLPTDGCADNAT LVDLILREHHKRWKSCYLAT VDVSKAFDLVSHQAIIKTLQ AYGAPTNFVSFIEEQYKGGG TSLNGAGWSSEVFIPARGVK QGDPLSPLLFNLIIDRLLRS YPREIGAKVGNTMTSAAAFA DDLVLFAETPMGQTLLDTTL GFLASVGLSLNADKCFTVSI KGQAKQKCTVVERRSFCVGE RECPSLKRTEEWKYLGIRFT ADGRAQYSPADDLGPKLLRL TRAPLKPQQKLFAHRTVLIP QLYHQLTLGSVMIGVLGKCD RLVRQFVRRWLDLPLDVPVA YFHAPHTCGGLGIPSIRWIA PMLRLKRLSNIKWPHLEQSE VASSFIDDELQRARDRLKAE NVQRCSRPEIDSYFANRLYM SVDGCGLREAGHYGPQHGWV SQPTRLLTGKEYLHGVKLRI NALPSKSRTTGRHELERRC RAGCDAPETTNHILQKCYRT HGRRVARHNSVVNAVKRGLE RKGCVAHVEPSLQCDSGLNK PDLVGIRQNHIYVIDVQVVT DGHSLDQAHQRKVERYDRAD IRSQMRRFFGVTGEIEFHSV TLNWRGIWSGQSVKRLIAKD LLIAEDTKLISVRAVNGGVT SFKYFMYCAGYTRS (SEQ ID NO: 1468) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| R2 | R2-2_PM | . | Petromyzon marinus | CGGTGCGTTCCCTTGGGTAA GGAACACGAGTCTTAGTGGC CTTGACCTCCACGTGGTCCC GCTGGTAACATCATCTCTTG ATGATGGCTAACAAGGCTAA TGCACCCATTCCATCTCCTA TCTCGCATGGAGGCCGCTAT GCGTGATTACTAG (SEQ ID NO: 1224) | TGAGAATAATGAGGTGCTAA CCTCCCTGGGCCTGACCAAA CCCAGAACACATCACTGGCC AAGATGATTTCCCGCAGCAC GTTGCTTTTCTCTCTCGATA CCCGAGAATGTTCTGCGGAA CTACGCAGTCTATGAACAGT CACAGACAACCTCTGATCCA AG (SEQ ID NO: 1347) | RPQTKLMTDKLKFSSQLARG LAKQRAMDGARVGDPPITVR PTETDLCNTEGSWGRRPMKL LFVSVSTQTQNEDALWASDV AKPMASRSALKMTSIPSMTF HNSSLEKEEEMNYDFYEQIK SLVESDDSSDDFTEDDEDVE ESFLDISAEEPVLGKFPIDT KGTITVVLPSLEYICVICKQ HMGKASELVAHFNIKHRDIP LVFKCAKCDKTNSNHRSIAC HAPKCGGIKLTEESLPMVCE CCQARFATLSGLSQHKRHAH PVTRNEERIKDGIKGTSQRG VHRSCWSLKEVEQLALLELQ FQGKKNINKIIAEALGTKTN KQVSDKRRDLSKKTGAPMSD SLHFSSRPLETLSPPPNVTT GTSSILAQAAERLTNENSGT LEKPAMEAIKAWLNGEGQHD ALVETATALMLCPMRLVKNK GKRSKPENDIIKPRILPTRS WMKKRAEKRGSFMKHQKLFF KNRSLLASLVLDGTERHECR IPNADVYRFYCEKWEKVLPF NGLGQFKSSGVANNEYFEPL ISVEEVQTAIRAIKPTSAAG PDGLTRAAICAADPEGRTLT ALFNAWMITGIIPKELKKNR TILIPKVMDDEKLKELGNWR PITIGSMILRLFSRIMTARL ARACPLNPRQRGFIAASGCS ENLKVLQDLMRHAKKLHRPL AVMFIDIAKAFDSVSHAHIL WVLRHKKVDEHVVGIIQNAY DRCTTSFKSNGESTREISIR VGVKQGDPMSPLLFNLAMDP LICTLESHGVGYSIDTDHVT ALAFADDLVLVSESWVGMAA NLAILESFCGLSGLEVQARK CQGFMISPTKDSYTVNNCDP WTIKNKDVHMIQPDESTKYL GLKICPWTGIIRSDLHVQLK TRISKIDEAPLKPTQKVELL NAYALPRLLYPADHSDCKQS TLRVLDQEIIKAVKGWLHLP ASTCDGLLYARARDGGLAIL KLENAIPSVQVRRLQRIANS SDAIARNIASSQGVEEEYRS LWVRAGGDSEAIPTFFLRGS ESKEPVYPRPCDWRKRESRR RCEKPVQGRGIVNFAQDRIS NAWLGPRCGFKQCFFIAALQ LRANIYPTRESINRGRDGAS RSCRKCSARLESLSHILGQC PAVQKFKDCATQTEAEMVPH GPAGNALPGWSLSRTFLVNV PQYKNSRIARRNKISDILAD EAARLGWWVYKEPRFTSEAG ELRKPALVFAKGEEALVIDV TVRFELSRKTSSEAASHQVA YYTPPCDQVKVLTKASNVTF FGFQVGARGKVAP (SEQ ID NO: 1469) |
| R2 | R2-2_SMed | . | Schmidtea mediterranea | AGTCATAGGGTGAACTGCAA TTCTGACACGATGACCGAGC TGTGTCAGTTTGCAGCTAGT CGCTAAAGACTCGATCAGTC CGCCAAGTGAGGTGGCCGGG TATCTGCAGCACTAGAGCCA CTGGTATCAAGAGCAGAGAT ACGCGAGTGGAAGTTGAGTA CGACTACCTTCACGGGGTCC | TAGAAGGGAAACAAAGGAAA AACGAAATGACTGGAAACTA TGAAGGATATAGCTGAAAGC CCTCCCAAGAGGAACTGTGG GAAACCGATCTACATCTTCG ATCCCAAGAGGAACTGTGG TTAAGCTTGAGCCGACGGAA AAAGCGAATGCATGTTAGAC GACGAGGTACAGTCACCTCC | RKELVTIKNLFEESGATAPA PVPLEVAVEVHQSSSVPEIT DESTTTQEGSYSEPPIHRCE NCGREFRTRAGVQQHRRKAH TNEFMEEKEKAAPTKKLRWT DEEKEILIESEIKIIKEGSL KEQHEINKILASRMPGRSQD GIAKIRQKQEHKAEIQRRLH GVTTTNETRGNRTSEITEPI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TCCTGATAACCACAGTGGAC TGTGGGAACTAAATGTGTGC TCAGCGTTCCCTACTTTCTC GTAGGGTAAAGGGTATGATA ACCCAGAGAATATCCCATGG GAGATATCCATGGAAAAAGC ACCACGTTAGACAATCCGAT GGTCTAACTCGGCTCCGAGG GGCTAACTATCCCAAAGGGC TTAA (SEQ ID NO: 1225) | TCGTGGTATTTGGCGGGCAA TGCTCACTAAATTAACTGTG AGTAGCTGAGAACTGTATGT GTATCATGAAAAAAAAA (SEQ ID NO: 1348) | RSLPINTKTWSEDEMKRMLA EEVKLRTKNEKDINKKLAEI FPNRTMGSIKSKRTKDKDYQ DLVKLTMQTISENPDNETDF NTSNTENNSTDAEKEVKNYL NMLLLTINEEEWLTSTLKEA ATLALQGKKTEASEKLNEYA SKTLFPGLKITNQTRKREKK ISKRETRRQEYAEIQKLYKK NISSAAEKAINGKWSIKPEE EYHNNKDLIKAWKPILEAPP FSDCRPIENIKEMDYALMEI STAEIFLAIRAMGKTAPGPD GIKYSKLKKNIQSMAILFNT CLLTSFLPLPLKIARTILIP KQENPGILDYRPLTIASVVT RVFHSILAKKLDNNAQLSQR QKGFRKCDGVAENIVILETI LTNSRSEKRPLCMAFVDLRK AFDSVGHESIIRGAKRVGVP PMLLEYISSSYQNASTNLFG EILNSRRGVRQGDPLSPILF NFVIDEALENLNRNIGYLLK EEKVSCLAFADDIVLIAETK GGLENHIEKLLEKLNGAGLE LNASKCATLMVMKNGKEKST YISTKAIKIKENDIPTMKAT ETYKYLGLOMGFKAREQNAN EVITEGLENITRAPLKPQQR IHILRDFLIPRLIHKLVLGR VAKKSLKRIDQNIRKKVRNW LHLPKDTTAAFIHADAGDGG LGVPALEHTIPLLKRERITN LRKSNDPVTKECLRMEYTKQ VLGKWSRPTKIGETLATNKS QLKEAFRKQMLITLDGKGLK DHHETPTIHKWIRRGENMTG KQFITAVKIRGNLVATKSRN SRGRPEQEKLCEAQCGRPDS LGHILQGCWRTHGMRVERHN NICRRIKAIMKGKESEVVEE PRLQTNEGLRKPDLLICHKG KIIICDAQVVADSSNCSLES ENQRKIDYYKKDSVVSEARK LIGRVDEDIIIMAVTFNWRG AISKTSIRDLDMLLDIKSKE VIKMSRKIIRDNSIMVEMHR NRTEKRR (SEQ ID NO: 1470) |
| R2 | R2-2_TCas | . | Tribolium castaneum | TGGAAGACCCCGCCCATGAG GCTTGGAGAGTGTGATCCTG ATCACACTTGAAAAGTTATG CTGAGTACGTCGTGAGAGTC GGTAACTGTCCCAGGATGGT CTGGGATAGGCTAAACCTCA GCAGGGGAAAGTTGTAGGGG CCTGCCACCCCTACACTTTT ATAGATATGGCATTCGATAC CTCAAATAGAGCCTCGGACT TGGAGGAGCATGGTTCCCCT CCTCCTCGTACTAGACCTGG AACCAACGGTCTTGACAACC CCATTGGACCTACGGGAGCG GACCATGCTCATGGACATGG ATTCCGAAGACGAAGCGGGG GAACACGGACCCCCCGCCGA TAATGCTCACTTAACGTCAG GCGAACCCATCGAAATCATC TTGATGTTACCCTTTCAAAG CAGGTCATGCGGCATATGTC TCAATGCCGAAAGGGTGGC TCCCGGGCGTAACGGACATC TATCGCTGATGGAASCTAGC | TGATGCTCCTTTGGTTTTAC CATCTGTGGGGGCATCGGTC CTCACGGTTTCCTCGGGTTT CCTATTGTTTTTCCTAAACC CGACAAGGAGCCCTTTGGCC CTCCTCCTTAAACACCTCTC CTTCATCCTSTTAGTCCATT CCGGCTAAAATGATGAAGAC CGAGGAGTGTCACTCTCTTG GCGGGGTTAACCCGTCCAAG TGTAAATGTGACCTCGCCAT TCGGGCTCTGATA (SEQ ID NO: 1349) | MKSRSFRRIGDCAAGSSRRG VRLTGKAGREGRFAASPHLS PRYLAGSVSGNVPSVPPGPG LGAGAPAFAAGRNADGGPAQ NPCPYCARSFTTANGRGLHI RRAHPDEANNAIDIERIHAR WSHEETAMMARLEAGAIQRG GVRFMNQFLVPRMPGRTLEA VKSKRRDATYKALVQRFLQA PQINLPELRDGDAPRQPDPQ QENPPEPPSFDGAIRGAVAD LVGGVDWQRLGFQGDRLCNI ARRACDGGDVSGQLLGWLRD VFPVKRVSTRGDQSDLDVDG ALVSRRTARTREYARVQELY RKEPKACLARILGDRREGAN RAPNRDPAFIDFWRGVFSEA SAEVEGWAEEVSDHGELARR VWDPISVEEVGRSRVRNGAA PGPDGIAVSVWNKLPPEAAA LLFNVLLLGRCLPAELTRTR TVFIPKTDAPRTPADYRPIS IASVVARHFHRVLSARVQRI PDLFTKYQRGFLSGVDGIAD |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TCGCTCTTGAAGAACGGCGG ACGGGGACTTGGAATCGTGG TGTGGTTCTGATGTAAGTCC TGAAATTATGGCGTGATGGC CCGCCCGCCCGACCGGAGGG ACTTAGAACCCCCTTCCGCG AGGGTCCTGTCTGTAGGTCC WCCATCTCCGTAAAACGAGT TGGAGGAAACCGCAGACGGG G (SEQ ID NO: 1226) | | NLSVLDTMLTMSRRCCKHLH LAALDVSKAFDTVSHFAIVR ACRSIFGSAETVLEEGGRRH FVQVRXGVRQXDPLSPLLFN LVLDRALKRLSTDVGFRLTD ATKVTALAFADDVVLCATTA RGLQTNLDVLEAELRLAGLL LNPNKCQALSLVASGRDHKV KLVTKPTFKVGQNTIHQVDA SSIWKYLGIQFRGSGMCGCG SEGVAAGLKRITCAPLKPQQ RMHLLRVFFLPKFYHAWTFG RLNAGVLRRLDVVVRTSVRT WLRLPHDIPVGYFHAPTKSG GLGIPQLSRFIPFLRLKRFD RLGRSAVDYVRECAFTDIAD RKIRWCRERLSGIVDQVAGG RDALDAYWTAQLHQSVDGRA LRESASVASSTQWLRCSTRA IPASDWLHYTAVHIGALPSR VRTSRGRRGGQDVSCRGGCL LDETPAHCIQVCHRTHGGRV LRHDAIAKRISADLMELGWI VTREVSFRTTAGVFRPDMVA VKEGVTVILDVQIVSPAPTL DEAHRRKVAKYRDRADLARY LAEAAVARGRAPPANIRFAS ATISWRGVWSAESVGSLREL GLSARHFDRYTTMALCGSWR NWVRFNASTASRMGRGRGDA SPRRHENQQ (SEQ ID NO: 1471) |
| R2 | R2-7_MR | . | Megachile rotundata | TCTAGTTAGCAAGCGGCCCC CTCTAA (SEQ ID NO: 1227) | TAAATGTCGAACCGAATTTT GGGTAACGTGCACCCCACCA TCCTTAATCGGCAGCACGCA ATAAAGCCGTGGGCAGTGGT TTTAGTGGGTAGTCATTAGG AGTCCCACAGTACCCAGCGA ACATCTTAGTGGGTCTGCGT AAACGCATTTCCACTGCCTA TCCTCCGGGAAAAAAAAAAA AAAAAAAAAAAAAAAAAAAA AAAAAAAAAAAA (SEQ ID NO: 1350) | SGPATSTFGETKSRLCEPTS ALGCRPGAVVIQWAQIHKEK RKRIVGWPLGHLGSPTSLKL RHPRLQAKRIVPVLAELMQC LCARHVSGRSPQKSAWAFTL EERTSACGVDAMFVCSTCQR SFATKIGLGVHVRRAHVEVA NAAISVERVKDRWSEEERRI MAAVEVRGVLSGARFINEYI MSHLQTSRTLESVKGTRKNP KYKELVATLLEEARTSVREE SPRSAVNDSATQPSGPSDTR SLRTEHLFTESTEPFEHRIR ELIGDLEGVTDFRAELLVSI AEQQLQGDEVAESLTRWLGE VFKPENQQQQVQRKRRRQRK APVSGQLPKWRERRRDYAAM QTLFHRNPSLAAGRVLDGKN ESRPPDLPEMTAFWEPILTE QSAEHRAVGPASEKSELCSV WGPVEKEELLSSVPPLDTAV GPDGVTARQWRAVLPAVRAL LYNIILKRGSFPASMLESRT VFLPKKQHSVNPADFRPISI ASVVVRQLHKILAMRLRRTN LVDERQRCMDDGCAENITVL ASLLDDARHGLKELHLVSLD CAKAPFDSVSHHAIDATLKEC GLPAGFVQYISRTYSDSSTR LEVGRNRSEPIKTNRGVRQG DPLSTLIFCLCFDRVARTLS PHIGYDLNNTRISTLLYADD AFLVSTTAPGMNILLRSVEE SAGEVGLSFNTSKCSALSLI PSGKEKKMKVGTTPTFKTSQ GFITQITPSQEWRYLGVDFQ YSGPKKASRSLKIELERISK APLKPQQRLLILRVYLLPRY YHHLVLSRTTLGHLRGLDLQ VRAAVRRWLSLPRDIPIAYF HTTAKEGGLGLPAFETSIPC |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | LMLARLRSMETSTCKAARAA VQGFWVQKRIHWATAALTKN GEALTCKADVDRWWASRLHK SVDGRELRECSGVGSSSTWV NSALNITGRDYVQYHHVRIN SLPTRIRTSRGVRREGMEVT CRAGCQVTETAAHVIQSCHR THGGRILRHNAVCKVLASGL RDKGWEVREEPKLRTRQGLR KPDIVAIKDGVARVIDAQVV SGSGPLDEAHETKRKYYSDN GDVTAAIARECNIAPSNVAY SSCTISWRGVWSPRSAADLL QVGLSKKLLGFITLRVLRGS HLNWTRWNKMTTMRVHHQRT GIG (SEQ ID NO: 1472) |
| R2 | R2Amel | . | Apis mellifera | TGGTAATCAAATGCCTCGCT ATTTTAGTAGCGGTAGCGCT CCGCCCGCGCAGGAACCATT GACGCCGCCGTAGTGTGGGT GATTTTATATCCAACCAATC ACGTCAACTACGATCATTTG TAATCACCGACGGTACTTGG TAGGGGTACCACATGGGCAT TCTTGCTCATTCCACAACGC CGCCTCCATCATGGCAACAA TTTAAAATATATATAAATTC TTAAGGTTTGACCGTATTCA TATATATATATATATATTTA ATATTCAACCATAAATCTT ATATCGAGCCTTCTATTTGG TCTCAAAAGCAATACGTTGT CAGATCTTGTAGAACATCAG GAGTGAGCGGTGCGCTGTGG TATCCGTGCTTTGTGCCGCG GCGACAAACCAATACGCTGC TGCCTGTCGCAAAGCAATAC GCTGCTGATTCTCGGATGCG GGTGTCGACGGTCACGCAAA GCGATACGCTGGTGGGGTTT CAAAACAATACGGCGCTGGT GCTAAAAAGCATTATGCCGC TAACGGCTGGATTGTCGATC GCCGCTGCGGGGCTAGTGG CGCACCCAGAGAGGTGCGAC GCGCAAGCATTGGTTCTGTG CGAAGCGGAGTTCTTGAGAG TAATGGTTGCTGGGGCACA AAGCGCAACATATAGCCTCT TATGCCTCAAGTCGTAGTTC GTACCTCCACGTGGTCCCGC TGGAATGCCTATCGACTCCT CCCCGGAGGATCATAGAGTT CGAAACCGGCTACGGCGAGG CAAGGGCGGTGAGGTGCACA CCGATGGGGAGCAGCGACCC CACCTACCCTTAGCTAAGAG AGCAGGCGATCCGCCAACTG TCAGCACGAAATAAACTAAT CATATGTATACGAGGGAGAA TTTACAACGGGTACCTTGTG CCCGAACCGCCTGTAGGTAT CACCTACAGGTGTTAAAATG AATCTGATAGCTGGCGGATC GTCGACCCTCTTTGATGGCT CTGCGCCAACGACTGGAAAG AATAGGAACGGAAGTCTAAT | TGATCGTTAAAAGTAAAAAT CTATTTATTTATTTTTATTC CTATATTATAACACATTATT TATTTATTTACTTATTGTTT TAAAGATGACGAAGCCGCAA GGCCAATCCAAATTTAACAA AAGAACGAGACTACTGGTCG ACATTAAAAAGACGAAGCAG CTGCCAGCTGATAAACAACA GAGCCCGTCTCGGCCTTTAC ACCGAGCGGTGCAAGTCCTG ACGTACTATTGTACGTCTAG GGCGCGGGGCAGATTCTACC GTGTAGAATCTGGGGCGACG CCTCCGCGAGGCACTCCCTG GACAACGTACGCTAAAGCGT ACGGCTAAGTGCGCCTCCCG AAAGGGTCCCCGTTCCTAAT TTTTCCGAGCCCGCGGGCAG ATCTCGTGGCAGTGACGCTA GAAAGTTAAGTCCGCGGACA TATAAAATTACAGCCTTAAA TAATGAACCCCACGAAGGAG GTATCCTCGAAATTCCGCCA CGATCCTTCTGATCGTAGGC GCAAAACA (SEQ ID NO: 1351) | MSSNEEGASDTGAPGPGVPV ADVSAADGRATYDDHGMSTD YEKQTIELPLNGGQIQCLWCH IEGRNQRFLQESQYLKHKDT QHPKGEIIWRCAACQKEFEK LHGCRCHLPKCKGRKEAKGV AKFKCDSCEESFLTQRGLSM HELHRHPAIRNLKRTQGTSR GNTRPINRASVWSKEETDLL IKLNERYKHLKQPNVALKEY FPDKTLKQISDKRRLLPVQE PEDVATTDETGPPPSDSSEE SIYESATEDEGGGDMQQTAP NDSWKEPFIQSIRTNHLEEE DSLRKVEEAIERMAMNEGVT EQEVGTLLEQFVDSLTQSPT TERKGSRRKSQKTTKRKTTH NNRKKFLYAKHQELYKKSPR RLLELALSGESSSGREVVNL PEADSVGPLYKSLWGQIGPE KTHRNQPMCNNIDMSEIWTP IALESLVEKFKKIKSDTAAG ADQIKKFHLRKKGALHVFAK LCNLLMLHRIYPAQWKTNRT TLIPKPGKSAEEVENWRPIT IGSLLGRIYSAMIDRKLRSK IKQHIRQKGFTQEDGCKNNI AILSSALTKMKEDSGGIITI IDISKAFDTVPHGEISQSLM NKGVPSPICEYIQKMYIGCK TIIYCRDKKTLPVDILRGVK QGDPLSPLLFNLIIDPIIGT LDETTEGIKLENENISVLAF ADDLVLLAKDKETADKQNRL INEYLDDLKMKVSAEKCTTF EIKRQNKTWFLGDPQLTLGQ QRIPYADPEAAIKYLGTNFN PWRGLCKTSIKEIIDAARTV KQLKLKPHQKINLIRTYLLP RYIHKLVANPPPLGTLDLID KELKTIIKEILHLHPSTTDG LIYTDKSHGGLGIQRVANIV KLAKLKHSILMTRSEDNAVK IALNGQEGMVKRYATSIGLQ WPCGIEEIEETRKKLKRADT NKWKTLISQGQGIKEFFGDK TGNAWLYNPEMLRPSRYLDA LKLRTNTYGTKAALHRAKRD IDINCRRCGVQVETLGHILG LCTHTKNKRIKRHDEICDLI AKNVSKEYVIFREPEVEVNG |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | GGAAGGAAAGTGTCGGGAGC ACTATAAATTCCCAAAGAAG AAAAGAAAAGAAAAAAAATA AAAAACCCAAATTAA (SEQ ID NO: 1228) | | DRRKPDMVIKDHDKVYVVDV TVRYENNDSLNKAYKEKENK YKETAEIMRRDLKAKESRVL PVVIGSRGAVPRATIENLKV LGLQTKHALTASLIALRSSI EMANEFLDYDHTT (SEQ ID NO: 1473) |
| R2 | R2B_NVi | . | Nasonia vitripennis | GACTAGACTATGGGTTCAGT CAGTCCCAAATAGCCGATCC TGGCGCGTCCGGCAGTAATG CCACGTATGAGTCGGTTACC CATCTCTAAACGCGTAGAGG TGGGGAGCTAAAGGCCAGGC GGTTTACCCGACGTCGAATT TCTCCAGGTCTGTGTCAGTC GACGGAATAAAGGTACTACA ACATCTACTATCTATCGGGA TCGGAAGACGCCTTACAGCG TTTTCCGATTTTTGCTCTTT GAGCATTTTTCTTCAAATTG CGATAACCGACCCGATCACG CGGGGCTTTGACAAAGCAAT GCGTGGTCGGTAAGATGGTT GCAATCTTTTCCACCTCGTT TCTTTTACGAACGAAAGCA ATGCGTGTGGGGAACGTTAA AAACTCCCTTCATGCATCCC AGGATTTATCCTGCTTACTG CAAAGCAATGCGTGTGGAGC GACTTTACCACGAGTCGCTC CACCGCAAAGCAATGCGTAT CGCGCAAAAGCAATGCGTGT GGGGGACTTGTCAAAGATCC CCCGCCGCAAAGCAATGCGT GTCGGCACCACGTAGAGCAA AGCGTGTAGGCAGACTTTGT CAAAAGTAGTTCTGCCGCAA AGCAATGCGTGTGGAGATCT TCGCCGGTGAAAGCAATACG TGTGGGCGAACTTAG (SEQ ID NO: 1229) | TGACCTGAACAAAACGTGTT GTCTTGTCTTGTCTAAAACT ATTTATTCGAAATAAGGGGA GGCTAACTGCCTGCAAGTTG AACGCGAAAGTTAGACCTTC CCACCTAAAGCCCAAAAGTG ATCGGGGAATGAATCCGCGG GTGACCCCAGAGTTGGGTAA ACCCTTGAAACGTTGGAGAA GCGGAAGAGAGTCCCGCCAC CGAGCATCGAGTGCTGCGGC GCCCGAATGAAACCGATCGC GGATGGTGCAAGTCGTAGGA CGGGGCACGACCTAAGCCTC TGTCACGGCGGCGAAGCCAG GAATCACCATGCAAAGGTGT GAACTGGGGCGGATACCTCC ACGGGGTTTCCCTGGGCATC GCGCGAGCGATGGCCAAAGT CCGCTTTCTCAGCTACAAAA CAAAAATGGTATGAGACTTC GTTAACACTAATTTTTCCGA GCCTAGCAGGCTCCCTTGAC AACGCTTATGAATCTGGAAA AGGACACAAAGTGGAAAAAG CGCTGATGGTGGACAAAGT CAGTTGAGACTTGATATCAG TTGTTTTGACTAAGAATTTT ATTATCGTTGACTTTTAAAT ATTTTATTATTGACTGTTAA TATACTGACTTGGGACCAAG TCATCTCTGTTACCCGGTAC CGGTTCCTGTCATCAAACCG GAAAGTCCGTCCCACGTAAT GTGGTAGACGCAGGA (SEQ ID NO: 1352) | TFAPTHPMVRSGPCRKTKRP GSDYRESLIMDSGNNVASEP RGAVDVTSAAPIGAELNAEP CEGRNORREAALSAQTRRRN XARRARNAQQADEPGDDEEI ETHGPLTIRTXEPMEIVAIA KNPQACPKCLQGGTQLLCMG SWELSRHINKEHPSVDVTWV CGACQRRCTTLRSWSCHVLH CKGRQEPKDLPFKCEHCSLS FDSQIGLSQHERHVHPEVRN DKRAAEANKPKGKSGRRPSI WSDEDLLLIRELESEYHGAR NINEKIAEHFPDRTGRQVSD ARRRKDYAALRGRGGPQGPA EGVEAIEEVDEGEIPEGEEL VATDGAALESGPPENGGSAP AEQVNAPALESSSQQDRECS PAVGSDEQIEDSSDDDEFSD ALGEISLPEPLSVERTTISP PPRDDWKGPMRWEICNASEE AGSYANWVTGLQELVRNNAL SEIGLDSLYDQLIQIMRHPS DDNEQDRLQLNARGPPRRGH RKNRRRRRLTAADRKRFAFA RCQDLWNNNPKKLAELVIAN DLSILQRRQAPGRTETQTLY NELWGRVGPNIEAPRRTEDP IPVSRIFTPITPQEIMGRIR RIKNDSAAGPDGVTKDDLRG RGVSIALSKLFNSILLAGYY PKAWRENRTTLLPKPEKDPA DVKNWRPITISSMVSRVYSG LLDQRVRAVIKQCDRQKGFT EENGCFSNIQLLDDAVSNAK KAGGVITILDVSKAFDTVPH AVIQGCLEKKGIPETVAAYI SSMYRDCSTAIRTRSGDVKI GMKRGVKQGDPLSPLIFNLV LEPLLERLQETSGVEIEGMN LSCAAFADDIVCFANTAPEA GRQLRMVADYLGRLDMSLSV SKCIAVEYVPHRKTWYTKNP GLEVNGNAVPSISPSETFKY LGAKVSPWKGLLEGFESDAF REVISRVQRLPLKPMQKVDL LQMYIFPRYTYGLITSPPAK AVLKTIDRIIRTRIKEILHL PESVSSSFLYTPRKQGGLGL LEVEKMVLIAALRNGLRARQ SHDPVTRAAMNSNAADDRLK SYADALRLHWPLTTKELDTY KYQLRLSYAQKWAEQKWQGQ GVEEFAQDPVGNSWLQRYDL LPASRYIDAIKLRTNTYPTR ALMKIIDGRVDSSCRKCQGS SETLGHILGRCRYTKDKRIS RHNEIKDLLKARLAKNHQVM DEPQITVRGQRFKPDLVVKT NEGRVHVIDVTVRYEHRTYL DEGRTEKIGKYRQILSTLRR DLHSNAEEVIPIVIGSRGAI PRETRKALSKLGIGKSDWLT ISLIALRSSLEIVNAFMDD (SEQ ID NO: 1474) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| R2 | R2Ci-B | AB097122 | Ciona intestinalis | CGACGGTGAACCACCTTGTC GCGGTGTAAGAGCTTTAGTG TCTCGAACAAGAAATAGCTT GTGTGCTGTCCTTCTGGGCG GTGCACATACTTCTTAACCT CCCGAGGCCATGCCGGCGGG GGCTTTAGCCCCCGGCAGGT TTTACCATGCCGGACGGGTT CGAGAGGTAGAGGCCAAACT AAGAGTTCACCAGCAGACTT CGCACGCGGCTGGCCACTGG CCGAAGTTTAAACAACAGGG CCGCATCTTCCCAAACTCAA TATATGGTGTTAAGTGAACC GTGCCG (SEQ ID NO: 1230) | TGACAGTAATATGAAAACAT CACATCTGACCGGCACAGAA TCACCATGCCGTAATGCACC CAACTAAGGATTCCAATGGG TAAAAAAAAAAAAAAAAAAA AAAAAAAAAAAAAAAAAAAA AA (SEQ ID NO: 1353) | MGEWPWVSWSLTVLVEKWRP FTILQPYPMPGQLRVDVYLP RKTSYLMDKNIYENTTSPGG GPLCGEKTHRSDVIIPPPGF APSTDTASNTLGENVDASAT TSSANPLSQEPGWCESCSKL FKSQRGLRVHQRSKHPELYH SQNQPLPRSKARWSDEEMVI FAREEIANRKIRFINQHLHK VFPHRTLESIKGLRGKNVRY ARIMADLEAEMTSQPEAATS LCTETSENLASSNVLPQTRG WAENLVENIDTAHLANLGPL SQFEPGKPSSSTKEAINTEY NDWISKWLPSGAAHRERRAN PPSTKLNARATRRLQYSRIQ NLYKLNRSACAQEVLSGAWK VQSGELNLKEVQPFWEKMFR KESAKDRRKPKPTGEVLWGL MEPLTIAEVGSTLKSTTPSA PGPDKLTLDGVKRIPIAELV SHYNLWLYAGYQPEGLREGI TTLIPKIKGTRDPAKLRPIT VSSFICRIFHRCLAQRMETS LPLGERQKAFRKVDGICHNI WSLRSLIHNSKDNLKELNIT FLDVRKAFDSISHKSLGIAA ARLGLPPPLITYISNLYPNC STKLKVNGKISKPIEVRRGV RQGDPLSPLLFNAVMDWALS ELDPRVGVQIGEQRINHLAF ADDIILVSSTKIGMVSSINT LSRHLAKSGLEISAGKEGKS ASMAIVVDGKKKMWTVDPLP RFKVNSQKIPALSITQQYKP LGINIDAQGARNDAARILTE GLAELSRAPLKPQQRLYLLR VHLLPKLQHGLVLSSCAKRA LTYLDKSVRSAIRRWLTLPK DTPTAFYHAKACDGGLGITR LEHTIPILKRNRMMKLTLSE DPVIMELVKLTYFTNLLHKY SNVKLLNSWPVTDKDSLARA EASMLHTSVDGRGLSNCSDV PRQSDWVTNGASLLSGRDFI GAIKVRGNLLPTKVSAARGR QREITCDCCRRPESLGHILQ TCPRTWGPRISRHDSLLKRV RNQACLKNWTPIIEPSIPTN IGLRRPDLVLAKGNIAFLVD ATVVADNANMQLQHEAKVEK YNNSDIKEWIKVHCPGVDEV RVTSLTANWRGCLYGGSASF LTEDLGLPKAELSLLSAKIN EKGYYLWCAHYRGTARLWNR PLRS (SEQ ID NO: 1475) |
| R2 | R2C_N Gi | . | Nasonia giraulti | CGGGTTCCCCCGACTTCGGC TTGCCGTGGTCTGGGGCTCA CTGCTTTTTGTGGAGTCATG GTTACATGGTGACCCTGGTT CCTCGCACCCCGCTGGAAA CTATCTGGGAGGCCATGAT TGGGTAACGATAAAGGTCCT GGTCGTGTCCTCCTGAGATA GGCTGAATGGGTCACTAAGT GGCACCTAA (SEQ ID NO: 1231) | TAGCGGACTGGACTGTCTGG AGGAGTGTTTAACTCGGGTT CTCATGGGAACCCGACAACG TTGTTATCTTGTATGACAAT TCATAAAAAAAAAAAAAAAA AAAAAAAAAAA (SEQ ID NO: 1354) | WVTSPRRPRYVGPQKKKASD GNDGRAAARAEPTNPGGPDR ADDDEGDVKFWCEFPGCDRF FMTRSGRGLHHKKGHPDWND QRNLAGKQHRKEIWSEEERL LLAKKEAELAISGARFINVE LRDFTARSLDAIKGQRKRPD YKILVEKFVRELRVGIRQG VASRSQQARAMAVAGAPAAT SSGAPPVATQPPPSGRVLRS QVVEAPAMEIPVAESEGDSS GDELFEDVEPVRLSDLPPDR FTIYFPAGLEIPGTEDIYAHR LHTICLMTTWRTKEEVRLEL GLFLKDLFPSKGSQERPERT NLPDPRNRIERRRGEYKKCQ |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | DLWRRNKSTCVQRILKEDLS QGECLPRELMEPFWNATFTQ NPGTAPVLPPPTEVYSSVWE PIRPENIKGNYPPQNTAAGI DGLTVGDLKGVSREMLARIF NLFMWCGKLPEHLCASRTIL LPKKPGAKVPGEFRPITVTS VLIRTFHKVLAERLKVVPLD PRQRGFRESDGCAENVMLLD MTIRYHHERRRKMFLALLDM AKAFDSVSFESMREVLTTKG IPTPFIEYFMTHLEDSFTVL QHGNWQSGKIHPTCGVKQGD PLSPPIFNFIMDEMLKRLPK EIGVNLDGLFVNAMAFADDL SLVANTEQGLQILIDEATSF LGLCGLRANPNKCVTLAIKT IPKEKKTAIDPSSHFRIGNA VIPSLKRTDEWVYLGIKFNS NGRLISDAKPKLIKDLELLT KAPLKPQQRLWALKVIVIPG ILYRGTLGSSTAGYLRSLDC VIRAYVRRWLRLPGDCPNGY FHAAVADGGLGVHPIRYKAM VDRLARLRKLEKSAYITGPE AARYLQRQVSIAENRLRDGA NRIMSDASMLREFLRELLYK SFDGRPLENSSKVPGQHRWV EEPTRFLSGADYMNCIRARI AALPTAARCARGRLKDKHCR AGCGNVETLNHVLQFCHRTH GTRIGRHDAVVKYVVGGLKK RGYAVKEEPKIVLQDVVYKP DMVATKEGKTLILDAQVLGD QRDMRLAHEDKLRKYGAPEF KRKIRSETGSATIKSLSVTL SWRGLWGPDSVKGLLEEGVI LKKDLKILSTRVLIGALAGW RRFNERTSMATSGRREEVTT RMVRRWKRRERVGVG (SEQ ID NO: 1476) |
| R2 | R2La | JN937 617 | Lepidurus arcticus | GGGGTAGCAATTGATCGATT CCCGCTTCCTCGTGGCGCTA CCCTGGGTAATACTATGAGG AATTGATCACACCGTAGCGA ACGTCATCAGTCACAGCTGC ACGAATCCAGATAGAAATAT AACAGACGAGTAATTCTTTT AAAAGCTCGTCAGTAATCTT CCCAG (SEQ ID NO: 1232) | TGATAATCGCTCCATCCTGC AACTAATTATGAATGCAAAT CTGTTAAGTGACATTAGTGA TACTTACCTGATACTTACCC TGGTATTTATTTGACCTATA CTTACCCTGGTATCTACCTG ACATATATTTATCTAACCAC CTACCTATGATGACTCCGC GGAAACTCTCACTTACCTTA TTACCCACTTGGTCTTTTAT TTTCTCGTTCCTTATTACTT TGTTCCTTTGGTGTAGGGTT CTCTGGTTTTTGGAACGGCT TCCTTAGCCGGAATTTTGTC TGATGTATCTTGCTTGTGTC CTTGAAATATACGACCCAGG CTTGCGTCATTTAGGCTCTG GGAAA (SEQ ID NO: 1355) | MSGKSSKPRTVSSGSSSQET PPSGSNACDICGKCFMKPVG LSRVHPSQYHARLEKNQPKA KKFRWTDEDLYFLAKKEAEL LHLGSIKFVNKELAEFFPEK SVDQIRGQRRSETYKQQVLS IHSELLKLQTVADSPPPSRI PAKEVSAWLDFFLALPKTKN KFSEDKLDQLIRTAQDGTLI LDDDLDLYLREVLVQPTSQGE KQAKLLPPPKSSREKRDREY ARAQNLYRKNKTACVNAILD GNKKCENKIPDIDDFWKTIF ESHSPPDAEPVCYVVDEEPT NIWSWISFFEMNHNYPDSST SPGPDGVTARMLRSIPARVL NKLLNLLLFIEDLPAVFKCH RTVLIPKIDNPTSPGEFRPI TISSIVVRQLNKIIAARVSE GVPINPRQKAFRQIDGCAEN VFLLDFILRDAKTKIKSLSL ATVDIKKAFDSVSHHSIFRA IRGARCPENLVNYIQNSYSG CTTQISVGGSISASKIPMNR GVKQGDPLSPVLFNLVINEI IRKLPASIGYPINSELSINC IAYADDLILVTNTREGLKLL LGLLNEELPKRGLELNASKC FGLSLTALGKLKKTHLCTSD QLDLHGTLIKNLTAEESWVY LGVPFSHIGRSKSFSPDLEA LLNKLQKSPLKLQQKLFALR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VYLIPRLLHGLVLSRVAIGE LKIMDKLILKHLRVWLRLPK DTPLGFFYSPVKLGGLGIKN LRTNVLKCRKQRIERMLVSP DDVVRLVAESEIFLKETDKL KDLLTINGMCLDXRNVPRTG KNNKFWSERLYTSFDGKTLA YSEYFTQGGGWIREDKILQP AHVFAECIKLRINALPTKSR VAHGRPTKDRSCRAGCLDVQ KVPTIETINHIAQVCPRTHG ARIKRHDRLVQFLSLNLRKN PKRNVLVEYNFRTVAGIRKP DIIVIEDTRAVILDVQVVGD SSNLEMEYLEKSRKYSNDAN FINALQKLYPTVTNLTFHAV TFNNRGLIAKSTVAALRMLG VPPRCIMILCVISLEKTLEV WRMFNQSTASARK (SEQ ID NO: 1477) |
| R2 | R2LcA | . | Lepidurus couesii | TTTGGGGTAGCAATTGATCG ATTCCCGCCTCCTCGTGGCG CTACCCCGGGATAGCCTCAA AGAAATTTGACGGTAAAGCA AAGAGGAATTGATCACCCAA GGCAGTACATCGGCCTTCCT GCAGGAGCTCTGATAAAGAT ATTAGTGAGTTATTCTGTTG AAGCTCGCTATTTCATTCCC CTG (SEQ ID NO: 1233) | TAGTGCTTGAGTGATGCCTA TCCTTTCTTTGATTAACTCT TACCATATACTTACCAGTTC TTACCCGTACTTACCCTGTA TACTTACCTGTGTGCGTACC TGTGTACTTGTCCTTTAGCC GCCTTGTGTTTTTACCATTG GTACTTACCTTGTGTGGTTG CCCGATACTTACCTTGTATT TGCCTTGTAATTCTGCATGA TATTTATTGTGTAGGTTCCT GATGCTTACCTGATTTGTCC CCCTCATCATCTTTAGTTTC GTTCTATTTCACTCCATTAT GGAGTTCCGTTTGTTTTTTG GTGGAGGTACAGCACCCTTT AAGCTGGAATTGAGTGAGTT TATGTACTTTGGATGGTTGT AATAAACTACCCGGAGGCAT (SEQ ID NO: 1356) | MSEESRPKQTASKRGAAVEK TMMSGTYVCTLCGRSFEKSV GLSLHTNRMHPEAYNKLKEA KKPVLKKARWSEEEVFLLAQ KEAELSFIGGIKFMNIELHK IFPERELEGIKGQRKNPTYK AQVVSLLAEIRESKANDSSS SSSSSSSCDSASLGISNWLE FLLALPKTSNQFQEGRLDRL ISDALRGVDVLENLDAYLLE VFAKPMAQNPCPKPPPPAKN SRERRDREYSRVQNFYKKNR SACINSILDGNTRSQNVIPG LTKFWTETFEKNSPPDDEAP DQFVADEPRDMYKWITFYEM SQDYLDSSTAPGVDGFSAKQ LRSMSPRVLNKILNLLLLSE NLPNSFKMHKTVLIPKIDDP KSPGDFRPITISPVLARLLN KILAARLSKLVPISQRQKAF LPVDGCGENIFLLDYILRSS KKSSKSVAMAVLDVKKAFDS VSHHSILRALNEAKCPINFI NFVRNSYDGCTTKLTCGGTS FPDSVRMNRGVKQGDPLSPV LFNLIIDSAIRKLPDSIGYV IRDGLKINCLAYADDLILVA SSRAGLKTLLNIVAEHLSLR GLDLNAAKCHGLSIIASGKA KTTYVSAADSLDLDGQPIKN LGVLDTWTYLGIPFSHLGRA EKVSPDLTNLLNKLQKAPLK LQQKLYAVRNFVIPRALHGL ILSKTNLKELNTLDRAIRVF LRTLLYLPKDTPLGFFHSPI KSGGLGITCFRTSVLKCRLQ RIARMRSSCDGVIQAVAESD IFADEYAKLRDLIRINGNVL DTTESIKRYWAQRLHSSVDG KTLAYMDYFPQGNLWMSEDK VSQRSYVFADCVKLRINAIP TRVRVSRGRPNKEMCCRAKC FDSQRMPAFESLNHITQVCP RTHGSRIQRHDKIAKFLFKN LNNCPSRSVLYEPHFVTVDG LRKPDIIIYDDSHMVVLDVQ VVSDSANLEKEFECKAKKYA NDVALRSAMLIKYPFIKSFS FVAATYNNRGLIAKSSVQVL RQLGLSPRSIMVSILICLEG TLETWRIFNQSTMNAH (SEQ ID NO: 1478) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| R2 | R2LcB | JN937619 | Lepidurus couesii | TTTTGGGGTAGCAATTGATC GATTCCCGCCTCCTCGTGGC GCTACCCTGGGATAACCTCA AAGAAATTTGACGGTAAAGC TAAGAGGAATTGATCACACC GTGACGAATATCATCAGTCA CAGCTGCACGAATCCAGATA GATATATAACAGGCGAGTAA TTCTTTTCGAAGCTCGTCAG TAATCTTCCCAG (SEQ ID NO: 1234) | TGATAATCGCTCCATCCTGC AACTAATTATGAATGCAAAT CTGTTAAGTGACATTAGTGA TACTTACCTGATACTTACCC TGGTATTTATTTGACCTATA CTTACCCTGGTATCTACCTG ACATATATTTATCTAACCAC CTACCTATGATGACTCCCGC GGAAACTCTCACTTACCTTA TTACCCACTTGGTCTTTTAT TTTCTCGTTCCTTATTACTT TGTTCCTTTGGTGTAGGGTT CTCTGGTTTTTGGAACGGCT TCCTTAGCCGGAATTTTGTC TGATGTATCTTGCTTGTGTC CTTGAAATATACGACCCAGG CTTGCGTCATTTAGGCTCTG GGAAA (SEQ ID NO: 1357) | MSGKSSKPRTVSSGSSSQET PPSGSNACDICGKCFMKPVG LSLHMSKVHPTQYHARLEKN QPKAKKFRWTDEDLYFLAKK EAELLLLGGIKFMNKELAEF FPEKSVDQIKGQRRSETYKQ QVVSIHSELLKLQAVADSPP PSRIPAKEVSAWLDFLLALP KTKNKFSEDKLDQLIRTAQE GTPVLNDLDLYLREVLVQPT RQGERQAKPLPPPKSSREKR DREYARVQNFYRKNKTACVN AILDGNKKCENKIPDIDEFW KAIFESQSPPDAEPVSYVVD EEPKNIWSWISFFEMNRNYP DTSTSPGPDGVTARMLRSIP ARVLNKLLNLLLFIEDLPAV FKCHRTVLIPKVDNPALPGE FRPITISSIIVRQLNKIIAA RVSEGVPINPRQKAFRQIDG CAENVFLLDPILRDAKTKIK SLSLATVDIKKAFDSVSHHS IFRAIRGARCPENLVNYIQN SYSGCTTQISVGGSISTTKI LMNRGVKQGDPLSPVLFNLV INEIIRKLPASIGYPINSEL SINCIAYADDLILVANTREG LKLLLNLLNEELPKRGLELN ASKCFGLSLTALGKLKKTHL CTSDQLDLHGTLIKNLTAEE SWVYLGVPFSHIGRSKSFSP DLEALLNKLQKSPLKLQQKL FALRVYLIPRLLHGLVLSRV AIGELKIMDKLILKHLRVWL RLPKDTPLGFFYSPVKLGGL GIKNLRTNVLKCRKQRIERM LVSPDDVVRLVAESEIFLKE TDKLKDLLTINGMCLDXRNV PRTGKNNKFWSERLYTSFDG KTLAYSEYFTQGGGWIREDK ILQPAHVFAECIKLRINALP TKSRVAHGRPTKDRSCRAGC LDVQKVPAIETINHIAQVCP RTHGARIKRHDRLVQFLSLN LRKNPKRNVLVEYNFRTVAG IRKPDIIVIEDTRAAILDVQ VVGDSSNLEMEYLEKSRKYS NDATLSMRINALQKLYPTVT SLTFHAVTFNNRGLIAKSTV AALRMLGVPPRCIMILCVIS LEKTLEVWRMFNQSTASARK (SEQ ID NO: 1479) |
| R2 | R2Nvec-A | . | Nematostella vectensis | GGTTGGGGCCTTCTCGTGGC GGAGTCGTGAGTAAGGGGTA TAGGGGTAAGGGACACCACG GACCGAGAACGGTTACCGCT CAAGGCGAGTGGTGGAAGGC ATAAAATCGTAACGCCGCCC TCCGACCTGCTCCTGAAACT AATGCCAACCAACTGACTGT GGGGCTAACCTCCCCAGAGT CAGG (SEQ ID NO: 1235) | TGATGGTGGGTTACTCGCCT CTGTGTAACAGGCAAATGAA AGCTGCGCAAGCAGTCAGTG AGCCAAAGCCGCACAGCCCC CGACTGGGGTACAGGGCAGC CCTGGGCTATGCCCGAAGTC TTTTGACAGGTCCAAACTTC ACCCTTGCCGCCAGTAGGGC ACCAGGGCCAGGTGCAGGTG GGCGCTTTGTTCTATTTGGT TTCGCTTAATTTTTGTTAAA TTTTTCCCGTGCGCCCACCC TTTTTAACCCTTTTAACACC AATTTTTTTTACAACCCTCT ACTCAATAATCCAAATGAAT AAAAGCGGCATAACAGGTGA ACAC (SEQ ID NO: 1358) | MLRGTGNMNDKRDGSATADP TSALLGAVGDGSLVCNLCGL ACKSRGGLSIHRRSKHATVY HAERQPAPRAKARWTNDEMI LVARKQIASEKSRCSAVVEG MREAVPHRTFDAVKSLKTKN RNYTRILEQIRAECSEEEVI ESGVLKDRTENVCVQTTSNV PGSAGRAASVELEGNIQVGH QLAQKTMAGNNSRKQPANHT NWAEFNIEEGNITLRKSKRK ANGMPDATHRPGPPTVDSLK HPVCLLQGAADKRDEPHTVE QLYYNIEEGMPLAEEQQWSE KLFDAIDSSLLSVEVELGRI VPGCPDEETRQLIDREFLDF IHSYSREKPPQRGLAKSKPP PKGPKSLRRQQYRQLQRLWD KNRSAAAEQALTGKWQEVRT AAGVPLSLMEVPWREIFETP STTDVREPAPAGPVLWQLLR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | PVTIAEVEDAISSKKSASGP DGVPCAALQTMGAASLAAHF NLWLLAGTQPKRLTECRTIF VPKEVNTHLPLHHRPITIGS VVVRLFHQILGKPMEAVLPL GSGQRGFRKGDGICQNIWLL HTLIRRSTDLLRPLKLVFLD VKKAFDSVSHESLLIAAKRL GVPGPLLTYINELYSRSETV FEVGGESSGSVKVSQGVKQG DPLSSTLFNCVIDWAVSDLD PHIGVLLGESRVSFLAYADD LVLLSETEAALTSQLNSIEK SLAHCGLKLSTGDSGKSASL NIVIDGKAKRWVVNPTPFLR ASGGEIRSLVANETYKYLGI NIGAQGVKAAEYNAFKEALD NLSRAPLKPQQRLFLLKTYL LPQLHHSLVLSRTTGKLLNS LDALVRKAVRGWLKLPHDTH RAFFYAHQADGGLNVPSLYH LIPLLRRSRYERLTRVEDPE IREVSRTDYFKRVLGAAAAA TTVAGHRIDSKVTLRLAWRE ALYASADGRGLSQCPLVPEV HSWVTDVSGLQTGSQYISAV RLRGALLPTAVRKSRGRGGV NSNCDCCGRGQPEFLGHVLQ TCPRTWGSRISRHNHVLSLI AKACRSRRWQVLEEPIIQTP AQLLKPDLVIWNHQAAYVVD VSVPGDNTPLSTCHNRKVAY YSGESVREWVRSKTGHNPTV SSVVINWRGAMAKESYRLLT KDLRLAKTLPRLLVLRVLEG GHGIWLNFHRSTFAVGVT (SEQ ID NO: 1480) |
| R2 | R2Sm-A | . | Schistosoma mansoni | ATGTTTTAATTTATTTTGA ACTACTACTGTCTGAGTGCT TCTTACAACCTGAAGGCTCA GAAACTACCCACTTTTTGCT GTTTATCCAACAACAGTT GTGAATCTATTCTCCAAATA TTCCTTGTGCTTTTGTCAAC ATTATTCTATACCAACTGTA CCACCTACTTCTTCATCTCA CGTTTTAATTCTGGTCTAAT TTTCTCATCATTAGTCACGG AGAGGGCCTATGAACGGTCC GTGACGCGAAATTCAATCCA CGAATTCGTCCTCTTCTGCT AGTGGTCCCCGAAATACGGT TCCTCTGGCCTGTCAGTTGT GTTAAAACTATATAATAACG (SEQ ID NO: 1236) | TTGCTTATCTTCATGTTTTT GTGTTAATTGACTGCTCTCT TCTGGGTTGATGTCTGATTG TCTCTCTCTCTTTCCATATT GCTTGCTCTCCCCGCTTACT TCCAATAGTTGTCATATTAT GTCTTTGTTTACTTGCCATG TCTAACGACAATTACTTTAT CTACCTTAGTTGGTCCTCTT GGTTTGGTTGCCTTCATGTG TTCATGGCGGAATCTGATGT TTATAATGACTATTCCTACT ACCACCATTACAACTATTAT TATTATCACTATTATTAACA TATTATTACTTCTACAATT AGTATTATGGCTACTCCTTT CAGCACACCAATAAAATCTC AATCAAACATCTCACTTATT AAACTCTCTATTTCCCCTTC GTTATAAACTTACAATTCAG TTTAACCGAATATCTCTCTT TTACAAATCTTAAGTATGTA ATTTTGTGCCAAGCCCATTT GGGTCTGTACAATTTGATAC TTAAAAATAAATGTTAT (SEQ ID NO: 1359) | MPVSTGAETDITSSLPIPAS SIVSPNYTLPDSSSTCLICF AIFPTHNILLSHATAIHHIS CPPTPVQDGSQQMSCVLCAA AFSSNRGLTQHIRHRHISEY NELIRQRIAVQPTSRIWSPF DDASLLSIANHEAHRFPTKN DLYQHISTVLTRRTAEAVKR RLLHLQWSRSPTAITTSSNN HTTTDIPNTEARYIFPVDLD EHPPLSDATTPDASTHPLPE LLVILTPLPSPTRLQNISES QTSHESNRNSMHTPPTYACD SDESLGVTPSSTIPSCFHSY RDPLAEQRSKLLRASASLLQ SSCTRIRSSSLLAFLQNAST LMDEEHVSTFLNSHGEFVFP RTWTPSRPKHPSHAPANVSR KKRRKIEYAHIQTLFPHHRPK DAANTVLDGRWRNPYVANHS MIPDFDCFWTTVFTKTNSPD SREITPIIPMTPSLIDPILP SDVTWALKEMHGTAGGIDRL TSYDLMRFGKNGLAGYLNML LALAYLPTNLSTARVTFVPK SSSPVSPEDFRPISVAPVAT RCLHKILAKRWMPLFPQERL QFAFLNRDGCFEAVNLLHSV IRHVHTRHAGASFALLDISR AFDTVSHDSIIRAAKRYGAP ELLCRYLNNYYRRSTSCVNR TELHPTCGVKQGDPLSPLLF IMVLDELLEGLDPMTHLTVD GESLNYIAYADDLVVFAPNA ELLQRKLDRISLLLHEAGWS INPEKSRTLDLISGGHSKIT |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | ALSQTEFTIAGMRIPPLSAA DTFDYLGIKSNFKGRCPVAH IDLLNNYLTEISCAPLKPQQ RMKILKDNLLPRLLYPLTLG IVHLKTLKSMDRNIHTAIRK WLRLPSDTPLAYFHSPVAAG GLGILHLSSSVPFHRRKRLE TLLSSPNRLLHKLPTSPTLA SYSHLSQLPVRIGHETVTSR EEASNSWVRRLHSSCDGKGL LLAPLSTESHAWLRYPQSIF PSVYINAVKLRGGLLSTKVR RSRGGRVTNGLNCRGGCAHH ETIHHILQHCALTHDIRCKR HNELCNLVAKKLRRQKIHFL QEPCIPLEKTYCKPDFIIIR DSIAYVLDVTVSDDGNTHAS RLLKISKYGNERTVASIKRF LTSSGYIITSVRQTPVLTFR GILERASSQSLRRLCFSSRD LGDLCLSAIQGSIKIYNTYM RGTQRLNE (SEQ ID NO: 1481) |
| R2 | R2Tc | EU854 578 | Triops cancriformis | TTTTTGGTCTGGCATTTGAT CGTTTCCGCCTCCTCGTGGC GCCAGACTGGGTAAGCTGAT TTATCAGTGAGCTAAGAGAA ACGATCACCGCAGGAGTCCA TCTACCTGCGCTGCACGTGA TTTCATTGTGCACTTGGCGA GTTATCCCTTGTGGAGCTCG CTCGTTAGCTTTTGAG (SEQ ID NO: 1237) | TAGATGACTGCCCTACCCCT TTGCTGCCGAAGAACTACTG AAGACTATTGAACTAACCAA CTGTGTTAAGTAAGAACTAA TGCCTCTTTTTCCCTGCATG TATCCCCTGATCAGTGACTT ATTTTCTTTTCCTGTTGCGC CCTTTGTTTAGTTATTTCCT TTAATTACTAGAATTATCTT TTCGTTCTCCGTCTAATTGC TTT TTCGGTGTAGGAACGGCTAC CTAAAGCTGGAAGTGGGAAG TGTTTTCAATGTACTTTGTG ATTATAGAAATATATGACCC GAGGTGCATTGTTTGGCATT TCCTCGAGAAA (SEQ ID NO: 1360) | MSQKRRPEKAVPDEGATAHD VAQPDKSKCSVCGETFKGPA SVTMHMVKKHPVEFNELKMA KKPVPKKVRWSEEEIFQLAR TEAELTLQGVRFINVELQKI FPAREIEGIKGQRKLAKYKE LVKDQLDEIGRAPNPPEQEI GEDVPSPFKAWLELLLALPK TPNDFLEHKLDNIIVQALKE DVNSDQVFNDLNSYLKLILE PSGRAKSVPGEIIHGDPSGS AKTSVTKAPKPATVSSSRKK RRDAEFARIQRLYRKNRTSC INTILDGNTREHEAPKNMEG FWREIFERESPDDPDDPDIF LEEEASDIWKYISFYEMCNL YPPPSTAPGPDGFSSKDLRR MTPRVLNKILNLLLHLRDLP QILKSHRTVLIPKTDLPTKP GDFRPITISNILVRHLNKIL ANRVSHLIPINERQKAFLPI DGCAENIFTLDFILHHARTK IKSLSMAILDISKAFDSVSH HSIFRALREARCPIGFIKFI ENCYGGCFTKLFCGGVKYPS EVSMNRGVKQGDPLSPVLFN LVIDGLIRQIPSALGFNVSD QVKVSCIAYADDLILIATTR AGLKTLLDLTNSYLAKRGLS LNPDKCSALSIVASGKQKLV YIASSEHFDLAGQKMRNLNV GDSWRYLGIQFSHLGRAEKV TPDLTCLINRLQKAPLKLQQ KLYALRIYLIPRLIHGLTLS KTNLGELKTLDKLIRKYIRA WLHLPDDTPMGYFYTPLKAG GLGLPSLRLVILNNRLERIL RMKASQDIIVRTIAESETLG VEIRKLHDLLSIDGTILDTS VKIHSFWAERLYSSYDGKCL CNSANFPPGNKWIGEDSLNQ RSHIFADCLKLRINALPTRS RTARGRPLKDKPCRAGCRNS DGVKVIETLNHITQVCERTH GARVKRHDRLVDFAVKGLQR PHRVVLKEPHYKTVNGVRKP DIVIKIPDHTYICDPQVVSD TSCLELEFRKKALKYAEDKG LCDQLTRDHPGELSFTAITF NTRGLIAKSSVTALRKLGMP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | PRSIMTLQKICMEGSLEIWR IFNQTTAMARN (SEQ ID NO: 1482) |
| R2 | R2_DAn | . | Drosophila ananassae | AGAATATGGATTTGATTGTG CAGAGGGGTGCTATACCGT AACTCGTAAGCCATGCAATC AGATCAAGTCGACTCAAAAC CTCCTCGTGGTATTCTCTGG GTGCCAGTATTTACTGGTAG CTGA (SEQ ID NO: 1238) | TAGCCAATGCACGGGTTCCA GATTAAGCTTGCTGCCGAAG CATACCATCAAAATCGGCAT AAAATTCGCTTAATAAAGGA GGTGGTTTTAGTACGTAGGC GTCCCGGGACTTGTCTCGGG ATGAATCGTGCATGCGTATA ATTGGGATCGATAACAAATA CCAACTAAGTTATTACTAAT ATATCGAAATACATAAATAT CCCGTCCTTACGTATCTTTG AAGATTTCCATCCTCAGCGA ACAAAAAAAAAAAAA (SEQ ID NO: 1361) | FERRKDPWGYRPPGTLKQIG ATENNEPRNLNRFVRGESTA SSLESTQFGTSAEVNLAGRV PCTICEMTFSSKRGLGVHMS HRHKDDLDAQRLRVDKKARW SEEETLMMARKEVELAASGV RFLNKKLAEIFTHRSADAIS SYRKRSEYKAKLEQIRGQSV PTPEAEEINTTQRRPSNSEQ NRRVPRSEGGPIAPTEQTNN EILRVLQGLAPVVCLPRWRA EVLQNIVDNAQVSGQETTLQ SLSSYLMEIFPPRNEPHILT RPRTEPRNMRQRRRQQYARV QRNWDKHPGRCIKSLLEEDD ESVMPNQEVMEPYWRRVMTQ PSSSSIKRDMFNMEHSLERV WSAVNQRDLRATKVKLSSSP GPDGITPKTARSVPEGIMLR IMNLILWCGNLPYSIRLART IFIPKKATANQPQDYRPISV PSVIVRQLNAILASRLSAAI NWDTRQRGFLPTDGCADNTT IVDLVLREHHKRFKSCYIGT LDVSKAFDAVAHEAVYNTLA SYGAPKGFINYLRKAYEGGG TMLAGNGWVSEAFIPARGVK QGDPLSPILFNLVIDRLLRS LPSEIGAKVGNAMTNAAAFA DDIVLFAETPMGLQKLLDTT VCFLSSVGLTLNTDKCFTVS IKGQAKQKCTVVERRSFLIG GRECPSLKRTDEWKYLGIKF TAEGRARYDPAEDLGPKLLR LTRAPLKPQQKLFALRTVLI PQLYHKLTLGSVTIGVLKKF DKLVRYTARKWLGLPVDVPV SFFHAPHKSGGLGLPSLRWT APMLRLKRLSNIKWPHLERS EVASSFVEEEMRRARDRLQA GSEELLTRSQVDSYLANRLH MSVDGCGLREAERFAPQHGW VSQPTRLLTGKEYTDGIKLR INALPSRSRTTRGRHELERR CRAGCDAPETTNHILQQCYR THGRRIARHNGVVNFLKRGL ERRGCVVHVEPSLQGETGLN KPDLVAIRQNRIYVIDTQIV TDGHSLDQAHQRKVGKYDTP DIRTNLRRSFGAFDIEFHSA TVNWRGIWSGQSVKRLIASD LLSSGDSNIISVRVISGGLW SWRQFMYLSGYTRDWT (SEQ ID NO: 1483) |
| R2 | R2_DM | X51967 | Drosophila melanogaster | TTGGGGATCATGGGGTATTT GAGAGCAGAGGGGAGTATT CTTCTGTAATTCGTAAGTCA TATCATATGATGTGCGAAG GGGAATTTTACTCTGTAACT CACAAGTCTCTCCTTTACTC AAGTCGACTCAAAACCTCCT CGTGGTGGTCCCGGTAATGC TAAACTCGTTTAGCAGCTAA | TAGCTAAATCGTTTGGTTCA AAACATTTGCTTGCTGTCTT GGCATAACATCAATAAAGGC ATAAACATCGCAAAATAATG GTTATAATTAAATGGCTATG AGGATGGTTTAGTACGTAG GCGTTGCGGAACTTCGGTTC ATATAGAGCAATGAATCGTG CATGCTAGGAAAACTGACCA | MTTRPSVDIFPEDQYEPNAA ATLSRVPCTVCGRSFNSKRG LGVHMRSHPDELDEERRRV DIKARWSDEEKWMMARKEVE LTANGCKHINKQLAVYFANR SVEAIKKLRQRGDYKEKIEQ IRGQSALAPEVANLTIRRRP SRSEQDHQVTTSETTPITPF EQSNREILRTLRGYSPVECH |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TTTGAGCGGAAAAACTTTTC CGATGGGCTGGTTCCCCAGA GGAAATTTATTCATATTGGA ACTACAAGCACAAATAACGA GCCTCGGATACCTTTACACA ATCTG (SEQ ID NO: 1239) | CACACAGTGTTGGCAGACCT AGTATCTTTCGAAGATTTCC ATACCTCCGCGATCAAAAAA AAAAAAAAAAAAAAAA (SEQ ID NO: 1362) | SKWRAQELQTIIDRAHLEGK ETTLQCLSLYLLGIFPAQGV RHTLTRPPRRPRNRRESRRQ QYAVVQRNWDKHKGRCIKSL LNGTDESVMPSQEIMVPYWR EVMTQPSPSSCSGEVIQMDH SLERVWSAITEQDLRASRVS LSSSPGPDGITPKSAREVPS GIMLRIMNLILWCGNLPHSI RLARTVFIPKTVTAKRPQDF RPISVPSVLVRQLNAILATR LNSSINWDPRQRGFLPTDGC ADNATIVDLVLRHSKHFRS CYIANLDVSKAFDSLSHASI YDTLRAYGAPKGFVDYVQNT YEGGGTSLNGDGWSSEEFVP ARGVKQGDPLSPILFNLVMD RLLRTLPSEIGAKVGNAITN AAAFADDLVLFAETRMGLQV LLDKTLDFLSIVGLKLNADK CFTVGIKGQPKQKCTVLEAQ SFYVGSSEIPSLKRTDEWKY LGINFTATGRVRCNPAEDIG PKLQRLTKAPLKPQQRLFAL RTVLIPQLYHKLALGSVAIG VLRKTDKLIRYYVRRWLNLP LDVPIAFVHAPPKSGGLGIP SLRWVAPMLRLRRLSNIKWP HLTQNEVASSFLEAEKQRAR DRLLAEQNELLSRPAIEKYW ANKLYLSVDGSGLREGGHYG PQHGWVSQPTRLLTGKEYMD GIRLRINALPTKSRTTRGRH ELERQCRAGCDAPETTNHIM QKCYRSHGRRVARHNCVVNR IKRGLEERGCVVIVEPSLQC ESGLNKPDLVALRQNHIDVI DTQIVTDGHSMDDAHQRKIN RYDRPDIRTELRRRFEAAGD IEFHSATLNWRGIWSGQSVK RLIAKGLLSKYDSHIISVQV MRGSLGCFKQFMYLSGFSRD WT (SEQ ID NO: 1484) |
| R2 | R2_DPe | | Drosophila persimilis | AAGATATGGATCTGAATAAT AGCGTAGAAGGGGAGTCATT CCGTAATTCGTAAATCGTAA AAATCAGATCAAGTTGATTC AAGACCTCCTCGTGGTATCT TCTGGATGCTATTAGACTGA (SEQ ID NO: 1240) | TAGCCTATACACTATGTTGG AGAGAAGACGCTTGCTACCT AGGCAAAATGTGAAATTAGG TATAAACATCGTGGTTGTAA AACTTGAGGTGGGTTTTTAG TACGTATGCGTGATTACTTC GTAATCATGAATCGTGCATG CTAGTGGGGTTTGGCCTCCA CTAGTATCTTTGAAGATTTT CCTTCCTCAGCGATCAAAAA AAA (SEQ ID NO: 1363) | SSFGLIVTNLNSETVLWGCQ PLGQFSLIGTNMQNTTPRII NTNSLTNQIPTVSSLGAQSE HSAQVNPNSGYQCTICESSF RSKSGLGVHMSRRHKDEFDQ LRLRTDRKAQWSEEELSMMA RKEIEBLAANGERYLNKKLAE VFTNRSVDAIKKCRORERYK TKIEQLKGQAVPLPEALESE TIQRRPSIRERDLLVTPPNT LGTTPTELSNSEILAVLQGY PPVVCNDQWRVEVLQSIVDG AQASGKEITLQRLSTYLMEV FPSQNDRPIQTRPPRRPRNR RQGRRQQYALTQRNWDKHKG RCIKAILDGTEGTATMPSQG IMGSYWRQVMTQTSPTYSGT NTTFRTEHPLEGVWSPITLG DLRVHRVSLTKSPGPDGITP RTVRSIPSGVMLRIMNLILW CGKLPVSIRQARTIFIPKVG NASRPQDFRPITVQSVMVRI LNAILASRLTSSVDWDPRQR GFLPTDGCADNTTIVDLILR DHHKRCKSLYIATLDISKAF DSVSHAAVSATLTAYGAPKE FVDYVQNSYEVCGTTLNGDG WRSEEFIPARGVRQGDPLSP IIFNLIIDQLLRSYPNEIGA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | TIGDHTTNAAAFADDIVLFA ETRLGLQTMLDTTVDFLSSV GLTLNSDKCFTVGIKGQPKQ KCTVVIPETFRIGSRSCPAL KRTDEWKYLGITFTAQGRTR YSPADDLGPKLLRLTRSPLK PQQKLFALRTVLIPQLYHKL TLGSVMIGVLRKCDILVRST VRKWLGLPLDVSTAFFHAPH TYGGLGIPSVRWVAPMLRMK RLSNIKWAHLAQSEAASSFL TDELNKARGRTLAGLNELTS RTEIETYWANRLYMSVDGRG LREAGLFRPQHGWVCQPTRL LTGQDYRNSIKLRINALPSR SRTTRGRNELERQCRAGCDA PETTNH ILQNCYRTHGRRVARHNCVV NNLKRILEEKGHTVHVEPSL QLETSVSKPDLVCIRDNHAC VIDAQIITDGLFLDDVHHRK VEKYKRPEVISALRREFGVS GNVEVLSATLNWRGIWSNQS VRRLIAKGLISSGDSNVISA RVVTGGLYCFRQFMYLAGYT RDWT (SEQ ID NO: 1485) |
| R2 | R2_DP s | . | Drosophila pseudoobscura | CAATTGGAAAGATATGGGTC TGAATAATAGCGTAGAAGGG GAGTCATTCCGTAATTCGTA AATCGTAAAAATCAGATCAA GTTGATTCAAGACCTCCTCG TGGTATCTTCTGGATGCTAT TAGACTGA (SEQ ID NO: 1241) | TAGCCTATACACTATGTTGG AGAGAAGACGCTTGCTACCT AGGCATAATGTGAAATTAGG TATAAACATCGTGGTTGTAA AACTTGAGGTGGGTTTTTAG TACGTATGCGTGATTACTTC GTAATCATGAATCGTGCATG CTAGTGGGGTTTGGCCTCCA CTAGTATCTTTGAAGATTTT CCTTCCTCAGCGATCAAAAA AAAAAAAAAAAAAAAAAA (SEQ ID NO: 1364) | SSFGLIVTNLNSETVLWGCQ PLGQFSLIGTNMQNTTPRII NTNSLTNQIPTVSSLGAQSE HSAQVNPNSGYQCTICESSF RSKSGLGVHMSRRHKDEFDQ LRLRTDRKAQWSEEELSMMA RKEIELAANGERYLNKKLAE VFTNRSVDAIKKCRORERYK TKIEQLKGQAVPLPEALESE TIQRRPSIRERDLLVTPPNT LGTTPTELSNREILAVLQGY PPVVCNDQWRVEVLQSIVDG AQASGKEITLQRLSTYLMEV FPSQNDRPIQTRPPRRPRNR RQGRRQQYALTQRNWDKHKG RCIKAILDGTEGTATMPSQG IMGSYWRQVMTQTSPTYSGT NTTFRTEHPLEGVWSPITLG DLRVHRVSLTKSPGPDGITP RTVRSIPSGVMLRIMNLILW CGKLPVSIRQARTIFIPKVG NASRPQDFRPITVQSVMVRI LNAILASRLTSSVDWDPRQR GFLPTDGCADNTTIVDLILR DHHKRCKSLYIATLDISKAF DSVSHAAVSATLTAYGAPKE FVDYVQNSYEVCGTTLNGDG WRSEEFIPARGVRQGDPLSP IIFNLIIDQLLRSYPNEIGA TIGDHTTNAAAFADDIVLFA ETRLGLQTMLDTTVDFLSSV GLTLNSDKCFTVGIKGQPKQ KCTVVIPETFRIGSRSCPAL KRTDEWKYLGITFTAQGRTR YSPADDLGPKLLRLTRSPLK PQQKLFALRTVLIPQLYHKL TLGSVMIGVLRKCDILVRST VRKWLGLPLDVSTAFFHAPH IYGGLGIPSVRWVAPMLRMK RLSNIKWAHLAQSEAASSFL TDELNKARGRTLAGLNELTS RSEIETYWANRLYMSVDGRG LREAGLFRPQHGWVCQPTRL LTGQDYRNGIKLRINALPSR SRTTRGRNELERQCRAGCDA PETTNHILQNCYRTHGRRVA |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | RHNCVVNNLKRILEEKGHTV HVEPSLQLETSVSKPDLVCI RDNHACVIDAQIITDGLFLD DVHHRKVEKYKRPEVISALR REFGVSGNVEVLSATLNWRG IWSNQSVRRLIAKGLISSGD SNVISARVVTGGLYCFRQFM YLAGYTRDWT (SEQ ID NO: 1486) |
| R2 | R2_DS e | . | Drosophila sechellia | GGGATCAGGGGTAATTGCGA GCAGAGGGGGAGTATTTTTC TGTAATTCGTAAGTCATATC ATATGGTGTGCGGAAGGGGA ATTTTACTCTGTAACTCACA AGTCTCTCCTTTACTCAAGT CGACTCAAAACCTCCTCGTG GTGGTCCCCGGTAATGCTAA ACTTGTTTAGCAGCTAA (SEQ ID NO: 1242) | TAGCTAAAACGTTTGGTTCA AAACATTTGCTTGCTGTCTT GGCATAACATCAATAAAGGC ATAAACATCGCAAATAATGG TAATATATAAATTGGCTATG AGGATGGTTTTAGTACGTAG GCGTTGCGGAACTTCGGTTC AGATAGAGCAATGAATCGTG CATGCTAGGAAACTGAAGTG TTGACAGACCTAGT ATCTTTCGATAGATTTCCAT ACCTCCGCGATCAAAAAAAA AAAAAAAAAAAAA (SEQ ID NO: 1365) | FERQNFSDGLVPQRKFIHIG TTNRNNEPRSNLRNLMTTRP SVDIFPEDQYEPNAAATLSR VPCTVCGRSFNSKRGLGVHM RSRHPDELDEERRRVDIKAR WSEEEKWMMARKEVELTANG HKHINKQLAVYFANRSVEAI KKLRQRGDYKEKIEQIRRQS ALVPEVANLTIRRRPSRSEQ NHQVTTSETTPITPFEQSNR EILRTLRGYSPVECHSKWRA QELQTIIDRAELEGKETTLQ CLSLYLLGIFPAQGVRHTLT RPPRRPRNRRESRRQQYAVV QRNWDKHKGRCIKSLLNGTD ESVMPSQEVMVPYWREVMTQ PSPSSCSREVIQMDHSLERV WSAITEHDLRASRISLSSSP GPDGITPKTAREVPSGIMLR IMNLILWCGNLPHSIRLART VFIPKTVTAKRPQDFRPISV PSVLVRQLNAILATRLNSSI NWDPRQRGFLPTDGCADNAT IVDLVLRHSHKHFRSCYIAN LDVSKAFDSLSHASIYDTLR AYGAPKGFVDYVQNTYEGGG TSL NGDGWSSEEFVPARGVKQGD PLSPILFNLVMDRLLRNLPS EIGARVGNAITNAAAFADDL VLFAETRMGLQVLLDRTLDF LSLVGLKLNADKCFTVGIKG QPKQKCTVLEAQSFYVGSRE IPSLKRTDEWKYLGINFTAT GRVRCNPAEDIGPKLQRLTK APLKPQQRMFALRTVLIPQL YHKLALGSVAIGILRKTDKL IRYYVRRWLNLPLDIPIAFI HAPPKSGGLGIPSLRWVAPM LRLRRLSNIKWPHLTQNEVA SSFLEAEKQRARDRLLAEQN ELLSRPAIEKYWANKLYLSV DGSGLREAGHWGPQHGWVNQ PTRLLTGKEYIDGIRLRINA LPTKSRTTRGRHELERQCRA GCDAPETTNHIMQKCYRSHG RRIARHNCVVNRIKRGLEER GCVVIVEPSLQCESGLNKPD LVALRQNHIDVIDIQIVTDG HSMDDAHQRKINRYDRPDIR TELRRRFEAAGDIEFHSATL NWRGIWSGQSVKRLIAKGLL SKYDSHIISVQVMRGSLGCF KQFMYLSGFSRDWT (SEQ ID NO: 1487) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| R2 | R2_DSi | . | Drosophila simulans | GGGATCTGGGGTAATTGCGA GCAGAGGGGAGTATTTTTC TGTAATTCGTAAGTCATATC ATATGGTGTGCGGAAGGGGA ATTTTACTCTGTAACTCACA AGTCTCTCCTTTACTCAAGT CGACTCAAAACCTCCTCGTG GTGGTCCCCGGTAATGCTAA (SEQ ID NO: 1243) | TAGCTAAAACGTTTGGTTCA AAACATTTGCTTGCTGTCTT GGCATAACATCAATAAAGGC ATAAACATCGCAAAATAATG GTTATATATAAATGGCTATG AGGATGGTTTTAGTACGTAG GCGTTGCGGAACTTCGGTTC AGATAGAGCAATGAATCGTG CATGCTAGGAAAACTGACCA CACGCAGTGTTGGCAGCCCT AGTATCTTTCGATAGATTTC CATACCTCCGCGATCAAAAA AAAAAAAAAAAAAAAAA (SEQ ID NO: 1366) | TCLAANLSGKNFSDGLVTQR KFTHIGTTNTNNEPRISLHN LMTTRPSVDIFPEDQYEPNA AATLSRVPCTVCGRSFNSKR GLGVHMRSRHPDELDEERRR VDIKARWSEEEKWMMARKEV ELTANGHKHMNKQLAVYFAN RSVEAIKKLRQRGDYKEKIE QIRGQSALVPEVANLTIRRR PSRSEQNHQVTTSETTPITP FEQSNREILRTLRGYSPVEC HSKWRAQELQTIIDRAELEG KETTLQCLSLYLLGIFPAQG VRHTLTRPPRRPRNRRESRR QQYAVVQRNWDKHKGRCIKS LLNGTDESVMPSQEVMVPYW REVMTQPSPSSCSGEVIQMD HSLERVWSAITEHDLRASRI SLSSSPGPDGITPKSAREVP SGIMLRIMNLILWCGNLPHS IRLARTVFIPKTVTAKRPQD FRPISVPSVLVRQLNAILAT RLNSSINWDPRQRGFLPTDG CADNATIVDLVLRHSHKHFR SCYIANLDVSKAFDSLSHAS IYDTLRAYGAPKGFVDYVQN TYEGGGTSLNGDGWSSEEFV PARGVKQGDPLSPILFNLVM DRLLRNLPSEIGAKVGNAIT NAAAFADDLVLFAETRMGLQ VLLDKTLDFLSLVGLKLNAD KCFTVGIKGQPKQKCTVLEA QSFYVGSREIPSLKRTDEWK YLGINFTATGRVRCNPAEDI GPKLQRLTKAPLKPQQRMFA LRTVLIPQLYHKLALGSVAI GVLRKTDKLIRYYVRRWLNL PLDVPIAFIHAPPKSGGLGI PSLRWVAPMLRLRRLSNIKW PHLTQNEVASSFLEAEKQRA RDRLLAEQNELLSRPAIEKY WANKLYLSVDGSGLREAGHW GPQHGWVNQPTRLLTGKEYI DGIRLRINALPTKSRTTRGR HELERQCRAGCDAPETTNHI MQKCYRSHGRRVARHNCVVN RIKRGLEERGCVVIVEPSLQ CESGLNKPDLVALRQDHIDV IDIQIVTDGHSMDDAHQRKI NRYDRPDIRTELRRRFEAAG DIEFHSATLNWRGIWSGQSV KRLIAKGLLSKYDSHIISVQ VMRGSLGCFKQFMYLSGFSR DWT (SEQ ID NO: 1488) |
| R2 | R2_DYa | . | Drosophila yakuba | CATAAGTCTTGCCTTTACTC AAGTCGACTCAAAACCTCCT CGTGGTGTTTCCCGGTAATG TTAAACTTGTTTAGCAGCTA A (SEQ ID NO: 1244) | TAGCTTAAAACGTTTGGTTC ACATACATCTGCCTGCTGCC TTGGCACAATATCAAAAAGG CATAAACATCGCACATATTG GTTATTTACGGCTATGAGGA TGGTTTTAGTACGTAGGCGT TGCGGAACTTCGGTTCGGAT AGAGCAATGAATCGTGCATG CTAGGAACTGACCAAATAAC AGCAGCCCTAGTATCTTTCG AAGATTTCCATACCTTTGCG ATCAAAAAAAAAAAAAAAA AA (SEQ ID NO: 1367) | FERRIFPKGLVPLTKDNHIG TTNLQNEPRIFTNDLLTTRP SVDHVPEDQYEPNAAATLSR VPCTVCDRSFNSKRGLGVHM RSRHPDELDEERRRVDIKAR WSEEEKWMMARKEVELMANG FKHINKQLAVYFANRSVEAI KKLRQRGDYKEKIEQIRGQS ALAPEVANLTIRRRPSRSEQ DHQVPTSEASPITPLEQSNR EILRTLRGYSPVVCPSKWRA QELQTIIDRAEFEGKETTLQ CLSLYLQGIFPVQGVRHTLT RPPRRPRNRRESRRQQYAVI QRNWDKHKGRCIKSLLNGTD ESVMPSREFMEPYWREVMTQ PSPSSCNGEVIRTDHSLETV |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | WSAITEQDLRASRVSLSSSP GPDGVTPKTAREVPSGIMLR IMNLILWCGNLPHSIRLART IFIPKTVTAKRPQDFRPISV PSVLVRQLNAILATRLTSSI DWDPRQRGFSPTDGCADNAT IVDLVLRHSHKYFKSCYIAN LDVSKAFDSLSHAAIYGTLR AYGAPKGFVDYVQKTYEGGG ISLNGEGWCSEEFVPARGVK QGDPLSPILFNLVIDRLLRA LPSEIGTKVGNAMINAAAFA DDLVLFAETRMGLQTLLDKT VDFLSTVGLKLNADKCFTVG IKGQPKQKCTVLEAQSFCVG SREIPTLKRTDEWKYLGIHF TASGRVRCNPAEDIGPKLQR LSEAPLKPQQRLFALRTVLI PQLYHKLSLGSVTIGVLRKT DKLIRFYVRRWLNLPSDVPI AFVHAPPKCGGLGIPSLRWV APMLRLRRLSNIKWPHLVQS EEASSFIEAEKQRARGRLIA EQNELLSRPAIEKYWANRLY LSVDGGGLREAGHYGPQHGW VSQPTRLLTGKEYLDGIRLR INALPTKSRTTRGRHELERQ CRAGCDAPETTNHIMQKCYR SHGRRVARHNCVVNRIKRGL EERGCVVIAEPSLQCESGLN KPDLVVLRQNHIDVIDVQVV TDGHSMDEAHQRKINRYDRP DIRTELRRRFEAAGDIEFHS ATLNWRGIWSGQSVKRLIAK GLLSKYDSHIISVQVMRGSL GCFRQFMYLSGFSRDWT (SEQ ID NO: 1489) |
| R2 | R2_KF | GU949558 | *Kalotermes flavicollis* | GAGAGGTCACTGTTGCTGAT CAGCTGGACACCTAGCTGAC TGCGTGCATGCGTGCACGCC GCGCGCCGCCTCCTCGTGGT ACCGCTGGTAACGCAGGGTC ACTGAGACTACCTGCGGCTA AAGGCGCGCGCGAGGGATTG TAAGTCCACCACCTCCACGT GGTTCCCCGCGGGCAACGGC ATAGTTCATCTGCCGGCCAA GCGTGCCGTTCCCTCGATCC TCCTCTGATTAGGGATAGGA GGGGGGCGGTGGCTCCCGCC GACGACCTGGCAAACACCTT GGACACGCTAAGATAATAGG CCGTCCTCCGGGCCGGCCGA ATCATAAGCACACA (SEQ ID NO: 1245) | TAATGTCCCTTTTGGCTTGC CCCCACCTGCTTAAAGGAAC TGGCAGGAAAGAGAGTGATC CGTGCCATAGAAATATGGTT ATCCGGGGCAAGTCACTAGC AATATGGGACTTCTCCGGGT CCGTGCGGTCCTTCCAACAT GAGCTGGACGTAGTCCACTC TATGACTTGAACGATACGGG GGCGTATCTCCCCCGGAAGA GGTCGCCTAGGCGACTTAGA A (SEQ ID NO: 1368) | MEVPLTSSLGSGATQAPGTP ELLGEHTVERPGLDQGHSYG LLMDDVELPVRLPFFGPLIC PGCRTLLTSEETISSSHHRRV HPDARTRWVCYGCDSPFMTY RAIKCHLPKCSGRKVVTGDH ICNGCTKRFESQRGLSLHKR RAHPGLRNEEMLEPPVRAER RPNAHKSSIWSIDEIRILEQ YEAAYVGDLHINMKIAAHLP FKTNKQVSNYRNDRRKKSRT ATDASQQGLGPNDGNRGIVP SGQSSPLFLEGSDAEGDEDV FNVLVPPTLGGLEPAGQVHS LSEGETSPLVGEADPCFMGG TPSAGEASGSTLLGPDPTPA DGYSLVRKDLQLSVQTSPLL AVGSVGTESVQFERGVLSCG TPPEFLHPEQFAHCANNDPV LNASEEQVHAPLGEEANDLP DNNHPSELGVDPEDPTCSPA TEQVQPSSEEEADDPFAQFK AWRRRVASYALKIETGVLPA QVDDLLRRLRDGDTQSKVTC EEVEEVVLSLTRTILGGTAP KKRVEGRTKWTYKSRTNHEA RKRIMYARCQDLYRRRPQRP VERAVGYQAEESLLDNQDER PSHGAFETFYTGLWGKSGQC NITMPPGVPRHTGHVLREVT PKDIYSRLRKLKKDYAPGPD GVTKLKVQSMGAYPSLLAKV YNLVMLTGYFSSCWKEHKTS LIPKDRGSPMDVSNWRPITI GSLLSRIYTGLIERRLRTVS DIHQRQVGFMPVNGCAANLF |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | IFDECIRQAKKEGTIVGSLI DVAKAFDTVPHEAILRALSS QGVDEHTMAHIRDMYSGIRT RINGKGSDIPLVRGVKQGDP LSPMLFNMVMDPLIRDLQRK GFRIGGHEIGALAFADDIVL LADSIDGAQDHVDQVGRYMN KLGMTLNPRKSSSFLITAMR KTWICRDPGLSIGETKVPGA RPSSALKYLGVNYTLSEGLE SGALIDKLMQAVNRARGLAL KPLQKVNLILERIIPKFLYG IILGGPSLTRLHAADKCVRM AVKEILHLHPSTTDHVLYAR KKDGGMGIPRLAHLVRLASL RSGLALLASGDVAVQAAGMA GDLEGRCKKVANDLRLNWPV TLRDVVRASNKFKSQESKDW ERLASQGHGVKDFRNDRLGN CWLYDPTVLSSSRYTDALRL RTNTFGVNVALRRADKDLEV NCRRCHGKPETLGHVLGECV AGKGMRIQRHDKMAAFVATK CEEKGYQTTREQLFSIEQGK LKPDLVVIDGERALIVDVTV RFESGNALSRGASEKIEKYQ PLADYFVSQGAVREANVLPI VVGSRGAITQATLKSLATLG LDVERVGKYLAICAVASSVE IACMHLDYT (SEQ ID NO: 1490) |
| R2 | R2_RL | GU949555 | *Reticulitermes lucifugus* | CTCACTGCTGTCATGCCATT GTTAATGCGTTGGGTGATGG CGGGTGATGGGAGACGAGTT ACAGCAGAGCTGGCTTCACG GGGGGGGCTGTAGTTGCCCG AACCAGTCTGCTTCTGAGTG CCTCCACGTGGCCTCGCTGG AAACGTCGGAGCTGCTTACG GCTAACCCGTAGACAACTCC GGCGGCCAAACTCAGAAAAC GGCCTTACTACCAGGGTCAT CCCTCGCGGCGGCGCTAAGA CCTTACTGTATGTACTACGG ACTACAGTTGAGTAGCGCGG GAGAGCACTTGATGTGAGGG TAGCAACTTGTTGCTACTTC GACTGTCTCCCTGAAGATTT CCGAAGGGGTGCCGCAAGTC CATGGGGGCGGTCCTGCTGT GGGAGTTATCTTGCACCCGG GAAGCCCTCAGTGGATAAAT ACTCCAAAATGGCTTAGCCA CCTCACGTGGAGAGAGGGGA ATTAGGGGTTTACTCCTAAG GGCCGATGCCTCCAATCGGA TTTCCCCGGGCAACGGCTAT TATCAGCCGGCTAAGTTCGG ACCCTCATCTACTGATGGGA TACTCTCTCTCCCCCCGCCT GCGTGATTAGTTGGGAATGC ACGCGGGCGGGTGATTCTGA CAAGCCCAGCCCAAAAGTTC TTACCACGACGTACCCGGGG GTGTCACCCGAACTAATATA TTTTCCGCCGATCGGTTCGC TGTGGGGGATGTCGGGGCC TGGTGGCCGGGAACCGTCAG CCGCTCTTTGAGTGTCCTGC GTAACCCGGAGGCGGTGACG TCGAAGGGCTAGGCTAGCAC GGTCCAGACCCCTGAACGCC TGGGGAGACGGGCCCACCAC | TGAGTTAGATATATATGACG ACTGATTCTTCCCTAACTAA AATATAATTTGGAATGTGCA TTACTTATACTTTATTGTAT TTATTGACATCCGTAGTAGT CTGTTTAGTGGATTTAGATC GTTAACCATTCTGTGACGTC GCTGATGTCTATATGTACCA GTGGCAGAATGCTGACTAAG AACAAAATAATTTTAAACAA TAGACAGCACTAAGAAATTC TGCAAACTGGAACGTGGCCC ACGGTAGGCCAATATACCGG AAAGGGAAAATGACACATCC CCCCTTAAA (SEQ ID NO: 1369) | MMADYNNSVDHALEDNTRLI FARDAVLARVCGPPFDNLECG LCGVLLTSLQGVREHCHRAH HNLDLTFQCTKCDKGFSSYR GICCHFSKCIGARISVSEGP LSCSECEREFDSKRALSTHE RHMHPGIRNAKRLKDFNPRG GGGKTIHGNTKWTEEEVQLL VSLSKRFEGYKSINKEISLI LTSKTCKQISDKRRYLNLHN GNGGLAAAEAVLEFCEDSHP EVTESDGAVLSEIMDEECHQ SSVTMRSSIVHGDIGREVQG KELVRIPPDNSVMGNCVVLL RKLATDKRSDLDLSKDKELR IDIEKATKANRESADGRVIQ SVAGNEIDPDTFQWKELLLG QVRGFPRVDENSELFDLDDK LTKELSSDSPVWNDNCELIV SDLCQVLCKKKYELGRQHHV RKGKRHRGIHHKREKFRECQ KIFRKSPRKLAEYLYRDKDL SHISKDASTPQGIEQYYSQL WGEPELLESNTIEEKLPSSS LFDCLPPITPEEVEGRIHKI RPSSAPGLDGVRKIHLVGKG ITLVLVKLYNLLFLTGGYPE CWKRNRTVFIPKIGKDLSEV GGWRPLTIGSLLARMYSAFL ERRIRRVTSLSLSQRGFTNI QGCHVNLTILKEGIRQAKVK NGGVIVSVDIEKAFDTIPHS VIFSRLASQGVPPLLRKIIS NMYKDVYTVIEGQCIPIKRG VKQGDPLSPLLFNIAIDPVL RSLEEFQGGLPLGNSAIKIL AFADDIILGASSAGQAQQMV DMLGIGLTSCGLGVSHRKCF GFQIVNKNKTWTIVDPMITL NGSSLPFSGPEDRLPYLGVD INPWDRKSRYDAGQRLISAA KRGSQLSLKPQQKINLITAF |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CTGAGTAGGAGTGGGTCCTT<br>TACCTCATTTGAGGTGTCTC<br>CTCGTTCTTGTAGGGGCGA<br>AGGACGAGGAATGCATCCGT<br>CCCTCCAGGATGCTGGTGGT<br>TTCCGTCTGGTGGGCTCATG<br>CTGAAACGCGCAGGTGCCGA<br>TTTGTCGAAGAGGACATATG<br>GGGTAACCCATAGAACCTAG<br>GCAGGAGTAATCCCTTAGCT<br>GGGGGGTCAGCTGGTGGGT<br>CCTGTCAATTTATCCTCCCC<br>TCCATGCCAGAGCCGGTCCG<br>AGGTTAGAGACGGACTCATT<br>TTCTCCTTTTTATATGTC<br>(SEQ ID NO: 1246) | | LLPKFLYILIEDPPSPAYLK<br>SIDHDLRQIYKNILHLPNCV<br>STAFMYSPKRDGGLGLPRLS<br>CLVPLAHLKAGIKLGSLQDS<br>LVREITTSDRFVRTMGSVAH<br>SLWASWSLTLQDIYKLKSAL<br>KRREAKAWESCVSQGQGAAQ<br>FRGDSIGNNWLHNPGTYRPG<br>QYIEALKLRANLTGVRVNLK<br>RSGYNVPITCRFCKDIPETQ<br>AHVLGLCPKTKGMRIQRHDS<br>IVNRVRDKLKTKSPVALMHE<br>QNFTVEEGQVFKPDIVTILG<br>EVGYVIDVTVRYDDRDYIKD<br>ASVEKIRKYEALKGYLKDLY<br>PQLNKVEVLPLVFGSRGAVP<br>GSTVHNMGLLGFTKREMVHI<br>SRKVIADSLIISNFLEVY<br>(SEQ ID NO: 1491) |
| R2 | R2_RU | GU949554 | *Reticulitermes urbis* | CACACTGCTGTCATGCCATT<br>GTTAATTCGTTGGGTGATGG<br>CGGGTGATGGGAGACGAGTT<br>ACAGCAGAGCTGGCTTCACG<br>GGGGGGCTGTAGTGGCCCGA<br>ACCAGTCTGCTTCTGAGTGC<br>CCCCAAGTGGCCTCGCTGGA<br>AACGTCGGAGCTGCTTACGG<br>TTAACCCGTAGACAACTCCG<br>GCGGCCAAACTCAGAAAACG<br>GCCTTACTACCAGGGCCATC<br>CCTTGCGGTTGCGCTAAGAC<br>CTTACTGTATGTACTACGGA<br>CTACAGTTGAGTAGCGCGGG<br>AGAGCACTCGATGTGAGGGT<br>AGCAACTTGTTGCTTCTTCG<br>ACTGTCTCCCTGAAGAGTTC<br>CGAAGAGGTGCCGCAAGTCC<br>ATGGGGGCGACCCGGCTGTG<br>GGAGTTATCCTGCACCCGGG<br>AAGCCCTCAGTGGATAAATA<br>CTCCAAAATGGCTTAGCCAC<br>CTCACGTGGAGAGAGGGGAA<br>TTAGGGGTTTACTCCTAAGG<br>GCCGATGCCTCCAATCGGAT<br>TTCCCAGGGCAACGGCTATT<br>ATCAGCCGGCTAAGTTCGGA<br>CCCTCATCTACCGATGGGAT<br>ACTCTCTCTCCCCCCGCCTG<br>CGTGATTAATTGGGAATGCA<br>CGAGGGCGGGTGATTCTGAC<br>AAGCCCAGCCCAAAAGTTCT<br>TACCACGACGTACCCGGGGG<br>TGTCACCCGAACTAATATAT<br>TTTCCACCGATCGGTTCGCT<br>GTGGGGGATGTCGGGGCCT<br>GGTGGCCAGGAACCGTCAGC<br>CGTCTTTGAGTGTCCTGCG<br>TAACCCGGAGGCGGTGACGT<br>CGAAGGGCTAGGCTAGCACG<br>GTCCAGACCCCTGAACGCCT<br>GGGGAGACGGGCCCACCACC<br>TGTGTAGGAGTGGGTCCTTT<br>ACCTCATTTGAGGTGTCTCC<br>TCGGTCTAGTAGGGGCGAA<br>GGACGAGGGATGCATCCGTC<br>CCTCCAGGATGCTGGTGGTT<br>TCCGTCTGGTGGGCTCATGC<br>TGAAACCCGCAGGTGCCGAT<br>TTGTCGAAGAGGACATATGG<br>GGTAACCCATAGAACCTAGG<br>CAGGAGTAATCCCTTAGCTG<br>GGGGGTCAGCTGGTGGGTC<br>CTGTCAATTTATCCTCCCCT | TGAGTTAGATATATATAACG<br>ACTGATTCTTCCCTAACTAA<br>AATATAATTTGGAATGTGCA<br>TTACTTATACTTTATTGTAT<br>TTATTGACATCCGTAGTAGT<br>CTGTTTAGTGGATTTAGATC<br>GTTAACCATTCTGTGACGTC<br>GCTGATGTCTACATGTACCA<br>GGKTIHGNTKWTEEEVQLLV<br>SLSKRFEGYKSINKEISLIL<br>TSKTCKQISDKRRYLNLHNG<br>NGGLAAAEAVLVFCDDSHLE<br>VTDSDGAVLSEIMDEEYYQS<br>SLTMRSSIVHGDIGREVQGK<br>DLVRIPPDNSVMGNCVVLLR<br>KLATEKRSDLDLSKDKELRI<br>DIEKATKANRESADGRVIQS<br>VADNEIDPDTFQWKELLLGQ<br>VRGFPRVDENSELFDLDDKL<br>TSELSSDSPVWNDNCELIVS<br>DLCHVLCKNKYELGRQHHVR<br>KGKRHRGIHHKREKFRECQK<br>IFRKSPRKLAEYLYRDKDLS<br>HISKDVSTPQGIEQYYSQLW<br>GKPELLESNTTEEMLPSSSL<br>FDCLPPITPEEVEGRIHKIR<br>PSSAPGLDGVGKIHLVGKGI<br>TLVLAKLYNLLFLTGGYPEC<br>WKRNRTVFIPKIGKDLSEVG<br>GWRPLTIGSLLARMYSAFLE<br>RRIRRVTSLSSSQRGFTNIQ<br>GCHVNLTILKEGIRQAKVKN<br>GGVIVSVDIEKAFDTIPHSV<br>IFSRLASQGVPPLLRKIISN<br>MYKDVYTVIEGQCIPIKRGV<br>KQGDPLFPLLFNIAIDPVLR<br>SLEEFQGGLPLGNSAIKILA<br>FDDDIILGASSAGQAQQMVD<br>MLGIGLTSCGLGVSHRKCFG<br>FQIVNKNKTWAIVDPMITLN<br>GSSLPFSGPEDRLPYLGVDT<br>NPWDRKSRYDAGQRLISAAK<br>RGSQLSLKPQQKINLITTFL<br>LPKFLYILIEDPPSPAYLKS<br>IDHDLRQIYKNILHLPNCVS<br>TAFMYSPKRDGGLGLPRLSC<br>LVPLAHIKAGIKLGSLQDSL<br>VREITTSDRFVRTMGSVSHS<br>IGASWPLTLQDIYKLKSALK<br>RREAKAWESCVSQGQGAAQF<br>RGDSIGNNWLHNPGTFRPGQ<br>YIEALKLRANSTGVRVNLKR<br>SGYNVPITCRFCKDIPETQA<br>HVLGLCPKTKGMRILRHDSI<br>VNRVRDKLKTKSPVALMHEQ | MMADYNNSVDHALEDDTRFI<br>FARDSVLARVCGHFDNLKCE<br>LCGVLLTSLQGVREHCHRSH<br>HNLDLTFQCTKCDKGFSSYR<br>GICCHFSKCRGARISVSEGP<br>LSCSECERKFDSKRALSTHE<br>RHMHPGIRNAKRLKDFNPRG<br>AACAAATAATTTTAAACAA<br>TAGACAGCACTAAGAAATTC<br>TGCAAACTGGAACGTGGCCC<br>ACGGTAGGCCAATATACCGG<br>AAAGGGAAAATGACAAATCC<br>CCCCTTAAA<br>(SEQ ID NO: 1370) | |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | CCATGCCAGAGCCGGTCCGA GGTTAGAGACGGACTCATTT TCTCCTTTTTATATGTC (SEQ ID NO: 1247) | | NFTVEEGQVFKPDIVTILGE VGYVIDVTVRYEDRDYIKDA SVEKIRKYEALKGYLKDLYP QLNKVEVLPLVFGSRGAVPG STVHNMGLLGFTKREMVHIS RKVITDSLIIISNFLEVY (SEQ ID NO: 1492) |
| R2 | RaR2 | FJ461304 | Rhynchosciara americana | CAGAACGTGGAGAAACGGAA TAACTACCCAGATCCGTTGG TTAACCGGTGGCAAAGTTAA TCAAGGTTGCCATAGGCTTA ATAACCCTATGGAAATGTTT CCACACACCTCCACGTGGTG CCTGCCGGAAATTGTTCTAG GGTGAACAAGCTAAGTGTG AGAAACGGGCTCCACCACAA TATGGAGCCTGCCAGGGCGC GAGACTCAGGACTCTCCATG TACAAAGTGGTTAGTTGCAA AAAGAGTGCGCCTAGCATGA CTGATAATTTTTCACTGAAA TAACGTTGAACTTTATCTGT GTCATGTGCACAACACTATG GTGTCTGATCAAGCACCATC AGTGGTGGACCTGCTAATGT ATTAGTAGAACGTGTCCAGG CGATAATGCACACACGGCCT CCGGGCCCATCGCTTTTTTT GAGATTCCCTAGAAACTTCA GTGTGTGCGACAACTGTATA ACCCATAAGGGATGGACAAA GGTTATACTAGGGGTAAAA ACCCTAATCGGCTAATGGCA AATGGGATGTAGAAATGCCA AAGATTACTCGCACCGAATA ATGGTGGCCGAAAAGCGGGT AATCGAATGAAATGGTAATG CTGTAGCGGAAACATGATCA CATTCTGTGACAGTAAACCA TTAGACCTAGGGGGAACTAT GATTAACAAGATACCAGCTT ACATGGAAGCAATGAAATGT AAGTCACAGTAGTGATAAGT GGTGAAGAGTCTTGTAATCA CCGTAACTAGGCCAGGTTCT GGGGATGCCATGAACTTAGG GGGAGTATGGTTAGCAGATC TACCAGCTAACACTATTACT GATAATATGTAAGCCGCAGT AGCGCTAAGTGGTGTACAGA TTTGCAACCACCGTAACTAA GTTCTGTTTCGATGGACTAG GGGGAATCATGATTAACAAG ATACCAACTTACATGGAAGT TATGAAATGTAAGTCACAGT AGTGATAAGTGGTGAAGAGT CTTGTAATCACCGTAACTAG GCCAGATGTAGTCAAAGCAC ATGTTTAGGGGGAACAAGGT TAACATTGGTAAAAGACCAA TGCAACCTCCGTAACTAAAC GTGAAGGCACAAAACTAAAA GTCCAGTGGATGACAGGTGA GGTCATCACTGGACCCAAAT GTTTTAAGCTCATCATAACA ACACGGTGAAAAATCCAGCA TTTATTTGCCTGATTGAGTA GCTTCCACACTATTCCAAAG CCGAACCTATCTGGGTTTTT CTTGAAAGGCCGTATAGGGC ATATGTCGAGAAATAAGTCC AAGGTGAGGTAGTGTGGCCC TGTACCCAGGGGTAAGGTAC | TAGAAATGTGTGCGATAAGG TGTGAATAGAAGGGTTCACC AAGAGGGAGACCTAGTTTGG ACCTCAGAAATGGGGTCATA GGAGTGATAGGTTGTAAAGC CGTTGGGGAATCCGGCTACA CATGGTATCTCAGGAGCCAT TCATGCGCTGATCTCATTAA GGCGTAATAAACTGTGAAAC AGATCCTGATAATGCCGTGC TACCAAATGATGTAACGAGG CGGAAATAAAATTAATCTGG GGCGTTCTGCGGAATGACTA CTAAATATAGCGATGCTATA TATACAAACGATCGATGGTA ACACCGGCCTTA (SEQ ID NO: 1371) | MSNYNETNTSGGDNPRMATQ TTGSLSSGPINQHTCELCCR TFGTRAGLGQHVRKTHPIES NQSINVERKKRRWSPEEIRR MANMEAQATINNIKHLTQYL ATYLPQRTLNAIKGRRRDAE YKELVTGIIANLRSNSSTQQ TNQVCNESEMSQRSKILQSI RESVRDLRSRRNKYAKALQE LGEAALCGKMLNEEQLIHCI KSMFNTAKCPKGPRFRKTAT HSGTNKQQRQQRYARVQKLY KMNRKVAAKMVLEETDKIQI KLPDHDPMFKFWESEFKEGE GMPERMPKDLKESPDLKAIW DPVTEEEVRKAKVANNTAAG PDGIQPKSWNRISLKYKTLI YNLLLYYEKVPHKLKVSRTV FIPKKKDGSSDPGEFRPLTI CSVVLRGFNKILVQRLVSLY KYDERQTAYLPIDGVGTNIH VLAAILNDSNTKLSELHVAL LDITKAFNRLHHTSIIKSLV GKGFPYGFITFIRRMYTGLQ TMMQFEGHCKMTQVNRGVYQ GDPLSGPIFLLAIEKGLQAL DKEVGYDIGDVRVNAGAYAD DTDLVAGTRLGLQDNINRFS STIKQVGLEVNPRKSMTLSL VPSGKEKKMKVETGKPFRAN DVPLKELSINDFWRYLGISY TNEGPERLSLTIEQDLERLT KAPLKPQQRIHMLNAYVIPK YQDKLVLSKTTAKGLKRTDR QIRQYVRRWLKLPHDVPIAY LHAPVKSGGLNIPCLQYWIP LLRVNRVNKITESQRSVLAA VGKTALLTSTVYKCNQSLAT LGGNPTMLAYRTYWEKELYA KVDGKDLQNARDDKASTRWN GMLHSDISGEDYLNYHKLRT NSVPTKVRTARGRPQKETSC RGGCKSTETLQHVVQQCHRT HGGRTLRHDRIVGLLQHELR RDYNVLAKQELKTGIGLRKP DLVLIKDDTAHIVDVQVARC SKLNESHVRKRSKYDKKEIE VEVKSRYRVSKVMYEACTIS YKGIWDKQSVMSMRRLGVSE YCLFKIVTSTLRGTWLCWKR FNMITSVRS (SEQ ID NO: 1493) |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TATACGGTCGAGTGGCTCAG TAGGCCTAACTAGCCACTGA GTCACTATAATGACTAGTT (SEQ ID NO: 1248) | | |
| R2 | YURE-2_Cis | . | Ciona savignyi | CCAAAATTACTTCCAGCACC TCCACAGCAGACGAACGAAG AAAGAAGACTTACGAAATAA GAATAAGCAGTTTAAAGACG AAGCAGACGAACACCACTCC ACCACGACGCTCTGCAGCT ACACCACCACCATCTCGCCG CAACAAGAAGAATTTTCCGC TGCTCTCCACTCTGCTCCAA CACCACCTCTCCTGCTCTGT GGACTGCTGCCTTGCTGCTG GACCAACCTCTACCCGAAGG AACCCTTCGAACCCAGCAGC AAGGTACGTGTCACCACCTC TCCACAGAGCCAAGGCCAGA GTGGATAGAGCAGCGGCCTC TACAACCAAGTTCTCCACTC CGACGACAAAACACCTGCCT CGTGGCCAGAGTCCTGCCGA AGAAGAATCTTCGACCCCAA CACCGTCTCGGCAGGGCTCC AAGCAACGACATCAGCCACG AGTGCCCACCGGAGTGGACG CGGCGAACCCGAGGACCGCT GTCGCCAAGAACAATAACAT CACCGCCTGCAGCAGCTACC AAACAAAGGTTAGTCTCCTA CCTCACCTACAAACTCGTCT GAATAGACGCCCCCGCGTGG GAGCTAACCTTGGTAGCTAG CTGCAGTGCCCTGCGACAGC GGCCTCGAAGAGCTGCGAGAG CGTCAGCCTGCTTCGACCTC GCTTGTTCTCATTTCAACCT ACTCCGTCCTGTGGAATCAA AAGAGCCCCACTAACAATTA CATTCATAAAATCTAGCAAG AACGAAGAGAAGCGACCAAC TTTTAATCCATAACTTTTAG ATCTTTTTATTTATTAC TGTTTTTAAG CCCTAAGCATATTGCCTTTT TTTAGATCTTATAATTATAA AAATAGATTCAAAGTTAACA CCACCAGGCCGCTACAGAGC ATTTTATTTAATCAATTTGT TACCGACCTCCTGCTGCTTC TTTTTACTTTCTCCAGACTA CTACCCGGATCAACCCTTG GAAACGAGAGGA (SEQ ID NO: 1249) | TAAGATCCGCGGCTGTGGCG CCGAACGAGCACCTGCCCAT TCTTCTTGTAGGGACTTTTT CACCCTCACTCCCCCCAATA GTTTTTTTTCGTTTTTTCGT TTTTTCACCCCCACCCCACT CGCCTCTGGGCTGCACATCC CACACGTAGGGACCTGTTTA TATTATTTGCCTTTTATATG TACCACTTTTTAAATATATT TTTGTACCCCACAAGATGCT TTTCGCCAAAAAAAAAAAAT TTTTGTATACATTTTTATA TTTTGTAAAACACAGATTTT TATAAACTTTGCACTATTTT TATATAAACTTCGCACTTAT TTAAAATGAATCGCATCTTT TTTATATACACCAACACAAA CAGGATGTGCAGCTCAGGGG AACCAATCCTGCGTCCCTCC TAGCGGCGGGAGGGGCGCCC ACCTACCCCCACGCTCCTCT TGAGCACCAACAGGGACTCC CTTCCGGAGCCCTGCACCC TCAACTTTTCTTATTTTAA AAAAAAAAATCATATATAT TGATCTTGACGACGGGGGCT ACATTCAGCCCCCAAAAACC CACCCACCATCCCCAACGAG TGCCGGGGCATTGAAGAGCT CCCGGCACAATTAGCACTTAG CTTATTTATTATTTTTTGTC AACATTTTGTTTTTTCAAA ITTTTTCACCCCTCACCCCC ACCCTAATAGGTCCCTCGGG CTTGGGCCCCTTTTTCGTGC TCGAGAAGCGTCACATCGCC CCACTGACCACGACCTTCCC CGACATTGGAGTCCTTGGCG TCTCCCAGGTCGAAACAGTC CCAAGTGATAGCACCTAATG CTCGACTTGTTTCGGCCTGG GCCGCCGAGGATTCCCAGAA CGACCATTCTTCTAAATAAT ATTTATATTTCAGAATAAAA CTATATATATATCGTTGGCG GGACTTGTCCCGCCTCGATA CCCAGTGCTGCAGAGCGGCA AAATAAAGAAGAAACCGACG TCGCTCTGCAGCCAAGGACC ACCCAAACTCAAGCCAGCAC CGTCGACAACCAACATCCTC AAGTCGGCGGTTGCTGGAAC AACTCATAACATCTTCAANA TAAATTATCACCCTGTGCAG CAGGAGGCCGTGCTTTTAAA ACTACTCTGTAGTGGCTCAT GATAATATTTCGCTCCTTTT TTGCCCCGTGTAAACTTAGT NGATGCGAATAAAATCAGTT GAATCA (SEQ ID NO: 1372) | MAGHKITMSEGKLLEVAVRY GGVRNVSYECPVPDCTKTFS QANNLIRHLNNFGNTKHRAH NFTYFFTCEKCKIQIHSNTK HNISNHYKQCCATGGGPSCE TGQYFCPACEQAGLGNLESA LRHFQSSHPEFNLPPRSQFS KSHPNSYTLSLKPKDHLMKI LYSGPLTPGQLVCPIKICLR SSAARLFHDVSKLRKHMLVD HNRTLVYETTCGKCLRPVDT SKNMRKTTSHFEKCSGESFI SSPSPIPQKTYKLDLPSTST PPPRKSPKLQPYKPIRTFKN PLTKSSQSKSDNPPKPTPFF SPRTLERSASWPALSEVVDP LPKLKEKHPSLPCALDKCPP SPRIKPSTLVPPCHTANNSP KPTSPESPSTLKPLPRPIRP SKPLEDWLTVRSVGPDREIV LNIGPRPRPGPAAGSRTTSP PSTAPAKRVAANPIAAPLSG EPGATLDCGQTGRKVQPPKK RPTESAGSLPPPAEPATDLL TGREGLARLVEEYHLSGDFG AFCRDLERWTALSSTNRRPK PRRGRYNRGAAARATRNRGR DDRQDPQDRDDQGGPGPVTC GRPQRYKAAALRSAFGRDM KATVRRIIDGERGDARCEID PKTIEGRFRDELSPPVREGP ECSLPPWMAEAQAGEHAPSN DSQPGDAYDGPITALEVEMV LSTLNVGSAPGSDGLSYGFW RALDPKGLVLSELFEVCRIE RRVPGPWKSSRVTLICKDAE GDLDDLGNWRPISICQTVYK IYAAVLARRLQSWALDGGVI SRSQKGFMPPEGVYEHVFLL DSVVADARATRRSLAVCWLD LRNAFGSVDHTTIVEALSRF GAPAGLVEMISDIYTGGSCR IRTRAGFTPDIPVGRGVRQG CPLSGIIFNLVMEVLLRGVE ANNACGYRLSCAGGASVRVL AYADDVALVGSSRAEXKIQL GVCERFAAWAGFSFNNKKCA AMVLKHQRGGRRLLDSAPLR LCGEEVAILGPDSFYKYLGA HTGYGRQTGGQLVDRVERQV VRLFTSFLTPTQKLSALKRI VLPAMSFHLRVRPCAEGHLR RLDNTVRRCVKTALRLPKGS CRAFFHTSPDAGGLGITSVV AECDILTVTQAFKMLSSPDH LVSLVAKGRLGMHAARMGRS ETASACAMADYLSGDSVMGH XSWKTGYRMPADLWTATRAA SRRLSLRFSPQPQGEFGLES GTFKIAPRERRSLTRRLHHR QNLWWRNQWAALPNQGKTVA AHSAYAASNNWVKGPSSLAP QALFFGLKARLNQMPTRSVK ACYSRAPNYDKSCRRCGAEV ETLPHVLNHCPKSMKSILER HDSVLAEVLAAIPRGTFASV DVDRTSREHFRRVGEALRPD IVARRHDGSVVVADVTCPFE SCASALDTAAARKIEKYDQL |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | CANLRQLYRKPVESHALVVG SLGSWGRTNNTALAALGIRG AVRSRLAKQLVNLSVEGSHN IWLRWSGGIPKDLVR (SEQ ID NO: 1494) |
| R4 | Dong | . | Bombyx mori | GCTAGCTCCCTAAAATCCTA CCTTACGTCCGAGGCGAACA TCTGTCCACGTGGGGAGCGG AAACGCGTACTATCGAAACT TACGCGGCTAACAAGGTAAA GGTAACCCATTAATATGGAG ACAAGACTAAAAAGAAAATT GAGAGGGCCGCTTCCCGGGG GCGATCGCCGGGGCACACCT GGAGCTGGCGCTGGGTGTTC CAGCATAGGATCCGTCAGCG GCGGAGAGTTGAGCAGGCGG GCTCTCGCCGGGGATTTACA ACCCGAAAATGCTACAGCCG CCAACAGAAATCACGATGTA GAAAGTAGGAGCAATAGCCC ATGTGAACCTTACAGCCCGA GTACCGGTTCATACAACCCC TCGGTACAATCATCACCATC ATCCTCGGGTCATAGAGGCT CACCAACGTCGACTATGG (SEQ ID NO: 1250) | TAAAAACTAGCATAATTATT AACTCATAACTAATGTATAT TACTTGGCCAAAAGCCCGTA TATACAGTTCCACCGGCTCT GTCGACAGACTGAACTGAGA AAGGGGAAACATATGGAAAT AATAATAA (SEQ ID NO: 1373) | MLRRGRIFLPASTKAGKTRG RMKWSREVNLFIMRTYYYVT KLETDLTIYRKKLHEHFSLK YPNVIISQQRISDQKRAIER NKLLSQETLDRLKEEVRKQL EDEQTNNVENEKLNSETYSH EYTTLTPQTILTKKTQQHTN IISSTQTSHSSTQTESITLL LENEVDILNTNPTEGATQTQ EVKDKFETNLTMYSGMDPKA RPPLPKLKYSSKLNELIRLF NNDILVDYISPDTQLSDVHT LTYCTAVTISEQLKYKIIAI EGNARHKKNFKPPWQQRLEK DIAKLRADIGKLTQYINNNR SKKVVQSVEQIFKNTKIHTS HENGNKKSQEFLDTLKQKLA LKAHRLKRYNNSQKRKNENT IFLTNEKLFYRNLIKPKTDR DNSNIDIPTAEQLEMYWARL WENSAKHNDKANWITEEKER WDTIEEMQFDDVTEEEITTI TARLHNWKSPGIDKIHNFWF KKLICLHKTIAKNLTDIISG NQSIPEFIATGITYMIPKGD FSIEASQYRPITCLPTIYKI LTTVITKKINSHIEHNNILA EEQKGCRRGHMGCKEQLIID STIMKHATTKNRNLHCTYID YKKAFDSIPHSWLIQVLEIY KINPIIISFLRNIMTHWQTT LKLKNPPNFVTTRQIAIKKG IYQGDSLSPLWFCLALNPLS HQLHNDRAGYRIKQQDNTET IISHLIYMDDIKLYAKNDKE MKKLIDTTTIFSNDISMQFG LDKCKTVHIIKGKVQPGDYT IDDTNTITAMEPSDLYKYLG FQQLKGLDHITIKQSLTSEY KKRINAICKTKLSGKHLIKA LNTYAIPILTYSFGIIKWSK TDIEQIERITRTTLTKHNNL HPKSAIERLTIKRQDGGRGM IDIWHLWRKQIHSLKTFFYI KSDLSEIHRAIAQNDNNYTP LNLKQKELIDNTENLRNRNP QKDMEENWKKKALHGRHPHD LSQSHIDSKASNMWLKTGSL FPETEGFLIAIQDQVINTKN YRKYIIKDPTIRDDKCRKCN TQPETIQHITGACSTLTQTD YTHRHNQLANIIHQQLALKH KLIQNTNTPYYNYKPQTVLE NDSCKLYYDRAILTDRTIHY NRPDITLQDKNNKVTYIIDI AVPNTHNIQKTFTEKMTKYT ELKEEIVRIWKQKKAYIVPI IISTTGVVPNHIHNSLKLLD LKDNIFISLQKAAILNTCRI VRKFMQLEENQTYYTQ (SEQ ID NO: 1495) |
| R4 | DongA G | AB097 127 | Anopheles gambiae | GAAGGCTAACCACAATA (SEQ ID NO: 1251) | TAACATCCGGTGCAAACTCA TTAACATTAAGAAAAGAGAG AGGAGAAATGAGAATGAGAT TCATTCACCTTTGGCATTTG AATAGCCCGGGGTAGGTGAA AAGTTCCCAGCATATTGCTG | METRSMRKTTRLPEEGAPT GAGPGTGDRASIQRLEDEMV QERSFSQRALPVPRTQNRNG SPINHQGNAASANVAVADRQ QSLILAGGRRQRIMWTREMN HYVIRCYYVYTRMETDMPGR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | AGAAGTGACAAAATTCGGAT AATAATAATAATAATAA TAATAATAATAATAATAATA ATAATAATAATATGCATAAT AATA (SEQ ID NO: 1374) | VKMLGMFNDRFPRFAHQLDL SKLYIRQRAIILPEELEFIK LEVRREFGEEEAGWRESSRI SARLNTIDQNTSRASEDRDL DEPTAPGLSVDIQHQMATAV TQFHGTDPLSRHRLPKLHYS YRLKTAVSIINQDVLPQYLD SVGSIEDLQLIVYSAAVAVV RTLWLRTYPQGDSEGRPCSK AEKPAWMRRLENRINATRTK IGRMQEYQRGNSSMKVVRQI AEMVKPKELRDLTDANITEV LDIHLQRLSALAKRLRRYAE CSKRKEQNRMFNINEREFYN WIRNDKPNFREGLPDIGDFT QFWANLCEKPVQHNSEGMRL AEDERFSDGIEDMPVLVVNA QDIREATQYTRNGAAPGPDF VYNFWYKKLITIHEQIAACF NTVLEDSRKLPKFITGGVTY FLPKDQNTKNPAKYRPLTCL SNLNKVLSSVITQKVKDHCD TNNVMTEEQTGRRKNTQGCK DQVIIDAVIVGQAAKKQRNL DMAYIDYKKAYDSVPHSYLL KVLQLYKVDGNVIKLMQHAM GMWSTSLHVTDGKVVLRSRS LNIRRGIFQGDTFSTLWFCL AMNPLSRTLNQQCNFGYLLK SEEISTRITHTFFMDDLKLF AETVQKMHHLLKNVQGFSND IKMEFGIGKCRSIHLHRGQV LDADSFRANEQEEIRHMVQG ETYKFLGFLQLRGIHYAVIK KELQDKFLHRVSCILKSFLS VGNKVKAINTFAVALLTYSF GVMKWSNTDLEALERTIRVV STKHQMRHPKASVERVILPR KIGGVGIIDIQALCISQIHQ LRSYFVESQNRHELYRTVYK ADHGLSALHLAQQDYQLNCN IKTVDGKGATWKQKELHGTH THQLNLEHIDKVSSSTWLVR CDLFCETEGFMVAIQDRVIA TWNYRRCILREDVEDRCRKC NSGGESIEHVIAGCPVLAGS AYLDRHNDVAKIVHQQLALR HKLVERFLPCYRYLPDPVQE NDCIKLYWDREIITDILIRA NRPDILVYEKRKKRATIDID IAVTLDHNVQTTFSTKVMKY HDLAEELKQTWYLEDIRIVP VIISATGIVPMALLRSLDEL ELQRELPRIQKAVILRTCST LRRFLNPYN (SEQ ID NO: 1496) |
| R4 | R4-1_BX | CADV0 1008175 | Bursaphelenchus xylophilus | GGGATCCTGGGTTCCTACTA CCTCGCTCCACCTCCTCGCG ATGGATCCTGGGGAAGTCTC CGGACTGAGCTAAGAGAGCG TTAAAGTAGAGGGTGACGGC GTAAGTACCTCCAAGTTGCG GTGGAGCGGAACATCTACTC TTCGGAGAGAGGGGAAGCTC TATGGCGGCGTTAGAAAGGT TGGACTACGGCAACGCCAGG GAGATGGGGAAGGTTCATCA GGTGATACTAGTTCGACTACT GTCATTCGATGTATCCGAA CCATACTCGCCAAGTTGTGA ACTATGTGAAAGTCTGGATC CAATCCAAGACCACGGGGCG CAATTAAAAGGTGTGAAGCA | TAAGAAAAGCATGAAATAAT AAGAAATCAGATAAGAATAA CAAGAATACTAATAAGTATA TCATGTAACTATGACAAAAA GAACGCACCAATAAGAACAT GCTTGAGTGGCCAGCTCTGC AGGCAAAAGTCGAATTTGGA ACAGCCGGTAATGGAAGACC TGCAACAAACGTGGGGTAGC AGGCAATATGTAACTATGAC AGACCAAAACTCCGAAACTC TGGTAATGAGCCCGTGCCCC CCAAGCATGGTCTCGTTC GATGTAGTTAGGAACAGTTC TCTTTAACCCGTGATGATTA CGCCCTGTCTTAAATGGCAG GTGCCACCAAATACCGAACA | MTCNNAVVFPPADGNPAGTA DRNFAIRFPSSEPPGPSGIR PSEPLDGRTGIGDVEHAQAG NGGFLVDVLEYKEAHRYGSK CEFCYVQTKGTVCSKPRTDA WLKCEILFLLHHAYTANQNK SIELAESAFRRAGITRRSKA TIAKRWSLIQRGKGTDYKEY WDEYFEKFRYECNPTPIVRR KRNRLAAGLQSPSSVPNGYE FERKRTCETPLDTKASSLPL ICNLLTGIVGVENVEENMSV ECTEPKELSGTANSSVPGLA EGVYERRHNNVNEPAAGCPQ DVPVANNLIDSPTTNDRLEA EFKAQLDRAERSYMRRRLPR LKNLSPDERMWIGTTVERLR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | GCTTGCTGGTGATCACCACG GTGGTACCTACACCGGCGGG GGAACATCTTTAATGCCGAG ATGACCGCGCGAATAATAGG GAGCCGGCAAAAGCCGAGCG TAAGTGGAAAGGATACAGAA ATTTGCTCAAAAGTATACCA ACCCGCCACTTATAAAAGAC CGAGAAAAGGGTACCACTAG AGCTCATTATAAAACATCT (SEQ ID NO: 1252) | CTCGTTGAGGTATGGTGGTC CGAATGTGAAGCTGGGAGTA CAATTTGGTACGAGAGCACC AGCGCCCCGATCTAAGTGA TGACGCATGCGTCGGAACAA TGAAGACGGCTGGCAAACAT TCAGGAGTCGCAAA (SEQ ID NO: 1375) | LETVSEPVCEQWRLANAGLY AAIRSIAVMRPLDAAREAHK TWLLNMKMTERKLRQQIGWV ETTRRTKNEARTERQEIVYR KVAKLRRERFPEMDLDSVSV HLKRKLELLKGRIQVRTAER LRRDTREAAGPYGKTALRGQ GFAPNVKDATQYWSGLAQPS GQKCSENSAILSDWKELVEC NLSSLPDQMEPLVVQGISRA SPWKSPGPDGIFNYYWRQDF IVDWLKQLMLDSLRTGHYPW KLSSGRTVLLYKDGDPTKAE NYRPITCLNGCFKMINSVVS EVILKRVENTIALPIEQMAL RRKVWACVESQIWDQIKQRK LSDRTQKCKVAWDFSKAYD SLNHDAIKFVIGVLKLPTGI NNYLLDSMQNWSTHLELKSS GKVVRGPSYPIKRGVLQGDS LSPTLFVVVTSIIVRHIKTI ESSDIQMYMDDIKLYGKDQE TLTRLIKELQTVSNKLGLCM NLKKCAILGDDLPEEINGIE HLKESYKYLGVPQREITQVR ATMAALEKKILTEVDTSLGA AELSYRQRISRVNSKIAPLV RFVVQSMLVTPRDVLKVYNR LGGIDVEIRRRLVKYEIRYK KSNVARLYLDRKVGGIGFVN LCRIMVEAVAARAVYCRLAP SFNEFQDFLAEQNTSPITAA QTILDKCGINIELSTSTLGD VKKIVRNHYHELWLTAWKNT GLYKRWENDHVDIKRSSLWI NRGNLSANNARIGIGIQDNS IFCRGFVGNKCDTKYCRLCG DGIESVSHIVTGCPTHRTNL YIERHDCVARNVYAYLAIRY GIPVPHYTQRVKTIEKNGDQ SVELYWNYKFPCTRALEACR PDIVLIDKVSKRTHIIEVAV SWRGRLQEMVDRKVYKYTVN GEYEADGSSRGWNIVRELND QYGFPVEVYTLVIGAGGEIL PCTVKDVERLTGGAATDNLI ERMERSAVLGSCRIIKRHLA L (SEQ ID NO: 1497) |
| R4 | R4- 1_HG | . | Heterodera glycines | TGGCGATACTCGGAACCTCC GGGGAGCCTGGTAGGAGTTG GCCTACAGGTCGCGAAAGTC CCTAGGTGCTGCACGGGTTG CGCTAATCCGAGGGCGCTGG GTTACCTTCCCATCGGCCAA AAACGTCTGGGCCTTCTTAG CCGCGGGTCCAGTATTTCTG TTGAGCCTGACAGTTCTTCC CGGATATGGCGAAGATTAC AGGGCGGTATTTCGTGAAAC CTAAAAAWGGTCGGGCCGAA TGGCACGGACAGACTCACTT CGGAGTGAGCTCG GGGGCATCCGTGTGTTACCC CGCTGCACCACGCCGAAGCT GTCATAGCGAGCCCGAAGGG GAATGGCCATGGAGACTCCA GCCTCACCCTGTAACTCGAA CCTAAGTCCAGGCCCCTTTC TGGTGTTGGCTCGCACTGGT TAGGAACACGACAGTCTCGT GTAATCCCACACGCACCGAA AGCCCTAGCCCTCGTAGGCG | TGAGGACTCANAATTGACAA TACACCTCAGA (SEQ ID NO: 1376) | MISCDLERETLTQMALFRAR SDKTPTHAGIPAPDEVREGG CGQNRTNPAAPRGKAAAIQR QNGITIPIXACAQSGLVRTQ RVQQWSAVEESALKDVVVRN TDDRGLINWAKGVLPEWQRL CQLNPTMYMARSSPSLSNKW ASLRRTHVGPGCPSKEGSGP SQDLSDVKIQPARLAHDTVA ELPQRTVPCGTDGHGVIDSD ETETALAEVSRSSPFGEREP LDLGATERITRKRLRNAVRD VVPPRKRRVPSTPSRKEQDL VPEVDGPAPTDVLTHPPTES EPEPMLDPLSLVQLVRPQLG RAMGWAAEEMELGNVVMDVE LKREFNREVRRVGRTPPDQM YKRGAGPPLPQKREPERVAL LEQLIAARVERGINRGLDWF LELNVAVFAAARVLSRRERV ETLADRLHINDSATLSEVSR RRAKAERKLRCAREQPWMSR RIRXLGVRVERLKQLADLVR QRIAGRGNRSSYEGPRRRFR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | AAGGCTGCGTTGCTGGTTTC AGAACTGTGAGCWAGTGGGG TTCGGATGGCCGAGTGTACC AACCTGCTTGCTAACAGGTA GCATAGAGTAATATGCTAGT AAGCAGGGCACGAGAAAGGG CCGTAAAGGCTCCGGCTATG AAGGACCTTGCGACCACGCG TGTGTCTCCCACGTGCGGAT TCTTGAAGCCAGAGTCTTGC ACTGCGCGCAGGATGGAGCC TGTGCAACTCCTCCCTCGCT GATCGCAGGAGTGGAGGATC ACCACTCTTTTTACCTTGCT AGCTTGGGGTACCACCTTGA GCTGGGCCGGCCTTGCTAG CTTGGGGTACGACCCTTTGA GCTGGGGCTGGCCTTACTAG CTTGGCGCGCCACCCTTGGA GCTGGGGTGGCGCAAGATCA CTTGTATACGGTCTAACCAA TACATTTGAAAAGCGATCAA AGCGAA (SEQ ID NO: 1253) | | LRPSLRSVTEAPVNPPLNGN EVYTFWHSLWAQSLRANTDD CQLREFKNQLSAARHTDLTS VGTSSLVQMFSAALRKMKKG KAPGPDGIRAAWWGVFRRIA PYVATWVVRVIRGAEPVANW ICNGLTVLLPKSSDNADPSN YRPITCLNTCYKLFTAVIAQ ITASYVDVLGGLPRQQVALR KGVWGTSVSLMIDALTVADA RRAKRPLGVCWFDFKKA FDSVPHNLIRWILRVIGLPP VILSVIVSVMDQWATRLKIG GKVMPKTIPVRTGVFQGDTL SPLLFCLSVWPISFALDQFP QYQFRCANHLQQGFSVGHVF YMDDLKCYCPDREVLTAVIQ QVQKSASALGLTIHYKKSAW LDQDGGKSGKAVLGVPXLVG TYKYLGMHERFMIVSKDSLE SVRGKFMGRLKTLWTSKLTF GQAMLGTKSXCMPVVRYVLQ NLFLPKSEFNQTRLVLREWD RQIRDLLDECNIRQVFRSKT ELYVSREEGGWGLPSMEDAL EEEVVTKLAILVARQETEPL FRVCEALERKRCPTPLSLGL QILKDWGVGVELQGRTLLLN GNTVGPSQATRKLTGELVLR REAERLSRWRSKVKPGCGMT GGAWRDVPGIDVHLSNRWLV KGALSPTVVSNSLAIRANTV ILRGSGGGYTKGTLLRCRGC GNTGETRRHIVSACSLGRQK GAASRRHDNVCRILVRAICH KLNIEPPNSANFPHVVVLEG SGAKMWIDFPFVVPHKIRHT RPDIVVLFEWNGVRRLSVIE VAVSDVANMQTQHIRKSHRY GTNSTEPFVAGVTPTYRNDC LAAQLRAKFKAQQVDVIPII VGTTGETLDGEFGRIRKGLP MLTKLQMPRLWSEIQRAVIL GSYRILVEHLALPKGGA (SEQ ID NO: 1498) |
| R4 | R4-1_PH | . | Parhyale hawaiensis | CCGACCGCCAGCGGGATAAC TGGCAAACCCTGTCTCGACC ACCGGCCCGTGAATCCATCG GGGCGTATGAGTCTGACACA GGGGGGTGTTTAAGGTGACC CTGTTGCGAGGAAATGCGCA GCAAAAGCCGGATGAGCCTT AGAACATCGAAGGCCAACGA CAACCTGCCGAAAGACTGGC GACTAATCCAGTCAACCTCC TGTAGGTCACCGGCTGGTCA TGCTGAATCTCAGCTTAACC AGGCGTACGAACTTACAGTT GGAGGGTCGAGCACCCCTGA TGGCTGAAAAGGACCATCAA AGTCGAAGGTAGCCAACGAG AAGACCAACGGCTGATTCAG GCGGAAGAGTCAACTCGTTG AATGCGTTCGACAGCTTGGG GTAGATGGAACTCCTAAGCC CTGAAAGGCAGTCCATCTTC GCAGACGCTAAGGTGCCCCG CCGCCTGAGGGTTATCAGGC CCCGCCGCCTGAGGGTTACC AGGCAACC (SEQ ID NO: 1254) | TGAGCCTTAGGTCGCGGGAT GTGACCCGGCGCCAGAGTGT AGAGCTGAACATCGCTCAAC CGATCCAATTTGGGTCGTGA AATCCCCTCGATAATAATAA TAATAA (SEQ ID NO: 1377) | MKMSHNRDTPSNGVKGTSVR LGTSLVRSPVGEAGAVRERG THPSESVSQDSDASVNATGE GSVREQAPLSPPGAEEEATVP TQRRTRHKWSREDRVVLWEC FVASKREGPGYLKRLKQLWD ERGIPGNFPQASLSGQIRQI CSKNLLSEEERLQIAARMEA QVASPSADEPARQVPTRPVT PPRSPPVEPARRPSIPSEET PDLGAVPSEIDSADPNRSPS RGPRHLPAHNMSQSESEDDV TDPPVSDQQRSDSLEPRDLL RNSSVESTPGHPNQELSDTL LSNYVPSEIDSDDPNQSPRR GPRHLPAHDMSLSDSMDEET EPDLSDQQRSDLLELRDLLR NSSVETTPKGHPSLRHLPEP KIRAAAFRVNSVIGKIHTNN ITETNALIKAGADLAVRILE VQPRPQRTQRKKDPPWKHRL EKNIAEIRKHLSWISEWRRG NLHDEEKKTLLESRYRCLEV GLTNLEDTLKQRLSAKRSKV RRFEARVAGFHQNQLFNTNQ KRLYQTLRGEETSSDSPNAE ESIRFWSDIWSKEVRHNNTA EWLHDVKEKNVAADPDLTIT |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | SQQLKKQLSKTKNWKAPGPD MVQGYWIKTFTSLHSRIAAQ LNHCLQRGTVPTWMTTGKTV LIQKDKAKGTEVSNYRPITC LPLMWKVLTGIIYERVYQHL DSKKLLPDEQKGCRRNTRGT KDHLLVDKLLTKDARSKKKN LSMAWVDYKKAFDMVPHSWI LECLDIYGIAGNIRNLIATT MPNWKTQLTSANKHLGEVSI KRGIFQGDSLSPLLFVLTMI PLSETLNKAGQGYNYSRTMK LNHLLYMDDLKLYAKSKDQV EQLLNIVHQYSQDIKMQFGV SKCGVLNIERGEVTASEGIT IEEGTIKDIEEAGYKYLGVM EYNTILHRTMKDSIRKEYLT RLRLILKSHLNGGNTIKAIN TWAVPVVRYSAGIINWTKKD CTDMDIKTRKLMTIYRALHP RSCVDRLYINRREGGRGLIS VEDCVEAEKRALSQHFRESD DPWARCLVEAKLLKETETAD QFKERRRLDRTNKWKSMKMS GQYLEAVQDKIVPDSWNWLL RGELKRETEGTILAAQEQAL RTRYIQNKIDKRNVPSTCRI CRSSDETINHVISECGVLAQ KEYKRRHDKVARHLHWTLLR IHNFPVSERWYEHEPAPVVE NEAVQIYWDKRMETDRVLHA NRPDIVVKDKQEKSAKLIDI SIPFDSRIVDKEAEKKEKYR DLAIELQRLWQMKVDVVPVV IGALGAMSKNLKTALRELKC GHLHPGTLQKSALLGTAHII RKVL (SEQ ID NO: 1499) |
| R4 | R4-2_BX | CADV010090 48 | Bursaphelenchus xylophilus | GAGGATCCTGGGTTCCTACT ACCCTGCTCCATCTCCTCGC GATGGATCCTTGGGGAAGTC TCCGGACTGAGCTAAGAGAG CGTTAAAGTAGAGGGTGGCG GCGTAGTGACTTCCAAGTTG CGATGGGCGGAACATCTAC TCTTCTGAGAGAGGGAAAGC CCTATGCGGCGGTAGAAAG GTTGGGCTACGGCAACACTT GCCATGATCAGATTCGATCA AAATTAGCCTCTGGGCTGG CAACCCTACAACGGATTGTA AACTGAACTATGCTATGCAA AATGAAAATAAAAATGGGG GCTTTACAATCTAAGGTGTT GGCAGATACGAAAACTGCC CGTCGATGAGGGTGAGATAA CATCCTACGGAACAGCCCCT GCTGGACCAAACCAATCAT CCACAAATTGGAGGGTTTTC TTGGTAGTTTCCCTTGGCAC GTCTTGTTTCATAAGCCAGA ATAAAAACGATACCATACAG ACATGAGGCTGGGTACCTGC CAGCCGCGACACGGAAAACC GGTAGGTGCAACCGGAGACA GCTAGGGGAAAGAAAATAGT AAAGTGTCGAAAACAAAACA GGTAGCCCCTGGCTAGAGGG AATGGGACATTGTCCGATTA GGTTGCCTTGACCCAATGAA AGCCAACCGGGTTTACATTA TCGGTCTACCAAGGGCAATG ACCAGAGAAACTGCGACTAT | TAACAAGTGTAATAAAAACC ACCCATGCGTAGTAAACCGA TCAATTATCTAGCAAAATCG CAGGTCAGAAGACCAAAGAA CCGACCCAGAGGAATAGGAC CAGAGCTGAAACTCTCAGAT ACGCCAACGGTCCTAATAAA ACGTCGTTAAGTAAAGCATC GTTAAGTACAAAACAAAAGC ACTGTAAACGCGAGGCCCCC TCTTTTGCCAAACTCCGGTAA TCCTCGTAGTACGGTGCTTT TTCCCGCTTCACGAATCAGA ACGCTGCCAGATCTTGTCCG ACATGGGCCTAGGGTTTGG GAGTACCAGCGTGGGCGGA GAGCGTACCTGGGTACACTG CATAATCGGGTCTCAGAAAA CCACCTATGGTTTATTATTC TGTCTCCCATCTGCAGGGTA GCTTTTCGTTGGGCCATAGG AGCCTAGGGGCAAGAGTGCA TGTAGTCTTCAACGGCCATG CCAGGGAAACTTGTGAGAGG TGAGGGATAACTAGCATCAG ATAATATCAGTCATGAAATT AGTAACAACCAACGTTCACC GTCGTTGGCAAAACACCGAC TAACGATGCTAGTTAGAAAG AGTCGGGTCTTCCCAAAGTT AGGTGCTTGCACCGAAGCCG ATCCGCTCTACCCACAGCTC TGCCCAGCGTT (SEQ ID NO: 1378) | MVFNNCKPKHLCPAIRPTGQ QETNGGSEGTAEPTAGPSRP AVSEDAAQPVPLFEEGEYIR AHRDKTCPYCEVLWIGARSS KARSDSWPLCQILYLMKRND DLRGQRTRYPLLESSLRAAG IARTKFAIIKCIRNVLRDRY VPNGPYSEHWKIYRANSGEV PQGATITKGKRSARVAGLPS PSQSGHHTKRIQAGTGIETE TTVTETNTTPEVSHEHRDPC GEPETSAANVDKVTELTEDG SETRGTANVANGGVSVSDPG RKRQSSSQNRGNIETTNPEL VGMWEDMFGVQLDGAMRTTE RPRLPKLKHLSEPERLWIRA KLEQAWLQCVSYDVEQQWLN ANAVLYAAIRSVAASRPCKE AREAQKTWLDNKKKDEAKLR RLIGRISSVHSMPKGDRTPR EKKLVKNITKLKNTHYPDMD WGGLLNHFKVKLSQLKEKIS VRVAEHKRKVNRNAAGQYGK SVAGSAGLAPDVVSATAYWS GLAQPGPKKFKASSPIFQTW KDDVAKNLNTEPVLLYPIIK ECIRKPSPWKAPGPDGIYNY YWQQEFVAQWIQTLVKRTLD IGRFPTALMCGRTVLLFKSG DKSMPQNYRPITCLNGCFKI TNAVLTKVILQRVQDTCALP REQMALKPKVWSCMEAQLRD QALQSEIGDDCKTAWIDFSK AYDSLDHDALRFVIQTIALP AGMEEYLLKSLDSWRTQLVL |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | GCCGTAACCCTTCGCAGATT GCCGATGAGAACCATCGATC GTAAGTCGAAGCCAAGCGGA TTGACCAGTGGAGGGTTATC CCGACAACAGC (SEQ ID NO: 1255) | | SDAGKVVSGKPYPIKRGVLQ GDSLSPALFVLTTSPIVAHL QRTCPTGRIQLYMDDIKLYG KTESDLCMLIKETQRVANKL GLNINLKKCALFGKSIKQSI AGFDPLGDRTYKLGIPQRD VADIKQAYDELKAKTVQTIG ETMACDYLTTRQVINRLNSK IPPVVRFVTQSALCSAPMTR GLYNKITELDNVSRAELRKV LIYKATNVSRFYLATKEGGF GYASLQQVFVEAVVSRAIYC LRAPSLCDIREFILSKFDPV KVARIALARSKIDMDIERMD MASATRTIRQHYQAKWKTLF QQSKLYQKWVQHKIDIPNSS RWLQRGEISPRNCRIAVAVQ DNTLLCRGFVGSKDPNKQCR LCNAGIETASHIVTECSTHR VHMYIERHDSVARNIYAVLA KNCGFWIPHYSQKIPTVKIT KSYELYWNYKFPCTQALEAC RPDIVLIDRAKKRILVVEVA VSYVTRLEQMTQRKLYKYGV NGEYQADGETRGWNICRELV QKYNMRIDLCIVVIGACGEI LPCMVKEIEKISKVSGRQLL ERCQRSAVLGTVRTVRRHLA N (SEQ ID NO: 1500) |
| R4 | R4-2_HG | ABLAO 1000389 | *Heterodera glycines* | TGTGGCGATACTCGGAACCT CCGGGGAGCCTGGTAGGAGT TGGCCTACAGGTCGCGAAAG TCCCTAGGTGCTGCACGGGT TGCGCTAATCCGAGCCCCTT CCGGTGTTGGCTAGCACTGG AGGGGGGGGGTCCAAAGAA TACGTGAAGCGGACCCTGTG TTTTCTCTGACCTCATACGG GTATATCCCGATGATATCTA TACAGTGTTCATTTTCATTT CTTAACCTGCTTTTTCCTCA AGAGAAATATGACCACATTC GTTTGCCATTTCGAAGGTGC GACTTTTGAGGGAGTTCTCA GGGACATCAAGCTGTTCATG GACGGCTTGACGGCTCGTGG CGGCACGCAGCCGCGCGGGC CAGTTAGGGCTGGTGCCAAT GAGGCAGCGAAGAAGTCTCT GAAACGCCAAAAGCAGCGGG AGAAGAGAGAGAAAGCGGGG ACGGGTTAGAGATAATAGCA TGATTGACGGCGAAGCAATA CTTTGACTTCCAGGTACGGA GGACGGCGGCAAAAAGCAAA AAGGGGACGAAACCGATGGC ATTGCCAAAGGGGCCGAAAC CATTGAGCTGGACGCTGATG GGCCGTCTGCCGCGCAAAAG GAGGGGGGAGCCCCTCCGTC TGGGAAGAAGGTGCGGCGCC ATTCGTCCAACAAACCGGAA TAGATCTTGATGATCTCAGC AATTGATCATATTGATCTCT TTTTCCAGTTGTTGCGATAA ATTATCGTGCATTATTTCTT CGATTTCTCCAAAGCTTAAC TCCTTTCCTAATACCTACTC ATGTATACGTTAGTAGGCAT GTTTTATGCAGGTAAAGATA GACCTGGTGCCCCCGGGCGA CTTGGGATGGGATGATGGT | TAGTCGTAGCCCAGATGTCG ACAGCCCCTACACCGGTAGA TGGAAGGAGGTATGTATCTA AGCCCACGGCAAGCCACCAG TGGAAACGGTGACCACCTCT GTTCGCGGAAATGCCCCGTA GAGTATATGAAGGTCGGAGC ATTGAAGCACAAGTGAGAAC CCTGGAAGTATGGTGGTGA GCTGGT AACCTCGAATTCCTCCTATG GGTGCTTGCGCCCGTAGGTC ATTTGTGTATGTAGGGATGG AAGGAATCTCGATAGCGCAA ATCGGGATACCGCACTGGCG ATCATGCTGCCAGTGGGCCC TGCTGAGTTGGGCGGGTTAG CAACCCGTCCAGGGACGCAG ATGCCAAAAGCCTGGTGACA CTCTAAAGGGAGTCTACGGC GACGAGAACATCCCCTAAGT C (SEQ ID NO: 1379) | MRKSFLQHIPELSSHIAMSV PARNYPKMCSLAQGSSGTLS HNGKGVAMHRCPSDDCAGKD PPQRGSQKGNLRSVRWTPSE EKAVFEYWSRLEQHAMLNGS EARGTCAITRSQFLIHWDGE RESRSLSDGVPEYPMRTERA YYERVRLLRQRGWQWDCANE CLVIGQCAEPCRKPNVVAIK ADKGMKRSLVKGKLLSLPHV MGEINQVSVQVEVPLPSVPA SVPQVEGVESKGFTETEPSN KPSLEGNPAEEGLRKPERVN VPVHGIISDSERKDLKDRFW SAYKTAKRSVGFRPALKIEP NRVNRAQWEVLDSCVVEVLK KRETSNGYRGCVLRHLNVAV YAAGYVLAEGNKERRQVIRR QSAEWLLRQKSEINNIRRHI GWITDELTRRRTGKNPTSRQ LSNFAWLQRRYQVLGKPVRE TRDLEVQRERLVSRLRLAQD RINSSMDREERVRKRMLPLR RKLEEPLGDSKLDTKQARTF WASLIGERKEFGKIPELENW AEEVRSKVTDGQGFASDHVD QTVWKKILGKARPLKAPGPD GIPNLLWKRLPSANQALFKW LMGIKRKQLSVPSWLTKGRV VLLPKGGDPVDPANYRPIAC LNTQYKLVTGMVTAWVSEHL TTYSILPIEQRAMVSGTWGC THAMVIDRAITSYAEATGLP LYVGFVDFAKAFDSVSQPWI RYALKVAGVHKRIRCLIGIL MKCWSVRYEVFKSGRVLRSA PLAVKNGVLQGDTLSPLLFC LSVAVVSSAVGSLFDFEVTI PGRGVMQQQNHLFYMDDFKG FAPSEASLTRMLVTLERTAS ALGLKINKRKCALVHPRERE NEETGSDIPVLGLRDTYKYL GIEERFGIVFEDAWDRVRTK |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | TGGCGGAGAGTTCTGATGAC GCCGTAGTTCCGGAGGAACA GTTCCTACTAGTGCCAGCCT GGGCTAGTGGAGCTGGTCTG GCGAGTGCTTTGCTCGTCAG ATAAGGGGTGGTTGGGGTGG TACCTCTGGAATGATGTGTC GGATAAGCACTCTGCCTTAT AAAGCTGTCGTTCTGCCCAG GTTTCTCCTAACCAGGTTGA ACTTGTAATGAGCCTTTGGG TATCTGGTCGGGGTCTGCGC GGGAGATAGCTCGTGAGGAGC TGTTATTACATTATTGGTTG AACGCTTTTGGGTCGTACTG CACAGATAAAT (SEQ ID NO: 1256) | | MFERMRTLLCTEHTFGELRA AFASTIAPVARYLFLNVIVG GPSWSETLTKAKDMDLRIRR LLWERRDNEPGWRFKHCSAD RLYLRVQYGGLGFVSVEDTL SESIIYCWAYVQCRPELELA RELFGTLNRSARSGIKQSIA KGARKVFRSYALLSKNSAQR VSDLDGDASPGFRVGEMIFM EPTRGARAIVKILRKENDSR RLAAWKGRPMGGRVVSLPEL DQVHSYHWLIRARIGRRSFR DCIAAQEGQLKARELMCPHI NAKAKWCRRCGDGRVETEQH ILSGCAWSRTGTMLDRHNGV VRQVHTALCRKYGLPVSSHV VPLHAVIENEHAKILYDVAL HTSPAGVLPREDGSTSYTGL RSTRPDMVIFDKKARTILIV EISVPWRENLVKQELIKWRK YAINSMIEPLELAEAEIPGP NLKHALGLAYGTSFPTVKVV PIVVGSCGEVLPNITKRLSE LGIPKRGIPSLLESIQRAAI IGSGHVIRAHLSVPRSESET (SEQ ID NO: 1501) |
| R4 | R4-2_SRa | CACX0 100200 6 | Strongyloides ratti | CGTCAGAAGAGCAGGTGTTT TTCAAAGCAAAGACTTATTC TACGAAGGGGAAAGATGATC AAACATGCAGATTTGGCTGC AATGAAATAGAATCAAACTA CCATGTGGTGACATCTTGCA AATACCATTCATACACAAGA AGACACGATATGGTTGTGTA CAATATATTAAAAAGACTAA AAGAAAAGTATAAGTTAGAT GGTGATTTACAATATGGTAG ATCAGTATTTAATGGGAAGA AGGAAAAAATTAGGATCAGA TCTGGCCATAAGTTTTTGAC TGAACAACCGTTAGTAAACA ATAAACCGGATATTGTTATA ACGATGAAAGAAGGGAAAAA AAAGATAACGTACATACTAG AGATGTCGATACCACATATC TAGAACTTGAAGATGCAAGA AAGAATAAAGTATAAAAAAT ATTGTGTGAGCTCCATGGTA AAAATAACGAATGATAATGT TGATTCGATAGCTCGTGATT TTAATCTACTAAATTTAATG GAAAGAAAAGAAAGGTGTAA GATAAAGTTTGGATCATTTG TATTTGGCTGTTATGGAGAA TATGTCTTGACTGAATCTGC TCTAAGAACACAGAAAATCC TGATTGAATTGGGATTCTCC AAAAAAGAGATGGATAGCTT GATCAAAGAGTGTTCTTACA GTTAAATGAATGAGACAGCA AGAATTATTATGAAACATCT AGAAGGCGAAAAGAATCAAG ATGAAATCAGCCATTAATAA CTTTTATTTACCCAATTATT TATTGCGTTAACTTGATTAT ATGATATTTATTGTATATTT ATTGTTTAATTTAGTTTCAT AGTACAAATAAAAGAATTA CTACGATTCTTTACTTTTAA GTTCTACGAGAACGTTGTTT TAGAATATTTTAATAATATT TCTACTACAATTAAGTAATT AGAAGAAATCAACGAAAGCA | TAATTAGATTTATATGTGCC ACTTTACCTCAAAGATATAT TAATACTAACTTAATTATAA TTTATTATGAATTATAATAT AATAAGTTTTAAAATAAAA (SEQ ID NO: 1380) | MQKFSVPKDSSQIFLVDSIL NKHICSTKNKVKDVIKRRSI IKTLICAAGLTLRKLVCGKL GNNKYNSKINQLWKKERKII NCIEDLKHLIETNKRRHNFG KRLRNAKVSPSEMLKDYYNK LRYIKNEITACLDEHKKAIL RTKFKLTPSIKIISNIQNHN DEEAELPKEEEFVKYYKELF TNKDGDDKETPHLDNWLKKF SKTLIVDWTINDKEILEALK YCGNFKAPGSDMVMKVCYKW FKSAQNYLIRWIKSTWYGEY TINKKDTNAVTFMIWKRDGK PKNDVKSYRPISCLNCDFKL LNKLIANKIYESIEKILPIN QMAVIKNKHGTCEALLLYKS LVQSMKFRRTKDVKEIWCSW IDFSKCYDSISHKCLKKMIQ SIKAPPIIHKLILDGIDSWN ISICNGKNISKTKIPVKSGI LQGKVASSLYFVLLTGEISY ALNKEEQVPIETITPSNTLK INHISFIDDYQLYATSQKKV EKLTIKLREIAEEMNLKLNP QKCGIYGTDDLGKRLMLKES SLNFPYTSEYKYLGLVENSL DLKDINIQLFKDKILSKYST IFESRLTTHQKRKVFNSTIS PCAAYYLGNLITNKCSIQEL LNECKKFDQMVRNQLVNQNI KKLQVSNSRIYLPKEYNSLG LNEIEIEVAANIIRKACYIK KRETLRGVDKLYIAMSKNGH RNTLSDALYITKKYSNFQIN WNIMGMVKDQNNILLDAKKI IENIKEKRRNLWLEHWKKGN MTYANEAIKKEFHLPDLNID SKYLMLCYAGSEEQUIYNGH VSLVNQSSPSSRLCRKCNKL EETSYHVASVCEFHKKNLHL MRHNSAVYHIITELCRIMKV KCTLRYPEASGIIKSGNMKI AAGVKYTFGTAKIYHNKPDL VWYTPEVIYVIEVSISSLKN AKSQMKMKTARYAVNSTKKL ENFAALNNLKKGENFVEILS |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | GCTAAACTTACTCGCAAAAT TCGTTGATCGAGGCTGGAAT GGCACCAACTAATATACTAA CCAACAATAGAAAAAAAAG AAGAACTTCAGTGGACTTCA AATAAAATAAAATTATTGGT AGAATTGTATGATAAAACTG AGAAAATTTGACTAAAACAA AAAGATTAGAGCAAATATGT CATCATTTTCCTAATCATAC AATTAAAGCGATGATGACGA AATTGAGAGAATTTGAAAGA GAAAAAAGGGAAAATTGTGA AATTAAAATGAGGGAAAATG AGGAAAAACCTGAGGAAAAA TTAAATTTTGACAACTATGA AGAAGCAAAATTGAAAAGAG GAATTAAGTGTAAAAAAGAA GTAAAACCAATTGTTATTGA AAACAAGGATTAGGAATTTT TGAAAACGGAAAAATTATTT CTCAAGTTTGTCAACACAAT CAATTACCAAAGAAAGAAGG GTAAATCAACCAGA (SEQ ID NO: 1257) | | HKANFKRVHFMPLVFCTFGE IPKETMKYLEKLNFSNEKIK TIASPIARYTGRTLKAHFTN (SEQ ID NO: 1502) |
| R4 | R4-3_BX | CADV0 10088 32 | Bursaphelenchus xylophilus | GGGTCCTCGGTTCTTACTAC CGTGCTCCACCTCCTCGCGA TGGACCCTGGGGTAGGCCTC CGGGCTGAGCTAAGCAGAGC ATTAAAGTAAAGAGTGACGG CGCAGTTGCTTCCAAGTTGA GGTGGGGCGGAACATCTACT CTTCTGAGAGAGGGGAAGCC CTATGGCGGCGTTAGAAAGG TTGGACTGCGGCAACACTAG CCATGATCAGATTCGATCAA AATAGCCTCTGGGGCTGGCG ACCCTATAACGGATTGTAAA CTGAACTATGCTAACCTGTC AGTAAAGACAGAACGGGGGC TTTGCAATCTAAGGTGTTGG CAGACCACTAAAACTGCCCT TTGATGAGGGTGAGATAACA TCCTACGGAACAGCCCCTGC TGATCCAAACAAAATCATCC ACAAATCGGAGGGTTTTCTT GGTAGTTTCCCTTGGCACGT CTTGTTTCAAAAGCCAGAAT ATAAAACAATACCGAAGTAC AGAATGGCTGGAACCTAACA GCCATGGCACAGAAAACCGG TGGGTGCACACCGGAGACAG CAGGGGAAAGATTGCAAGT GCCGTAAATAAAGATGGTAG CTCTCTGACCTGAGGGAATG GGACACTGTCCGATTAATGC CTTATCCCGAAGACGGTCAA GGTTCTATCTTATCGGTCTC CAAAGGGCTCTGGCCATAGA AGCTGCGAGGAAGCCGTAAC CCTACGCAGATTGCCGCCGT GC (SEQ ID NO: 1258) | TGAGACCACCCATGCGCAGA GTATCCGAATCAGTGAAAGT CCAAGTTTCAGGACAGAAAC GTCAGATAAGTCCAAGAGAA ACGAGAAAACAAGTTCAAGT ATGCAAGAGTTAATCAATAA GAGAGTACCGTAAATGTATG ACCCCCCCCTTTGCCAAGTC GACAACTGTCATGCAGGTGT CTCTCTTTTCACCCGCCATA TGGACCAAACGCTATCCAGC CTCGCTCAGAAGAGCCTTAG GGCTGGGGAGTACCACATGT GGCGGAAACTGAATCTGGAT GCGATGCATACCGGGAGCGC AGCGAAATACTTAACGCTG GTGCACCTCCTGCTATCGTA GTACTTCCTAGATAGATGAG QTACTTCCTAGATAGATGAG TAGGGTGGGCTAAAGGTAGT CGTCTTCAATGGCAATACCG AGGGGTCTCGTGACAGGTGA GGGATAACTAGTATCAGATA ATATCAGTCATGAAATTAGC SFPEMDWHGFLNHFKAKLDL AACAACCAACGTCACCGTCG TTGGCAAAACACCGACTAAC GATGCTAGTTAGAAAGAGTC GGGTCTTCCCAAAGTTAGGT GCTTGCACCGAAGCCGATCC GCTCTACCCACAGCTCTGCC CAGCGTT (SEQ ID NO: 1381) | MISRSQADRPVEGQPVTAMS FHNLEPNNLYPENLRPTGSQ DANRGVADIAEEVTGPSGLV TNEEAARAPPLFVEGEYKRA HCGGGKCHYCRVLWIGARSS KARTDSWNLCEILFLINKCM ELGNVRRIYSPLESSLKEAG INRTRHAIVKCRLAVMRDRF VDNAPYSEHWRLYNACAENR AVVVPMDSATTVKKRTARQA GLESPSQIGVAGKRVHEAET GTDRINAVIETNTTPLEDID LSPETPEGLAELPSTVEIME LTEDGSRSRGTANDADGGVS ISDPLRNRPSSSQESRNVPE QVDPDGELVWESLYGAQLRG AMRTTDRPRLPKLTKFSAAE QLWIKSKVEKARLECVSYGI EQQWLRASAVLYATIKTVAA CRPYNKAREAHKVWLENKRA EEKRVRRIIGRIETVRTMPK GKRTDKQIRLARKINRLKRV SFPEMDWHGFLNHFKAKLDL LKKLISVRVAEHERKISRKI AGTYGKSVSGQSGFTPDVVA ATTFWSGLAQPGPKKFKKNS LIFQTWKDSVVENMNTEPVL LHPLIIECMNKPSPFKATGP DGIFNSYWRQGFIANWVKSL IQRTIQTGEFPASLMCGRTV LLYKNGDTAKPENYRPITCL NGCFKMTNAVITKVIVQRVQ DTCALPGEQMALKPKVWACM EAQLRDQALQSEIGNDCKTA WIDFSKAYDSLDHDAIRFVI ETLALPDGMEKYLLKSLESW KTKLVLSNRGKVATGRPYKI KRGVLQGDSLSPALFVIATS PIVSHLKRVCPSGRIQLYMD DIKLYGKSETELRMLIKEVQ KVANKLGLQMNLKKCSTYGA GLTESIAGFDPLGDRAYKYL GVPQRSVADTNLAFGELEGK VIRSIEETMACEYLTMRQVV TRLNSVIGPLVRFVAQSVLT SQAKVSWIYNKISDLDSKIR AKLAQTGLRYKKSNVARLYL SKSKNGIGLVNVQQVLVEAL |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | VSRAIYCLRAPSLVEIREHI LTAEFDPVGAARTVLRRSRI QLEIERVEMASAISAIKTNY QARWMTKFTQSKLYQKWVHH DIDLANSNLWLERGEISPQN ARIAVAAQDNTLLCRGFVGN RESEKQCRMCNMGIETCSHI LTECSYHRAHMYIERHDSVA RNIYAVLAKDHGLWIPHYSQ PVSSVTKTPTCELYWNYKFP CTRALEACRPDIVLIDRAKR TILIVEVAVSYVTRLKQMVS RKVYKYGVNGEKGADGESRG WNMIRELSEVYNMKVNLCAV VIGASGEVLPCTVKAIQSIS SKTSSRQLLERCQRSAVLGS TRVVKRHLAEFH (SEQ ID NO: 1503) |
| R4 | R4-4_BX | . | Bursaphelenchus xylophilus | TGCCAGCGGTGTTGATTAGG TCCAAGTTCTTTGGCCAAAG ATCCGCCCTCGGTTTAGCAG TACCGAACGAGTATACCTTC AAGTGGTGGCACTGAATTAG ACTGAATACTCTGAACTGTA GACTTTTGTGCAACTGTATA TGGTGTGGAAGACTTGTTTG TACCACTATCAGCTTTATTG GGGCTCGTTACTGTTTCATA CAGGTAGATGTCCCCTTTAG AGATTTCCCTGCAGTTTGCG CTCCAAGTCGCTAGCCTCTT GCGTGTAGTCAAAGGAATAC ATTCGCCGTCGGTGACAGGG CTATACCGGCGACTACGGA CTTGTTTATTACGTAGTGCA GCCTCGTTTAAGACGAATGT GAAAAGAAGGTGTGATTACT AAGCGTTATGAGTCGGGTTA TCTGGAAACTCCGCCCCGCC GCAATGGCTTCAAGGGTCAA ACTGCTAACATTTTAAACCA ATATTTGGCAGCAGCAGACT ATGATGTCAGAGTGCCGGGG GTCTATCGATATAAGACTGA AAGCGATAGACGTGGAGTGA AAGGATTCCCTTTGTTAAGA GAATCGGTAGAATTCACTTT TTACTTATTCAAGAACTTAA CAGCAACAAGCACTCGCGAG GATTACCGCCCAGATTCGG TCGGCGGTACTTCACCTGCT TTCTTCCACTTTCGGAATCT GGCATCCTGGCTTTCAGTGT GGTGATGGCCGGCTTGAGTT TTCTTGAGTCGTGCGAGTGC CTCATCTGGGACGTCCGGAC CGATTGATGGAGTCTGCAGT GGACGAGGACTTGATGGACC GTAACCATAGTATATCCCTC ATGCGTCTTCTCGACTCGAG GGGGTAGCTTGCACTACCCA CCCTTCTCTTCTCCGATTGG GATTTAGACCTAGCCCTCTG GTGTGTCTCGACCCGCGATA TCAGATTCCTGAATCGACTG TGAGAAATGTCTACGCGCAA AGATCGACCCATTGCCACCC GGCTATGTGGATCGGGCTGT TGACTGCTTATCTCCGGCTT TAATCGCTTGAGGAAAGGGG GGTGTCGCCCGAAAGGGTTA CGCGATCATCCGATTCCTAC CGTAAAAACGTAGTTGAAGT | TAATTAGGCAGTGCTCCTAG CGGAGTGCCGTGAAGTGGTG TCAGTACCCGTCGTGTGGAA AGCCCAGGAGGGGTTAGTACC GACAGTGGGAAACCCGCTGC ACGCAACCTAAAGACATTTG CCCTTCGGGGGAGAGGTATG AGACCACACTAGTCATGGTT GCTTGCGCAAGCATGACTCA TTCATTGTAAGTTCGTATTA TGAGGCCTCGCGGAATGCGA AAGTCCAAGAGCGCCAACTT GTCTCTTTGGGAGGTTCCTC CGGGTTCCTTAGGGTTGGCG TACCATGCTTCGTGTGAGAC CTAGGCCGCTTGGACCTAGA GTTAAGCTGTTGCATGTTTG AGGATGCCTTAGGCGGACGC CATG (SEQ ID NO: 1382) | MEILWEDLRLKIEDRYGVTL PQRSASSLKNQYPKVILRGL PDSGLPWAGVQVNDTGQVVV VDHABAATLRGSSPAAVDGE AEEPVVPPLPAAEVVESAAD AAVPDPQSEIVADQGVETRP VENPPANSRETETEPVEVEP YLEGQYKFFVSKILGKSMWR KPIKYPRRVPETLWRQANEL IERSIRQGEVSIQSLNCMVY AAGCAVKSSLDKKDQEAKRR ESEWYACRKAEIKALERYLN FIDLELKRRSASRPLTSRQR QNLGVLITKYGRARVRSGVR LSELQAMLRDALVGIRKCMA KRSADKKRKQGKFVPIQRYL EPSSAEPRLSPDTVRAYWND IVGSSQQSTSDSTIQDWSSN LSVPSQELNASKIMGWWRAA VSKSKPNKAAGPDGIPGVLW KRFRSASEWVCTWLYRLLQK RRIITPRWLSVGRVVLLPKK GPLEDPANYRPIACLNTVYK LITSVVEMAVREQIQACPGL VPYEQIANRKGVWGCTHASI VDRMITGASREGKGGGFPDL RVLFYDCKKAFDSVNRDHMF AVLRVANVNVKVVHLLHTLS QQWCVRYELRRNNRVERSSP LRVKRGLLQGDTLSPTWFCL CMAPISASIKTLNPGPTLRP NMGNGRNRGQVAIQVSHVFY MDDLKVYCPRVADQRRMEQN IPQLFGEIGLSINASKSAAA AAVGRYVESELPVLGTKDEY KYLGIESGFVVNEVAALDRM QAVLLNRVEAILSVKEHTVG QRRDAIRAKAIPGGAYILGH IILSDLDPRGAAERMRRLDI EIRRLVKSAGILHDKCSTAR IHLSCEQGGLAWPSMERAYY VAVAYSASYLLTSQDETISR ARDYFVSGRLSNKFTVYKHL TSIVDSLGLSVELPDPNGLP TGQPSVLARTIARAIDAKLE AQWKETLLTYQRAGRVERAD PTVVDHANSYHWLRKAWINE KAYQHAVSMEGTLLEGVNP HGVLTMCRACKAPSASIAHI ITGCAELRKSHMKVRHDGVT RWLYNALTEVDGSLPKFHYT QQIPAEMRGERLTVRYDSDI VTPNKPRHNRPDLVVFDSTR KVIYIVEVSVTWLSVLQKQY DNKLNRYAVNSNHEFSESIP |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | AGGATTGAACCTGAGTACCA AGTGAAAAGAGTGGCTATAA TGCTCCATGGTATACCCTAG GGATAACCGTGTCGAGCGCA CTGCTCAATACCCTGATTTG TTAGTGTAGGTATGTCTAGT GGCTGCCTAGGCAGATTCGC CTATTCACTACGTAAAATCT GGGTGAGTACCATAAGAACC TCCTGTAGGGCCAGGAGTCA AACTAGTCCAGGTTCGGTAT GCTTCGGTATACTCTCTCAC GGGCTAGTCACCTAAGAGTT AAGAACCGCCTTTTTCTGCA CTGTGAATAGAAAAAGAAGG GCGGGAGAATATACGGGCGA GGTAAGCACGTCGGAACGGG GTGTGCCCAACTCGTACCGT ACGCCCGGACAAGGACCATC TTTCGTACCCCGTTCACCCG GCACAAGTCCGATTGTCTCT CCCGAGAGGCGTCGGCGGAG GTTGGCTAACGCCGTCTCTC CAACCATCGGTTTGGGTTTA AGTAACGCCCCAGTGGCCGG TAGCCAAACTGATGGAGGCA GAAATGCCGGTCCGTTGCTA AATGCGGGAACGGACCAAAA CGCCGGTGTGGTGGATACAG GTGGAAGAGTCTTTTGGTCT ACGCAAGAAAAGACCAGGCT CAAGTACGAATACGACCGTC TTCGTGAACGACGCCGTCGA GACAAAGTTCGAAATCCTAC GGTCGATAAGGCC (SEQ ID NO: 1259) | | YPPGVNLANEIRVLYPQFTG GVKVFPMIISPTGEVHMQFV PHLAELLENPNIPRILEKIQ RSVVLGTDYIIRSYFAM (SEQ ID NO: 1504) |
| R4 | R4_AL | U29445 | Ascaris lumbricoides | GGGGCCGGTGGGTTACTCA CTTCTGACCCACCACCAACG GAACGAGGGAAAGCAGAGCT GGGGCCCTCTTCCGATTGGC ATGGAACCGACCTCCACGTG GTGGCCCTGGGCAACGGAAT TCAAGAGAGGATTTAATCCT CTCTATCATTTGCAAGATGC ATGAGATCGAGGTATCCGGC AAACAGGTTCCAAGTGAGCA CCTTTCCCATAGCTGGGAAT ATGGGTTAGGCGTCCTCTGA CATATAAGAGGAATCAGACT CGTTCGCGCCCGGTCATTAA CATCGATCAGCGGGAGGGCC GGACTGAAGTAAATTTCCTG TTGGCCCGAGTGCAGGTGGA GCTCGGACCCGAAAACGAT CCCTAAGAGGACCACAACCC GAAGGGATGGACGCAGTCGC CCCGGCACGTTTGGTGTTGG TTATCCTGGAGTGTTGTGGG ACGAATAGCT (SEQ ID NO: 1260) | TAGTCGCTAAGGGGTCCGGA AATGGTCCGGTCCTGCGCTA CCCGGTTCTGGTAGCACGTT CAAGCGCTCAATCGCCTGCC TTGTAGGCAGTCCATCTGTG GAAGTCGCGCTCTTGATACA GATGTGGACGGATGGAAGCA GATGATAGAGCCGGTGACGG CCCTACTAGCCAAACGC (SEQ ID NO: 1383) | MPCSTNSFFERGTPEPHREP ISGTDSSESLGMGTHRSPRL NDDEVINGPKGHESDPVHVV RAPRTLHPRRLELPIGVNNL GEASQLRQDSAIAEEAQLES TENHDGRRPPLRGGRKLWSE KEIATLRRLCEAYGNRQVCW KEVQRKFADFHEERTVAALA TKWGALKRPRAPMVGAPPTP DHDPERGPAGEGDGGTTSQE NVPTDDPIPANGPTEGKESD VRPAVACRCTEPEEQLMESD VRPPAVVRLADPEQHTMKSG VKPVALDGSADLEERPKEKD IEQMGVDFEGEPRFRAFRKA FYGYFRWAVNSFDREPVKRV RRDCPKVFYAYADYLIATGS SKALGPNQSRIGRLNGLVYA AARTIHQFWREEVGHRQQGE KGWYTKTKATREDLQMLISM MESELARRKEKRKPGAKELE NIHKLVARLGTRSTSGIVRR LEMTRQRLKLLEDRISLHEQ EKRRKRLRKQFAETPSLKLL TKGAKDRGDTMVTMKSVMDF WRPIIGRRVTSNPDQLQVLR DWRDEQKKAYPADLDLEKAD LEEKYEGAIRRIQPWKAPGP DGLHAHWWKALPSAKRLLGE LVVDWLTTGKVTTGWMCRGR TILIPKKGDRGDPSNYRPIT CLNTCYKVLTSVMNSVILSH LSRGEALPMNQRAMRKREWG CTHAMVLDRAMVMDAMAQKK HSLSVAWLDYRKAYDSVSHE YIRWAINSVNIPRSVQLTLK RLMSDWETRFESTQCRPKLR |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | SDKMKVLNGIFQGDSLSPTL FVLCIAPISYALNKGVGQCQ SSSGWSAGYGFEIGHQFYMD DLKLYARTPAMLDSQIQVVS EVSEAMGLHLNLSKCAKAHY APHGAGGAQEAVEGAEGSRK GEIPILGLRSTYKYLGVEQR LLPMEVALKEFEDKFMDRAE TIFASELTWGQMATAYNTIA IAGLRYVYSNTNGASPKLLE ALKRAATLDTRIRDLLRRHK CRFRNSFVERLYIPRECGGY GLKSVEDTLRESILATWSYI ATNPHLAGQQYFFERLAARG KRTPMADGVKILLDLGVEPQ VDLKRRTVTVDGIVFEDPTK LHRYLVGKLLKARTEARIRR WKEASLAGRLVNDTSIDMRL SCLWMKKGFVSARNLRDALA VQEGSLLTRACPALKGKGGQ EVCRCCHAAPETAEHITSAC RYWLPSLYVERHDSVARNLY YVICCRYGITPVHYSNRVSP LSENSQCRVLWNMDMQTRTP MKHRKPDIVVFDLKREKILM FEVSIAHASGLLKQREIKIN RYTVNSEELPDETITPYPPG PNLAADLAATYGWQVEFAPV VVGTCGEHVPAVKEDLQRTL DLKPHQVEALLERISRSAVI GTARVVRAHLACS (SEQ ID NO: 1505) |
| R4 | R4_H_mel | . | Heliconius melpomene | ATAAATAATAATAATAATAA TAATAATAAGCCCCCTAAAA TCCAACCATACGTCCGAGTC GAACATCTGATTCTCGTGGG GGGCGGACACGTGAAAATAA (SEQ ID NO: 1261) | TAACTTATTGTCAGAATTCC TTACTAGTAATAATAATTAT CGCTGAAAATCTCCACCCAA ATATTGCTTGGCTATATGCT CGCAATTTTTGGTTAACGTA CCCCAATGATTTGGGAGAAC AAAAATGGTAAAACTATAAT AATAATAATTATATTAATAT (SEQ ID NO: 1384) | ITYTANMALVTLFPMENMENK RYNLRPLPGGRRGASGANAG CHSMRTVGDGGLSRRVPLEK NVTAEQSSSPLTSSSSHSPV SSIPSPSSTRTLLNSPNSSP TSSHSSLVIRSADVVQEALA NYPAPTAGSIRARKKWTDIM NRYIWRTYLIITKCETTLLN NYLEPLHQEFSSKFPEMQVT RQRIGDQRRAIIRNKLLSDD TLAQILIEVKELLQIGDQPL TQNNIHSTQLSHSNTRIKWS NELNEEIVKCYFEVTLLEVN KTSYRKNLYSLFISRNPHLS HLTEQRIADQRRLIFMNKSV HNDRIIELKREVEIKLANSN SLTKNITESNSPSSQTNEIN DSAYVQSNLQPVEPLDQHCI NRHNLIEKHYVEQEFNNALI QFNNTNPETRPYIPRQKSSR KFSQIVSFLNSEVLPKHLNN ELDFNALHNIIYTAXYTASL CNGTKFSFIDNYRPRNSKPS WQRRLESRIDKYRLQIGRLT QYISGNRNRKILKTVEEIKT QYKIHSHHEEPNTELPHFLD TLKQKLNATSNRLRRYLTCT KRKQQNNTFVNNEKHFYRTL SSTNQNTTTQLXEHPTENNL QQYWANIWETSIEHNADAEW LNKIPDXEINXMKFKDISIE TFNQUIQRTHNWKAPGTDNI HNYWYKKLTCTHSLLLKHIN QFIQSPCTLPLFITNGITYM LPKGLDPTNPANYRPITCLQ TIYKIITACITDIIYKHIDQ NNILAEQQKGCRKNSQGCKE QLTIDAIVMKQAHNKNXNTM YIDYRKAFDSVPHSWLLYIL KKYKIHPILITFLSSVMLSW KTRLKLINNNETLITDWIKI |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | QRGIFQGDALSPLWFCLALN PLSELLNNTNTGFKLKHNNT YHIISHLMYMDDIKLYASNN KELKILADLTQSFSTDIRME FGIEKCKVHSIKRGKSQQNT YILNTGEQIESMDENSTYKY LGFQQAKQIQQKQTKIELTN KFKFRLNQILRSQLNSRNII KAINTYAIPILTYSFAIINW SQTDLSNLQRIINTHMTTHR KHHPKSCIQRLTISRLDGGR GLIDIRNLHNNLVTKFRNYF YAKAEISELHKFIVNIDNKY TPLNLNDRNIQLNQTLITKQ QKIEAWSLKSLHGRHLADLS QTHVDKVASNEWLRRGDLFP ETEAFMMAIQDQVIDTRNYQ KHIIKRPNMVNDLCRRCYSS PETIQHITGACKTIVQTDYK HRHDQVAAIIHQHLAFKHSL ITQAQKTPYYKYSPQAILES TNFKLYWDRTIITDKTVHYN RPDILLHDKVKXSVYLIDIA IPNTHNLASTFSNKIDKYTD LTIELKSQWKVQSVTTVPIV LSTTGVVPHTLHTSLETLGI HRLSYILLQKAAILNTCRIV RKFLSSNN (SEQ ID NO: 1506) |
| R4 | Rex6 | | Takifugu rubripes | TTCTATGCGCCTTATGCGAC TGGATAGGCCAGTTGGTTTAC GCCGCTGACTTTGGTGCGGA AGGTTGTCGGTTCGAATCCA GGCGAGCCCTTAGGCAAGGC TCCTTACGCATATATGCCTA CACCTCGGT (SEQ ID NO: 1262) | TAGAGGACCCGAGTCTGAAG GAAGGAGGCACCGCCCAGGA GGGCGAGGAAGAGATTTTTT TTTATATATATATATATATA TATA (SEQ ID NO: 1385) | MSGTXTDRVIPARTSPGSTR SASGVGEPGPPDVKLATGTR HSWSRAENVVLMECYYGSNP SERGYMQRMWEKWVLRNPTS SLTKKQLLAQCSNIRNKKLL SQLEIDEARRCASPTVQICY GKGEPGRQVSXGVISSSPPN IEIGYKAPMTDGLGTRAADL RERIMKSWGNSTTSLPRLTH KVPDQSLLEDMNTALSTIPT TTITETNQLMYAAATVILQM LGYKMKSMNSQKEQMAPWRR RLEAKIMATRREVSLLTELS RGVNLRTEXPKKYNKLSTTE ALETAKQRLTALATRLKRYT REVEARRINKVFSTNPAKVY SQWQGNKMTTDPPRAETEQY WKSIWEKEATHNTXAQWLQD LQTEHSQLPEQDPVVITLAD IQTRVSKMKSWTAPGPDKIH AYWLKKLTALHERLAAQMNQ LLTSGNHPEWLTQGRTVLIM KDPQKGTIPSNYRPITCLST TWKLLSGIIAAKISRHMDQY MSRAQKGIGNNTRGAKHQLL VDRAIAQDCRTRHTNLCTAW IDYKKAYDSMPHTWILECLK LYNINRTLREFIQNSMKLWN TTLEANSKPIARVSIRCGIY QGDALSPLLFCIGLNPLSQI ITKSGYGYQFRSGTTVSHLL YMDDIKLYAKNERDIDSLIH LTRIYSKDIGMSFGLDKCGR MISRRGKVIATDGVELPEGN ITDVQDSYKYLGIPQANGNH EEAARRSATAKYLQRLRQVL KSQLNGKNKIQAINTYALPV IRYPAGIIPWPLEEIQATDI KTRKLNGKHKIQAINTYALP VIRYPAGIIPWPLEEIQATD IKTRKLLTMHGGFHPKSSVL RLYTKRKEGGRGLVSVRTTV QEETTSLREYIKKMAPTDRL LSECLRQQKPTKEEEPEGLS |

TABLE 4-continued

Exemplary Retrotransposon Sequences

| 1. Family | 2. Element | 3. Accession | 4. Organism | 5. Predicted 5'UTR | 6. Predicted 3'UTR | 7. Predicted Amino Acid Sequence |
|---|---|---|---|---|---|---|
| | | | | | | WKDKPLHGMYHRQIEEVADI EKTYQWLEKAGLKDSTEALL MAAQEQALSTRAIEARVYHT RQDPRCRLCGDAPETVQHIT AGCKMLAGKAYMERHNQVAG IVYRNICTEYGLEVPGSRWE TPPKVLENKQAKILWDFQIQ TDKMVVANQPDIVVVDKHQK TVVVIDVAIPSDSNIRKKEH EKLEKYQGLKEEMERMWGMK ATVVPVVIGTLGAVTPKLSR WLQQIPGTTSEISVQKSAVL GTAKILRRTLRLPGLW (SEQ ID NO: 1507) |

TABLE 5

Exemplary monomeric retroviral reverse transcriptases and their RT domain signatures

| Name | Accession | Organism | Sequence | RT Signatures |
|---|---|---|---|---|
| Q4VFZ2_9 GAMR-residues only | Q4VFZ2 | Porcine endogenous retrovirus | MGATGQQQYPWTTRRTVDLGVGRVT HSFLVIPECPAPLLGRDLLTKMGAQISF EQGKPEVSANNKPITVLTLQLDDEYRL YSPLVKPDQNIQFWLEQFPQAWAETA GMGLAKQVPPQVIQLKASATPVSVRQ YPLSKEAQEGIRPHVQRLIQQGILVPVQ SPWNTPLLPVRKPGTNDYRPVQDLRE VNKRVQDIHPTVPNPYNLLCALPPQRS WYTVLDLKDAFFCLRLHPTSQPLFAFE WRDPGTGRTGQLTWTRLPQGFKNSPTI FDEALHRDLANFRIQHPQVTLLQYVDD LLLAGATKQDCLEGTKALLLELSDLGY RASAKKAQICRREVTYLGYSLRDGQR WLTEARKKTVVQIPAPTTAKQVREFLG TAGFCRLWIPGFATLAAPLYPLTKEKG EFSWAPEHQKAFDAIKKALLSAPALAL PDVTKPFTLYVDERKGVARGVLTQTL GPWRRPVAYLSKKLDPVASGWPVCLK AIAAVAILVKDADKLTLGQNITVIAPH ALENIVRQPPDRWMTNARMTHYQSLL LTERVTFAPPAALNPATLLPEETDEPVT HDCHQLLIEETGVRKDLTDIPLTGEVLT WFTDGSSYVVEGKRMAGAAVVDGTR TIWASSLPEGTSAQKAELMALTQALRL AEGKSINIYTDSRYAFATAHVHGAIYK QRGLLTSAGREIKNKEEILSLLEALHLP KRLAIIHCPGHQKAKDPISRGNQMADR VAKQAAQGVNLLPMIETPKAPEPGRQ YTLEDWQEIKKIDQFSETPEGTCYTSD GKEILPHKEGLEYVQQIHRLTHLGTKH LQQLVRTSPYHVLRLPGVADSVVKHC VPCQLVNANPSRIPPGKRLRGSHPGAH WEVDFTEVKPAKYGNKYLLVFVDTFS GWVEAYPTKKETSTVVAKKILEEIFPR FGIPKVIGSDNGPAFVAQVSQGLAKILG IDWKLHCAYRPQSSGQVERMNRTIKET LTKLTAETGVNDWIALLPFVLFRVRNT PGQFGLTPYELLYGGPPPLVEIASVHSA DVLLSQPLFSRLKALEWVRQRAWRQL REAYSGGGDLQIPHRFQVGDSVYVRR HRAGNLETRWKGPYHVLLTTPTAVKV EGISTWIHASHVKPAPPPDSGWKAEKT ENPLKLRLHRVVPYSVNNFSS (SEQ ID NO: 1559) | IPR043502, SSF56672, IPR000477, PF00078, cd03715 |

TABLE 5-continued

Exemplary monomeric retroviral reverse transcriptases and their RT domain signatures

| Name | Accession | Organism | Sequence | RT Signatures |
|---|---|---|---|---|
| POL_SFV1-residues only | P23074 | Simian foamy virus type 1 | MDPLQLLQPLEAEIKGTKLKAHWDSG ATITCVPEAFLEDERPIQTMLIKTIHGEK QQDVYYLTFKVQGRKVEAEVLASPYD YILLNPSDVPWLMKKPLQLTVLVPLHE YQERLLQQTALPKEQKELLQKLFLKY DALWQHWENQVGHRRIKPHNIATGTL APRPQKQYPINPKAKPSIQIVIDDLLKQ GVLIQQNSTMNTPVYPVPKPDGKWRM VLDYREVNKTIPLIAAQNQHSAGILSSI YRGKYKTTLDLTNGFWAHPITPESYW LTAFTWQGKQYCWTRLPQGFLNSPAL FTADVVDLLKEIPNVQAYVDDIYISHD DPQEHLEQLEKIFSILLNAGYVVSLKKS EIAQREVEFLGFNITKEGRGLTDTFKQK LLNITPPKDLKQLQSILGLLNFARNFIPN YSELVKPLYTIVANANGKFISWTEDNS NQLQHIISVLNQADNLEERNPETRLIIK VNSSPSAGYIRYYNEGSKRPIMYVNYIF SKAEAKFTQTEKLLTTMHKGLIKAMD LAMGQEILVYSPIVSMTKIQRTPLPERK ALPVRWITWMTYLEDPRIQFHYDKSLP ELQQIPNVTEDVIAKTKHPSEFAMVFY TDGSAIKHPDVNKSHSAGMGIAQVQFI PEYKIVHQWSIPLGDHTAQLAEIAAVE FACKKALKISGPVLIVTDSFYVAESAN KELPYWKSNGFLNNKKKPLRHVSKW KSIAECLQLKPDIIIMHEKGHQQPMTTL HTEGNNLADKLATQGSYVVHCNTTPS LDAELDQLLQGHYPPGYPKQYKYTLE ENKLIVERPNGIRIVPPKADREKIISTAH NIAHTGRDATFLKVSSKYWWPNLRKD VVKSIRQCKQCLVTNATNLTSPPILRPV KPLKPFDKFYIDYIGPLPPSNGYLHVLV VVDSMTGFVWLYPTKAPSTSATVKAL NMLTSIAIPKVLHSDQGAAFTSSTFAD WAKEKGIQLEFSTPYHPQSSGKVERKN SDIKRLLTKLLIGRPAKWYDLLPVVQL ALNNSYSPSSKYTPHQLLFGVDSNTPF ANSDTLDLSREEELSLLQEIRSSLHQPT SPPASSRSWSPSVGQLVQERVARPASL RPRWHKPTAILEVVNPRTVIILDHLGN RRTVSVDNLKLTAYQDNGTSNDSGTM ALMEEDESSTSST<br>(SEQ ID NO: 1560) | IPR043502, SSF56672, IPR000477, PF00078 |
| POL_MPMV-residues only | P07572 | Mason-Pfizer monkey virus | MGQELSQHERYVEQLKQALKTRGVK VKYADLLKFFDFVKDTCPWFPQEGTID IKRWRRVGDCFQDYYNTFGPEKVPVT AFSYWNLIKELIDKKEVNPQVMAAVA QTEEILKSNSQTDLTKTSQNPDLDLISL DSDDEGAKSSSLQDKGLSSTKKPKRFP VLLTAQTSKDPEDPNPSEVDWDGLED EAAKYHNPDWPPFLTRPPPYNKATPSA PTVMAVVNPKEELKEKIAQLEEQIKLE ELHQALISKLQKLKTGNETVTHPDTAG GLSRTPHWPGQHIPKGKCCASREKEEQ IPKDIFPVTETVDGQGQAWRHHNGFDF AVIKELKTAASQYGATAPYTLAIVESV ADNWLTPTDWNTLVRAVLSGGDHLL WKSEFFENCRDTAKRNQQAGNGWDF DMLTGSGNYSSTDAQMQYDPGLFAQI QAAATKAWRKLPVKGDPGASLTGVK QGPDEPFADFVHRLITTAGRIFGSAEAG VDYVKQLAYENANPACQAAIRPYRKK TDLTGYIRLCSDIGPSYQQGLAMAAAF SGQTVKDFLNNKNKEKGGCCFKCGKK GHFAKNCHEHAHNNAEPKVPGLCPRC KRGKHWANECKSKTDNQGNPIPPHQG NRVEGPAPGPETSLWGSQLCSSQQKQP ISKLTRATPGSAGLDLCSTSHTVLTPEM GPQALSTGIYGPLPPNTFGLILGRSSITM KGLQVYPGVIDNDYTGEIKIMAKAVN NIVTVSQGNRIAQLILLPLIETDNKVQQ | IPR043502, SSF56672, IPR000477, PF00078, cd01645, PF06817, IPR010661 |

TABLE 5-continued

Exemplary monomeric retroviral reverse transcriptases and their RT domain signatures

| Name | Accession | Organism | Sequence | RT Signatures |
|---|---|---|---|---|
| | | | PYRGQGSFGSSDIYWVQPITCQKPSLTL WLDDKMFTGLIDTGADVTIIKLEDWPP NWPITDTLTNLRGIGQSNNPKQSSKYL TWRDKENNSGLIKPFVIPNLPVNLWGR DLLSQMKIMMCSPNDIVTAQMLAQGY SPGKGLGKKENGILHPIPNQGQSNKKG FGNFLTAAIDILAPQQCAEPITWKSDEP VWVDQWPLTNDKLAAAQQLVQEQLE AGHITESSSPWNTPIFVIKKKSGKWRLL QDLRAVNATMVLMGALQPGLPSPVAI PQGYLKIIIDLKDCFFSIPLHPSDQKRFA FSLPSTNFKEPMQRFQWKVLPQGMAN SPTLCQKYVATAIHKVRHAWKQMYII HYMDDILIAGKDGQQVLQCFDQLKQE LTAAGLHIAPEKVQLQDPYTYLGFELN GPKITNQKAVIRKDKLQTLNDFQKLLG DINWLRPYLKLTTGDLKPLFDTLKGDS DPNSHRSLSKEALASLEKVETAIAEQF VTHINYSLPLIFLIFNTALTPTGLFWQD NPIMWIHLPASPKKVLLPYYDAIADLII LGRDHSKKYFGIEPSTIIQPYSKSQIDW LMQNTEMWPIACASFVGILDNHYPPN KLIQFCKLHTFVFPQIISKTPLNNALLVF TDGSSTGMAAYTLTDTTIKFQTNLNSA QLVELQALIAVLSAFPNQPLNIYTDSAY LAHSIPLLETVAQIKHISETAKLFLQCQ QLIYNRSIPFYIGHVRAHSGLPGPIAQG NQRADLATKIVASNINTNLESAQNAHT LHHLNAQTLRLMFNIPREQARQIVKQC PICVTYLPVPHLGVNPRGLFPNMIWQM DVTHYSEFGNLKYIHVSIDTFSGFLLAT LQTGETTKHVITHLLHCFSIIGLPKQIKT DNGPGYTSKNFQEFCSTLQIKHITGIPY NPQGQGIVERAHLSLKTTIEKIKKGEW YPRKGTPRNILNHALFILNFLNLDDQN KSAADRFWHNNPKKQFAMVKWKDPL DNTWHGPDPVLIWGRGSVCVYSQTYD AARWLPERLVRQVSNNNQSRE (SEQ ID NO: 1561) | |
| POL_MMTVB-residues only | P03365 | Mouse mammary tumor virus | MGVSGSKGQKLFVSVLQRLLSERGLH VKESSAIEFYQFLIKVSPWFPEEGGLNL QDWKRVGREMKRYAAEHGTDSIPKQ AYPIWLQLREILTEQSDLVLLSAEAKSV TEEELEEGLTGLLSTSSQEKTYGTRGT AYAEIDTEVDKLSEHIYDEPYEEKEKA DKNEEKDHVRKIKKVVQRKENSEGKR KEKDSKAFLATDWNDDDLSPEDWDD LEEQAAHYHDDDELILPVKRKVVKKK PQALRRKPLPPVGFAGAMAEAREKGD LTFTFPVVFMGESDEDDTPVWEPLPLK TLKELQSAVRTMGPSAPYTLQVVDMV ASQWLTPSDWHQTARATLSPGDYVL WRTEYEEKSKEMVQKAAGKRKGKVS LDMLLGTGQFLSPSSQIKLSKDVLKDV TTNAVLAWRAIPPPGVKKTVLAGLKQ GNEESYETFISRLEEAVYRMMPRGEGS DILIKQLAWENANSLCQDLIRPIRKTGT IQDYIRACLDASPAVVQGMAYAAAMR GQKYSTFVKQTYGGGKGGQAEGPV CFSCGKTGHIRKDCKDEKGSKRAPPGL CPRCKKGYHWKSECKSKFDKDGNPLP PLETNAENSKNLVKGQSPSPAQKGDG VKGSGLNPEAPPFTIHDLPRGTPGSAGL DLSSQKDLILSLEDGVSLVPTLVKGTLP EGTTGLIIGRSSNYKKGLEVLPGVIDSD FQGEIKVMVKAAKNAVIIHKGERIAQL LLLPYLKLPNPVIKEERGSEGFGSTSHV HWVQEISDSRPMLHIYLNGRRFLGLLD TGADKTCIAGRDWPANWPIHQTESSLQ GLGMACGVARSSQPLRWQHEDKSGII HPFVIPTLPFTLWGRDIMKDIKVRLMT DSPDDSQDLMIGAIESNLFADQISWKS DQPVWLNQWPLKQEKLQALQQLVTE | IPR043502, SSF56672, IPR000477, PF00078, cd01645, PF06817, IPR010661 |

… TABLE 5-continued

Exemplary monomeric retroviral reverse transcriptases and their RT domain signatures

| Name | Accession | Organism | Sequence | RT Signatures |
|---|---|---|---|---|
| | | | QLQLGHLEESNSPWNTPVFVIKKKSGK WRLLQDLRAVNATMHDMGALQPGLP SPVAVPKGWEIIIDLQDCFFNIKLHPED CKRFAFSVPSPNFKRPYQRFQWKVLPQ GMKNSPTLCQKFVDKAILTVRDKYQD SYIVHYMDDILLAHPSRSIVDEILTSMI QALNKHGLVVSTEKIQKYDNLKYLGT HIQGDSVSYQKLQIRTDKLRTLNDFQK LLGNINWIRPFLKLTTGELKPLFEILNG DSNPISTRKLTPEACKALQLMNERLST ARVKRLDLSQPWSLCILKTEYTPTACL WQDGVVEWIHLPHISPKVITPYDIFCTQ LIIKGRHRSKELFSKDPDYIVVPYTKVQ FDLLLQEKEDWPISLLGFLGEVHFHLP KDPLLTFTLQTAIIFPHMTSTTPLEKGIV IFTDGSANGRSVTYIQGREPIIKENTQN TAQQAEIVAVITAFEEVSQPFNLYTDSK YVTGLFPEIETATLSPRTKIYTELKHLQ RLIHKRQEKFYIGHIRGHTGLPGPLAQG NAYADSLTRILTALESAQESHALHHQN AAALRFQFHITREQAREIVKLCPNCPD WGHAPQLGVNPRGLKPRVLWQMDVT HVSEFGKLKYVHVTVDTYSHFTFATA RTGEATKDVLQHLAQSFAYMGIPQKIK TDNAPAYVSRSIQEFLARWKISHVTGIP YNPQGQAIVERTHQNIKAQLNKLQKA GKYYTPHHLLAHALFVLNHVNMDNQ GHTAAERHWGPISADPKPMVMWKDL LTGSWKGPDVLITAGRGYACVFPQDA ETPIWVPDRFIRPFTERKEATPTGTAE KTPPRDEKDQQESPKNESSPHQREDGL ATSAGVDLRSGGGP (SEQ ID NO: 1562) | |
| POL_MLVMS-residues only | P03355 | Moloney murine leukemia virus | MGQTVTTPLSLTLGHWKDVERIAHNQ SVDVKKRRWVTFCSAEWPTFNVGWP RDGTFNRDLITQVKIKVFSPGPHGHPD QVPYIVTWEALAFDPPPWVKPFVHPKP PPPLPPSAPSLPLEPPRSTPPRSSLYPALT PSLGAKPKPQVLSDSGGPLIDLLTEDPP PYRDPRPPPSDRDGNGGEATPAGEAPD PSPMASRLRGRREPPVADSTTSQAFPL RAGGNGQLQYWPFSSSDLYNWKNNN PSFSEDPGKLTALIESVLITHQPTWDDC QQLLGTLLTGEEKQRVLLEARKAVRG DDGRPTQLPNEVDAAFPLERPDWDYT TQAGRNHLVHYRQLLLAGLQNAGRSP TNLAKVKGITQGPNESPSAFLERLKEA YRRYTPYDPEDPGQETNVSMSFIWQSA PDIGRKLERLEDLKNKTLGDLVREAEK IFNKRETPEEREERIRRETEEKEERRTE DEQKEKERDRRRHREMSKLLATVVSG QKQDRQGGERRRSQLDRDQCAYCKE KGHWAKDCPKKPRGPRGPRPQTSLLT LDDQGGQGQEPPPEPRITLKVGGQPVT FLVDTGAQHSVLTQNPGPLSDKSAWV QGATGGKRYRWTTDRKVHLATGKVT HSFLHVPDCPYPLLGRDLLTKLKAQIH FEGSGAQVMGPMGQPLQVLTLNIEDE HRLHETSKEPDVSLGSTWLSDFPQAW AETGGMGLAVRQAPLIIPLKATSTPVSI KQYPMSQEARLGIKPHIQRLLDQGILV PCQSPWNTPLLPVKKPGTNDYRPVQD LREVNKRVEDIHPTVPNPYNLLSGLPPS HQWYTVLDLKDAFFCLRLHPTSQPLFA FEWRDPEMGISGQLTWTRLPQGFKNSP TLFDEALHRDLADFRIQHPDLILLQYV DDLLLAATSELDCQQGTRALLQTLGN LGYRASAKKAQICQKQVKYLGYLLKE GQRWLTEARKETVMGQPTPKTPRQLR EFLGTAGFCRLWIPGFAEMAAPLYPLT KTGTLFNWGPDQQKAYQEIKQALLTA PALGLPDLTKPFELFVDEKQGYAKGVL TQKLGPWRRPVAYLSKKLDPVAAGWP | IPR043502, SSF56672, IPR000477, PF00078, cd03715 |

TABLE 5-continued

Exemplary monomeric retroviral reverse transcriptases and their RT domain signatures

| Name | Accession | Organism | Sequence | RT Signatures |
|---|---|---|---|---|
| | | | PCLRMVAAIAVLTKDAGKLTMGQPLV ILAPHAVEALVKQPPDRWLSNARMTH YQALLLDTDRVQFGPVVALNPATLLPL PEEGLQHNCLDILAEAHGTRPDLTDQP LPDADHTWYTDGSSLLQEGQRKAGAA VTTETEVIWAKALPAGTSAQRAELIAL TQALKMAEGKKLNVYTDSRYAFATA HIHGEIYRRRGLLTSEGKEIKNKDEILA LLKALFLPKRLSIIHCPGHQKGHSAEAR GNRMADQAARKAAITETPDTSTLLIEN SSPYTSEHFHYTVTDIKDLTKLGAIYDK TKKYWVYQGKPVMPDQFTFELLDFLH QLTHLSFSKMKALLERSHSPYYMLNR DRTLKNITETCKACAQVNASKSAVKQ GTRVRGHRPGTHWEIDFTEIKPGLYGY KYLLVFIDTFSGWIEAFPTKKETAKVV TKKLLEEIFPRFGMPQVLGTDNGPAFV SKVSQTVADLLGIDWKLHCAYRPQSS GQVERMNRTIKETLTKLTLATGSRDW VLLLPLALYRARNTPGPHGLTPYEILY GAPPPLVNFPDPDMTRVTNSPSLQAHL QALYLVQHEVWRPLAAAYQEQLDRP VVPHPYRVGDTVWVRRHQTKNLEPR WKGPYTVLLTTPTALKVDGIAAWIHA AHVKAADPGGGPSSRLTWRVQRSQNP LKIRLTREAP (SEQ ID NO: 1563) | |
| POL_HTL1A-residues only | P03362 | Human T-cell leukemia virus 1 | MGQIFSRSASPIPRPPPRGLAAHHWLNFL QAAYRLEPGPSSYDFHQLKKFLKIALE TPARICPINYSLLASLLPKGYPGRVNEIL HILIQTQAQIPSRPAPPPPSSPTHDPPDS DPQIPPPYVEPTAPQVLPVMHPHGAPP NHRPWQMKDLQAIKQEVSQAAPGSPQ FMQTIRLAVQQFDPTAKDLQDLLQYL CSSLVASLHHQQLDSLISEAETRGITGY NPLAGPLRVQANNPQQQGLRREYQQL WLAAFAALPGSAKDPSWASILQGLEEP YHAFVERLNIALDNGLPEGTPKDPILRS LAYSNANKECQKLLQARGHTNSPLGD MLRACQTWTPKDKTKVLVVQPKKPPP NQPCFRCGKAGHWSRDCTQPRPPPGP CPLCQDPTHWKRDCPRLKPTIPEPEPEE DALLLDLPADIPHPKNLHRGGGLTSPP TLQQVLPNQDPASILPVIPLDPARRPVI KAQVDTQTSHPKTIEALLDTGADMTV LPIALFSSNTPLKNTSVLGAGGQTQDH FKLTSLPVLIRLPFRTTPIVLTSCLVDTK NNWAIIGRDALQQCQGVLYLPEAKRPP VILPIQAPAVLGLEHLPRPPQISQFPLNP ERLQALQHLVRKALEAGHIEPYTGPGN NPVFPVKKANGTWRFIHDLRATNSLTI DLSSSSPGPPDLSSLPTTLAHLQTIDLRD AFFQIPLPKQFQPYFAFTVPQQCNYGP GTRYAWKVLPQGFKNSPTLFEMQLAH ILQPIRQAFPQCTILQYMDDILLASPSHE DLLLLSEATMASLISHGLPVSENKTQQ TPGTIKFLGQIISPNHLTYDAVPTVPIRS RWALPELQALLGEIQWVSKGTPTLRQP LHSLYCALQRHTDPRDQIYLNPSQVQS LVQLRQALSQNCRSRLVQTLPLLGAIM LTLTGTTTVVFQSKEQWPLVWLHAPL PHTSQCPWGQLLASAVLLLDKYTLQS YGLLCQTIHHNISTQTFNQFIQTSDHPS VPILLHHSRFKNLGAQTGELWNTFLK TAAPLAPVKALMPVFTLSPVIINTAPCL FSDGSTSRAAYILWDKQILSQRSFPLPP PHKSAQRAELLGLLHGLSSARSWRCL NIFLDSKYLYHYLRTLALGTFQGRSSQ APFQALLPRLLSRKVVYLHHVRSHTNL PDDPISRLNALTDALLITPVLQLSPAELHS FTHCGQTALTLQGATTTEASNILRSCH ACRGGNPQHQMPRGHIRRGLLPNHIW QGDITHFKYKNTLYRLHVWVDTFSGAI | IPR043502, SSF56672, IPR000477, PF00078 |

TABLE 5-continued

Exemplary monomeric retroviral reverse transcriptases and their RT domain signatures

| Name | Accession | Organism | Sequence | RT Signatures |
|---|---|---|---|---|
| | | | SATQKRKETSSEAISSLLQAIAHLGKPS YINTDNGPAYISQDFLNMCTSLAIRHTT HVPYNPTSSGLVERSNGILKTLLYKYF TDKPDLPMDNALSIALWTINHLNVLTN CHKTRWQLHHSPRLQPIPETRSLSNKQ THWYYFKLPGLNSRQWKGPQEALQEA AGAALIPVSASSAQWIPWRLLKRAACP RPVGGPADPKEKDLQHHG (SEQ ID NO: 1564) | |
| POL_FOAMV-residues only | P14350 | Human spumaretro-virus | MNPLQLLQPLPAEIKGTKLLAHWDSG ATITCIPESFLEDEQPIKKTLIKTIHGEK QQNVYYVTFKVKGRKVEAEVIASPYE YILLSPTDVPWLTQQPLQLTILVPLQEY QEKILSKTALPEDQKQQLKTLFVKYDN LWQHWENQVGHRKIRPHNIATGDYPP RPQKQYPINPKAKPSIQIVIDDLLKQGV LTPQNSTMNTPVYPVPKPDGRWRMVL DYREVNKTIPLTAAQNQHSAGILATIV RQKYKTTLDLANGFWAHPITPESYWL TAFTWQGKQYCWTRLPQGFLNSPALF TADVVDLLKEIPNVQVYVDDIYLSHDD PKEHVQQLEKVFQILLQAGYVVSLKKS EIGQKTVEFLGFNITKEGRGLTDTFKTK LLNITPPKDLKQLQSILGLLNFARNFIPN FAELVQPLYNLIASAKGKYIEWSEENT KQLNMVIEALNTASNLEERLPEQRLVI KVNTSPSAGYVRYYNETGKKPIMYLN YVFSKAELKFSMLEKLLTTMHKALIKA MDLAMGQEILVYSPIVSMTKIQKTPLP ERKALPIRWITWMTYLEDPRIQFHYDK TLPELKHIPDVYTSSQSPVKHPSQYEGV FYTDGSAIKSPDPTKSNNAGMGIVHAT YKPEYQVLNQWSIPLGNHTAQMAEIA AVEFACKKALKIPGPVLVITDSFYVAES ANKELPYWKSNGFVNNKKKPLKHISK WKSIAECLSMKPDITIQHEKGISLQIPVF ILKGNALADKLATQGSYVVNCNTKKP NLDAELDQLLQGHYIKGYPKQYTYFL EDGKVKVSRPEGVKIIPPQSDRQKIVLQ AHNLAHTGREATLLKIANLYWWPNM RKDVVKQLGRCQQCLITNASNKASGPI LRPDRPQKPFDKFFIDYIGPLPPSQGYL YVLVVVDGMTGFTWLYPTKAPSTSAT VKSLNVLTSIAIPKVIHSDQGAAFTSST FAEWAKERGIHLEFSTPYHPQSGSKVE RKNSDIKRLLTKLLVGRPTKWYDLLPV VQLALNNTYSPVLKYTPHQLLFGIDSN TPFANQDTLDLTREEELSLLQEIRTSLY HPSTPPASSRSWSPVVGQLVQERVARP ASLRPRWHKPSTVLKVLNPRTVVILDH LGNNRTVSIDNLKPTSHQNGTTNDTAT MDHLEKNE (SEQ ID NO: 1565) | IPR043502, SSF56672, IPR000477, PF00078 |
| POL_BLVJ-residues only | P03361 | Bovine leukemia virus | MGNSPSYNPPAGISPSDWLNLLQSAQR LNPRPSPSDFTDLKNYIHWFHKTQKKP WTFTSGGPTSCPPGRFGRVPLVLATLN EVLSNEGGAPGASAPEEQPPPYDPPAIL PIISEGNRNRHRAWALRELQDIKKEIEN KAPGSQVWIQTLRLAILQADPTPADLE QLCQYIASPVDQTAHMTSLTAAIAAAE AANTLQGFNPKTGTLTQQSAQPNAGD LRSQYQNLWLQAGKNLPTRPSAPWSTI VQGPAESSVEFVNRLQISLADNLPDGV PKEPIIDSLSYANANRECQQILQGRGPV AAVGQKLQACAQWAPKNKQPALLVH TPGPKMPGPRQPAPKRPPPGPCYRCLK EGHWARDCPTKATGPPPGPCPICKDPS HWKRDCPTLKSKNKLIEGGLSAPQTIT PITDSLSEAELECLLSIPLARSRPSVAVY LSGPWLQPSQNQALMLVDTGAENTVL PQNWLVRDYPRIPAAVLGAGGVSRNR YNWLQGPLTLALKPEGPFITIPKILVDT | IPR043502, SSF56672, IPR000477, PF00078 |

TABLE 5-continued

Exemplary monomeric retroviral reverse transcriptases and their RT domain signatures

| Name | Accession | Organism | Sequence | RT Signatures |
|---|---|---|---|---|
| | | | SDKWQILGRDVPSRLQASISIPEEVRPP<br>VVGVLDTPPSHIGLEHLPPPPEVPQFPL<br>NLERLQALQDLVHRSLEAGYISPWDGP<br>GNNPVFPVRKPNGAWRFVHDLRATNA<br>LTKPIPALSPGPPDLTAIPTHPPHIICLDL<br>KDAFFQIPVEDRFRFYLSFTLPSPGGLQ<br>PHRRFAWRVLPQGFINSPALFERALQE<br>PLRQVSAAFSQSLLVSYMDDILYASPT<br>EEQRSQCYQALAARLRDLGFQVASEK<br>TSQTPSPVPFLGQMVHEQIVTYQSLPTL<br>QISSPISLHQLQAVLGDLQWVSRGTPTT<br>RRPLQLLYSSLKRHHDPRAIIQLSPEQL<br>QGIAELRQALSHNARSRYNEQEPLLAY<br>VHLTRAGSTLVLFQKGAQFPLAYFQTP<br>LTDNQASPWGLLLLLGCQYLQTQALS<br>SYAKPILKYYHNLPKTSLDNWIQSSED<br>PRVQELLQLWPQISSQGIQPPGPWKTLI<br>TRAEVFLTPQFSPDPIPAALCLFSDGAT<br>GRGAYCLWKDHLLDFQAVPAPESAQK<br>GELAGLLAGLAAAPPEPVNIWVDSKY<br>LYSLLRTLVLGAWLQPDPVPSYALLYK<br>SLLRHPAIVVGHVRSHSSASHPIASLNN<br>YVDQLLPLETPEQWHKLTHCNSRALS<br>RWPNPRISAWDPRSPATLCETCQKLNP<br>TGGGKMRTIQRGWAPNHIWQADITHY<br>KYKQFTYALHVFVDTYSGATHASAKR<br>GLTTQTTIEGLLEAIVHLGRPKKLNTD<br>QGANYTSKTFVRFCQQFGVSLSHHVP<br>YNPTSSGLDERTNGLLKLLLSKYHLDE<br>PHLPMTQALSRALWTHNQINLLPILKT<br>RWELHHSPPLAVISEGGETPKGSDKLF<br>LYLLPGQNNRRWLGPLPALVEASGGA<br>LLATDPPVWVPWRLLKAFKCLKNDGP<br>EDAHNRSSDG<br>(SEQ ID NO: 1566) | |
| O41894_9RETR-<br>residues<br>only | O41894 | Bovine<br>foamy<br>virus | MPALRPLQVEIKGNHLKGYWDSGAEI<br>TCVPAIYIIEEQPVGKKLITTIHNEKEHD<br>VYYVEMKIEKRKVQCEVIATALDYVL<br>VAPVDIPWYKPGPLELTIKIDVESQKHT<br>LITESTLSPQGQMRLKKLLDQYQALW<br>QCWENQVGHRRIEPHKIATGALKPRPQ<br>KQYHINPRAKADIQIVIDDLLRQGVLR<br>QQNSEMNTPVYPVPKADGRWRMVLD<br>YREVNKVTPLVATQNCHSASILNTLYR<br>GPYKSTLDLANGFWAHPIKPEDYWITA<br>FTWGGKTYCWTVLPQGFLNSPALFTA<br>DVVDILKDIPNVQVYVDDVYVSSATE<br>QEHLDILETIFNRLSTAGYIVSLKKSKL<br>AKETVEFLGFSISQNGRGLTDSYKQKL<br>MDLQPPTTLRQLQSILGLINFARNFLPN<br>FAELVAPLYQLIPKAKGQCIPWTMDHT<br>TQLKTIIQALNSTENLEERRPDVDLIMK<br>VHISNTAGYIRFYNHGGQKPIAYNNAL<br>FTSTELKFTPTEKIMATIHKGLLKALDL<br>SLGKEIHVYSAIASMTKLQKTPLSERK<br>ALSIRWLKWQTYFEDPRIKFHHDATLP<br>DLQNLPVPQQDTGKEMTILPLLHYEAI<br>FYTDGSAIRSPKPNKTHSAGMGIIQAKF<br>EPDFRIVHLWSFPLGDHTAQYAEIAAF<br>EFAIRRATGIRGPVLIVTDSNYVAKSYN<br>EELPYWESNGFVNNKKKTLKHISKWK<br>AIAECKNLKADIHVIHEPGHQPAEASP<br>HAQGNALADKQAVSGSYKVFSNELKP<br>SLDAELEQVLSTGRPNPQGYPNKYEYK<br>LVNGLCYVDRRGEEGLKIIPPKADRVK<br>LCQLAHDGPGSAHLGRSALLLKLQQK<br>YWWPRMHIDASRIVLNCTVCAQTNST<br>NQKPRPPLVIPHDTKPFQVWYMDYIGP<br>LPPSNGYQHALVIVDAGTGFTWIYPTK<br>AQTANATVKALTHLTGTAVPKVLHSD<br>QGPAFTSSILADWAKDRGIQLEHSAPY<br>HPQSSGKVERKNSEIKRLLTKLLAGRP<br>TKWYPLIPIVQLALNNTPNTRQKYTPH | IPR043502,<br>SSF56672,<br>IPR000477,<br>PF00078 |

TABLE 5-continued

Exemplary monomeric retroviral reverse transcriptases and their RT domain signatures

| Name | Accession | Organism | Sequence | RT Signatures |
|---|---|---|---|---|
| | | | QLMYGADCNLPFENLDTLDLTREEQL<br>AVLKEVRDGLLDLYPSPSQTTARSWTP<br>SPGLLVQERVARPAQLRPKWRKPTPIK<br>KVLNERTVIIDHLGQDKVVSIDNLKPA<br>AHQKLAQTPDSAEICPSATPCPPNTSL<br>WYDLDTGTWTCQRCGYQCPDKYHQP<br>QCTWSCEDRCGHRWKECGNCIPQDGS<br>SDDASAVAAVEI<br>(SEQ ID NO: 1567) | |
| POL_MLVBM-residues only | Q7SVK7 | Murine leukemia virus | MGQTVTTPLSLTLEHWGDVQRIASNQ<br>SVGVKKRRWVTFCSAEWPTFGVGWP<br>QDGTFNLDIILQVKSKVFSPGPHGHPD<br>QVPYIVTWEAIAYEPPPWVKPFVSPKL<br>SLSPTAPILPSGPSTQPPPRSALYPAFTP<br>SIKPRPSKPQVLSDDGGPLIDLLTEDPPP<br>YGEQGPSSPDGDGDREEATSTSEIPAPS<br>PMVSRLRGKRDPPAADSTTSRAFPLRL<br>GGNGQLQYWPFSSSDLYNWKNNNPSF<br>SEDPGKLTALIESVLTTHQPTWDDCQQ<br>LLGTLLTGEEKQRVLLEARKAVRGND<br>GRPTQLPNEVNSAFPLERPDWDYTTPE<br>GRNHLVLYRQLLLAGLQNAGRSPTNL<br>AKVKGITQGPNESPSAFLERLKEAYRR<br>YTPYDPEDPGQETNVSMSFIWQSAPAI<br>GRKLERLEDLKSKTLGDLVREAEKIFN<br>KRETPEEREERIRRETEEKEERRRAGDE<br>QREKERDRRRQREMSKLLATVVTGQR<br>QDRQGGERRRPQLDKDQCAYCKEKG<br>HWAKDCPKKPRGPRGPRPQTSLLTLD<br>DQGGQGQEPPPEPRITLTVGGQPVTFL<br>VDTGAQHSVLTQNPGPLSDRSAWVQG<br>ATGGKRYRWTTDRKVHLATGKVTHSF<br>LHVPDCPYPLLGRDLLTKLKAQIHFEG<br>SGAQVVGPKGQPLQVLTLGIEDEYRLH<br>ETSTEPDVSLGSTWLSDFPQAWAETGG<br>MGLAVRQAPLIIPLKATSTPVSIQQYPM<br>SHEARLGIKPHIQRLLDQGILVPCQSPW<br>NTPLLPVKKPGTNDYRPVQDLREVNK<br>RVEDIHPTVPNPYNLLSGLPPSHQWYT<br>VLDLKDAFFCLRLHPTSQPLFAFEWRD<br>PGMGISGQLTWTRLPQGFKNSPTLFDE<br>ALHRDLADFRIQHPDLILLQYVDDILLA<br>ATSELDCQQGTRALLQTLGDLGYRAS<br>AKKAQICQKQVKYLGYLLREGQRWLT<br>EARKETVMGQPVPKTPRQLREFLGTA<br>GFCRLWIPGFAEMAAPLYPLTKTGTLF<br>SWGPDQQKAYQEIKQALLTAPALGLP<br>DLTKPFELFVDEKQGYAKGVLTQKLG<br>PWRRPVAYLSKKLDPVAAGWPPCLRM<br>VAAIAVLTKDAGKLTMGQPLVILAPH<br>AVEALVKQPPDRWLSNARMTHYQAM<br>LLDTDRVQFGPVVALNPATLLPLPEEG<br>APHDCLEILAETHGTRPDLTDQPIPDAD<br>HTWYTDGSSFLQEGQRKAGAAVTTET<br>EVIWAGALPAGTSAQRAELIALTQALK<br>MAEGKRLNVYTDSRYAFATAHIHGEI<br>YRRRGLLTSEGREIKNKSEILALLKALF<br>LPKRLSIIHCLGHQKGDSAEARGNRLA<br>DQAAREAAIKTPPDTSTLLIEDSTPYTP<br>AYFHYTETDLKKLRDLGATYNQSKGY<br>WVFQGKPVMPDQFVFELLDSLHRLTH<br>LGYQKMKALLDRGESPYYMLNRDKT<br>LQYVADSCTVCAQVNASKAKIGAGVR<br>VRGHRPGTHWEIDFTEVKPGLYGYKY<br>LLVFVDTFSGWVEAFPTKRETARVVSK<br>KLLEEIFPRFGMPQVLGSDNGPAFTSQ<br>VSQSVADLLGIDWKLHCAYRPQSSGQ<br>VERINRTIKETLTKLTLAAGTRDWVLL<br>LPLALYRARNTPGPHGLTPYEILYGAPP<br>PLVNFHDPDMSELTNSPSLQAHLQALQ<br>TVQREIWKPLAEAYRDRLDQPVIPHPF | IPR043502,<br>SSF56672,<br>IPR000477,<br>PF00078,<br>cd03715 |

TABLE 5-continued

Exemplary monomeric retroviral reverse transcriptases and their RT domain signatures

| Name | Accession | Organism | Sequence | RT Signatures |
|---|---|---|---|---|
| | | | RIGDSVWVRRHQTKNLEPRWKGPYTV LLTTPTALKVDGISAWIHAAHVKAATT PPIKPSWRVQRSQNPLKIRLTRGAP (SEQ ID NO: 2453) | |

TABLE 6

Exemplary dimeric retroviral reverse transcriptases and their RT domain signatures

| Name | Accession | Organism | Sequence | RT Signatures |
|---|---|---|---|---|
| Q83133_AVIMA | Q83133 | Avian myeloblastosis-associated virus type 1 | RATVLTVALHLAIPLKWKPN HTPVWIDQWPLPEGKLVALT QLVEKELQLGHIEPSLSCWN TPVFVIRKASGSYRLLHDLR AVNAKLVPFGAVQQGAPVLS ALPRGWPLMVLDLKDCFFSI PLAEQDREAFAFTLPSVNNQ APARRFQWKVLPQGMTCSPT ICQLIVGQILEPLRLKMPSL RMLHYMDDLLLAASSHDGLE AAGEEVISTLERAGFTISPD KVQREPGVQYLGYKLGSTYV APVGLVAEPRIATLWDVQKL VGSLQSVRPALGIPPRLMGP FYEQLRGSDPNEAREWNLDM KMAWREIVQLSTTAALERWD PALPLEGAVARCEQGAIGVL GQGLSTHPRPCLWLFSTQPT KAFTAWLEVLTLLITKLRAS AVRTFGKEVDILLLPACFRE DLPLPEGILLALRGFAGKIR SSDTPSIFDIARPLHVSLKV RVTDHPVPGPTVFTDASSST HKGVVVWREGPRWEIKEIAD LGASVQQLEARAVAMALLLW PTTPTNVVTDSAFVAKMLLK MGQEGVPSTAAAFILEDALS QRSAMAAVLHVRSHSEVPGF FTEGNDVADSQATFQAYPLR EAKDLHTALHIGPRALSKAC NISMQQAREVVQTCPHCNSA PALEAGVNPRGLGPLQIWQT DFTLEPRMAPRSWLAVTVDT ASSAIVVTQHGRVTSVAAQH HWATAIAVLGRPKAIKTDNG SCFTSKSTREWLARWGIAHT TGIPGNSQGQAMVERANRLL KDKIRVLAEGDGFMKRIPTS KQGELLAKAMYALNHFERGE NTKTPIQKHWRPTVLTEGP PVKIRIETGEWEKGWNVLVW GRGYAAVKNRDTDKVIWVPS RKVKPDITQKDEVTKKDEAS PLFAGISDWAPWEGEQEGLQ EETASNKQERPGEDTPAANE S (SEQ ID NO: 1568) | IPR043502, SSF56672, IPR000477, PF00078, cd01645, PF06817, IPR010661 |
| POL_SIVM1 | P05896 | Simian immuno-deficiency virus | MGARNSVLSGKKADELEKIR LRPGGKKKYMLKHVVWAANE LDRFGLAESLLENKEGCQKI LSVLAPLVPTGSENLKSLYN TVCVIWCIHAEEKVKHTEEA KQIVQRHLVMETGTAETMPK TSRPTAPFSGRGGNYPVQQI GGNYTHLPLSPRTLNAWVKL IEEKKFGAEVVSGFQALSEG CLPYDINQMLNCVGDHQAAM | IPR043502, SSF56672, IPR000477, PF00078, PF06817, IPR010661, PF06815, IPR010659 |

TABLE 6-continued

Exemplary dimeric retroviral reverse transcriptases and their RT domain signatures

| Name | Accession | Organism | Sequence | RT Signatures |
|---|---|---|---|---|
| | | | QIIRDIINEEAADWDLQHPQ<br>QAPQQGQLREPSGSDIAGTT<br>STVEEQIQWMYRQQNPIPVG<br>NIYRRWIQLGLQKCVRMYNP<br>TNILDVKQGPKEPFQSYVDR<br>FYKSLRAEQTDPAVKNWMTQ<br>TLL1QNANPDCKLVLKGLGT<br>NPTLEEMLTACQGVGGPGQK<br>ARLMAEALKEALAPAPIPFA<br>AAQQKGPRKPIKCWNCGKEG<br>HSARQCRAPRRQGCWKCGKM<br>DHVMAKCPNRQAGFFRPWPL<br>GKEAPQFPHGSSASGADANC<br>SPRRTSCGSAKELHALGQAA<br>ERKQREALQGGDRGFAAPQF<br>SLWRRPVVTAHIEGQPVEVL<br>LDTGADDSIVTGIELGPHYT<br>PKIVGGIGGFINTKEYKNVE<br>IEVLGKRIKGTIMTGDTPIN<br>IFGRNLLTALGMSLNLPIAK<br>VEPVKSPLKPGKDGPKLKQW<br>PLSKEKIVALREICEKMEKD<br>GQLEEAPPTNPYNTPTFAIK<br>KKDKNKWRMLIDFRELNRVT<br>QDFTEVQLGIPHPAGLAKRK<br>RITVLDIGDAYFSIPLDEEF<br>RQYTAFTLPSVNNAEPGKRY<br>IYKVLPQGWKGSPAIFQYTM<br>RHVLEPFRKANPDVTLVQYM<br>DDILIASDRTDLEHDRVVLQ<br>LKELLNSIGFSSPEEKFQKD<br>PPFQWMGYELWPTKWKLQKI<br>ELPQRETWTVNDIQKLVGVL<br>NWAAQIYPGIKTKHLCRLIR<br>GKMTLTEEVQWTEMAEAEYE<br>ENKIILSQeqegcyyqeskp<br>leatviksQdnqwsYKIHQE<br>DKILKVGKFAKIKNTHTNGV<br>RLLAHVIQKIGKEAIVIWGQ<br>VPKFHLPVEKDVWEQVVWTD<br>YWQVTWIPEWDFISTPPLVR<br>LVFNLVKDPIEGEETYYVDG<br>SCSKQSKEGKAGYITDRGKD<br>KVKVLEQTTNQQAELEAFLM<br>ALTDSGPKANIIVDSQYVMG<br>IITGCPTESESRLVNQIIEE<br>MIKKTEIYVAWVPAHKGIGG<br>NQEIDHLVSQGIRQVLFLEK<br>IEPAQEEHSKYHSNIKELVF<br>KFGLPRLVAKQIVDTCDKCH<br>QKGEAIHGQVNSDLGTWQMD<br>CTHLEGKIVIVAVHVASGFI<br>EAEVIPQETGRQTALFLLKL<br>ASRWPITHLHTDNGANFASQ<br>EVKMVAWWAGIEHTFGVPYN<br>PQSQGVVEAMNHHLKNQIDR<br>IREQANSVETIVLMAVHCMN<br>FKRRGGIGDMTPAERLINMI<br>TTEQEIQFQQSKNSKFKNFR<br>VYYREGRDQLWKGPGELLWK<br>GEGAVILKVGTDIKVVPRRK<br>AKIIKDYGGGKEMDSSSHME<br>DTGEAREVA<br>(SEQ ID NO: 1569) | |
| POL_RSVP | P03354 | Rous sarcoma virus | MEAVIKVISSACKTYCGKTS<br>PSKKEIGAMLSLLQKEGLLM<br>SPSDLYSPGSWDPITAALSQ<br>RAMILGKSGELKTWGLVLGA<br>LKAAREEQVTSEQAKFWLGL<br>GGGRVSPPGPECIEKPATER<br>RIDKGEEVGETTVQRDAKMA<br>PEETATPKTVGTSCYHCGTA<br>IGCNCATASAPPPPYVGSGL | IPR043502,<br>SSF56672,<br>1PR000477,<br>PF00078,<br>cd01645,<br>PF06817,<br>IPR010661 |

TABLE 6-continued

Exemplary dimeric retroviral reverse transcriptases and their RT domain signatures

| Name | Accession | Organism | Sequence | RT Signatures |
|------|-----------|----------|----------|---------------|
| | | | YPSLAGVGEQQGQGGDTPPG AEQSRAEPGHAGQAPGPALT DWARVREELASTGPPVVAMP VVIKTEGPAWTPLEPKLITR LADTVRTKGLRSPITMAEVE ALMSSPLLPHDVTNLMRVIL GPAPYALWMDAWGVQLQTVI AAATRDPRHPANGQGRGERT NLNRLKGLADGMVGNPQGQA ALLRPGELVAITASALQAFR EVARLAEPAGPWADIMQGPS ESFVDFANRLIKAVEGSDLP PSARAPVIIDCFRQKSQPDI QQLIRTAPSTLTTPGEIIKY VLDRQKTAPLTDQGIAAAMS SAIQPLIMAVVNRERDGQTG SGGRARGLCYTCGSPGHYQA QCPKKRKSGNSRERCQLCNG MGHNAKQCRKRDGNQGQRPG KGLSSGPWPGPEPPAVSLAM TMEHKDRPLVRVILTNTGSH PVKQRSVYITALLDSGADIT IISEEDWPTDWPVMEAANPQ IHGIGGGIPMRKSRDMIELG VINRDGSLERPLLLFPAVAM VRGSILGRDCLQGLGLRLTN LIGRATVLTVALHLAIPLKW KPDHTPVWIDQWPLPEGKLV ALTQLVEKELQLGHIEPSLS CWNTPVFVIRKASGSYRLLH DLRAVNAKLVPFGAVQQGAP VLSALPRGWPLMVLDLKDCF FSIPLAEQDREAPAFTLPSV NNQAPARRFQWKVLPQGMTC SPTICQLVVGQVLEPLRLKH PSLCMLHYMDDLLLAASSHD GLEAAGEEVISTLERAGFTI SPDKVQREPGVQYLGYKLGS TYVAPVGLVAEPRIATLWDV QKLVGSLQWLRPALGIPPRL MGPFYEQLRGSDPNEAREWN LDMKMAWREIVRLSTTAALE RWDPALPLEGAVARCEQGAI GVLGQGLSTHPRPCLWLFST QPTKAFTAWLEVLTLLITKL RASAVRTFGKEVDILLLPAC FREDLPLPEGILLALKGFAG KIRSSDTPSIFDIARPLHVS LKVRVTDHPVPGPTVFTDAS SSTHKGVVVWREGPRWEIKE IADLGASVQQLEARAVAMAL LLWPTTPTNVVTDSAFVAKM LLKMGQEGVPSTAAAFILED ALSQRSAMAAVLHVRSHSEV PGFFTEGNDVADSQATFQAY PLREAKDLHTALHIGPRALS KACNISMQQAREVVQTCPHC NSAPALEAGVNPRGLGPLQI WQTDFTLEPRMAPRSWLA VTVD TASSAIVVTQHGRVTSVAVQ HHWATAIAVLGRPKAIKTDN GSCFTSKSTREWLARWGIAH TTGIPGNSQGQAMVERANRL LKDRIRVLAEGDGFMKRIPT SKQGELLAKAMYALNHFERG ENTKTPIQKHWRPTVLTEGP PVKIRIETGEWEKGWNVLVW GRGYAAVKNRDTDKVIWVPS RKVKPDITQKDEVTKKDEAS PLFAGISDWIPWEDEQEGLQ GETASNKQERPGEDTLAANE S (SEQ ID NO: 1570) | |

TABLE 6-continued

Exemplary dimeric retroviral reverse transcriptases and their RT domain signatures

| Name | Accession | Organism | Sequence | RT Signatures |
|------|-----------|----------|----------|---------------|
| POL_HV2D2 | P15833 | Human immuno-deficiency virus type 2 | MGARGSVLSGKKTDELEKVR LRPGGKKKYMLKHVVWAVNE LDRFGLAESLLESKEGCQKI LKVLAPLVPTGSENLKSLFN IVCVIFCLHAEEKVKDTEEA KKIAQRHLAADTEKMPATNK PTAPPSGGNYPVQQLAGNYV HLPLSPRTLNAWVKLVEEKK FGAEVVPGFQALSEGCTPYD INQMLNCVGEHQAAMQIIRE IINEEAADWDQQHPSPGPMP AGQLRDPRGSDIAGTTSTVE EQIQWMYRAQNPVPVGNIYR RWIQLGLQKCVRMYNPTNIL DIKQGPKEPFQSYVDRFYKS LRAEQTDPAVKNWMTQTLLI QNANPDCKLVLKGLGMNPTL EEMLTACQGIGGPGQKARLM AEALKEALTPAPIPFAAVQQ KAGKRGTVTCWNCGKQGHTA RQCRAPRRQGCWKCGKTGHI MSKCPERQAGFLRVRTLGKE ASQLPHDPSASGSDTICTPD EPSRGHDTSGGDTICAPCRS SSGDAEKLHADGETTEREPR ETLQGGDRGFAAPQFSLVVR RPVVKACIEGQSVEVLLDTG VDDSIVAGIELGSNYTPKIV GGIGGFINTKEYKDVEIEVV GKRVRATIMTGDTPINIFGR NILNTLGMTLNFPVAKEPV KVELKPGKDGPKIRQWPLSR EKILALKEICEKMEKEGQLE EAPPTNPYNTPTFAIKKKDK NKWRMLIDFRELNKVTQDFT EVNWVFPTRQVAEKRRITVI DVGDAYFSIPLDPNFRQYTA FTLPSVNNAEPGKRYIYKVL PQGWKGSQSICQYSMRKVLD PFRKANSDVIIIQYMDDILI ASDRSDLEHDRVVSQLKELL NDMGFSTPEEKFQKDPPFKW MGYELWPKKWKLQKIQLPEK EVWTVNAIQKLVGVLNWAAQ LFPGIKTRHICKLIRGKMTL TEEVQWTELAEAELQENKII LEQEQEGSYYKERVPLEATV QKNLANQWTYKIHQGNKVLK VGKYAKVKNTHTNGVRLLAH VVQKIGKEALVIWGEIPVFH LPVERETWDQWWTDYWQVTW IPEWDFVSTPPLIRLAYNLV KDPLEGRETYYTDGSCNRTS KEGKAGYVTDRGKDKVKVLE QTTNQQAELEAFALALTDSE PQVNIIVDSQYVMGIIAAQP TETESPIVAKIIEEMIKKEA VYVGWVPAHKGLGGNQEVDH LVSQGIRQVLFLEKIEPAQE EHEKYHGNVKELVHKFGIPQ LVAKQIVNSCDKCQQKGEAI HGQVNADLGTWQMDCTHLEG KIIIVAVHVASGFIEAEVIP QETGRQTALFLLKLASRWPI THLHTDNGANFTSPSVKMVA WWVGIEQTFGVPYNPQSQGV VEAMNHHLKNQIDRLRDQAV SIETVVLMATHCMNFKRRGG IGDMTPAERLVNMITTEQEI QFFQAKNLKFQNFQVYYREG | IPR043502, SSF56672, IPR000477, PF00078, PF06817, IP010661, PF06815, IPR010659 |

TABLE 6-continued

Exemplary dimeric retroviral reverse transcriptases and their RT domain signatures

| Name | Accession | Organism | Sequence | RT Signatures |
|---|---|---|---|---|
| | | | RDQLWKGPGELLWKGEGAVI<br>IKVGTEIKVVPRRKAKIIRH<br>YGGGKGLDCSADMEDTRQAR<br>EMAQSD<br>(SEQ ID NO: 1571) | |
| POL_HV1A2 | P03369 | Human immuno-deficiency virus type 1 | MGARASVLSGGELDKWEKIR<br>LRPGGKKKYKLKHIVWASRE<br>LERFAVNPGLLETSEGCRQI<br>LGQLQPSLQTGSEELRSLYN<br>TVATLYCVHQRIDVKDTKEA<br>LEKIEEEQNKSKKKAQQAAA<br>AAGTGNSSQVSQNYPIVQNL<br>QGQMVHQAISPRTLNAWVKV<br>VEEKAFSPEVIPMFSALSEG<br>ATPQDLNTMLNTVGGHQAAM<br>QMLKETINEEAAEWDRVHPV<br>HAGPIAPGQMREPRGSDIAG<br>TTSTLQEQIGWMTNNPPIPV<br>GEIYKRWIILGLNKIVRMYS<br>PTSILDIRQGPKEPFRDYVD<br>RFYKTLRAEQASQDVKNWMT<br>ETLLVQNANPDCKTILKALG<br>PAATLEEMMTACQGVGGPGH<br>KARVLAEAMSQVTNPANIMM<br>QRGNFRNQRKTVKCFNCGKE<br>GHIAKNCRAPRKKGCWRCGR<br>EGHQMKDCTERQANFLREDL<br>AFLQGKAREFSSEQTRANSP<br>TRRELQVWGGENNSLSEAGA<br>DRQGTVSFNFPQITLWQRPL<br>VTIRIGGQLKEALLDTGADD<br>TVL<br>EEMNLPGKWKPKMIGGIGGF<br>IKVRQYDQIPVEICGHKAIG<br>TVLVGPTPVNIIGRNLLTQI<br>GCTLNFPISPIETVPVKLKP<br>GMDGPKVKQWPLTEEKIKAL<br>VEICTEMEKEGKISKIGPEN<br>PYNTPVFAIKKKDSTKWRKL<br>VDFRELNKRTQDFWEVQLGI<br>PHPAGLKKKKSVTVLDVGDA<br>YFSVPLDKDFRKYTAFTIPS<br>INNETPGIRYQYNVLPQGWK<br>GSPAIFQSSMTKILEPFRKQ<br>NPDIVIYQYMDDLYVGSDLE<br>IGQHRTKIEELRQHLLRWGF<br>TTPDKKHQKEPPFLWMGYEL<br>HPDKWTVQPIMLPEKDSWTV<br>NDIQKLVGKLNWASQIYAGI<br>KVKQLCKLLRGTKALTEVIP<br>LTEEAELELAENREILKEPV<br>HEVYYDPSKDLVAEIQKQGQ<br>GQWTYQIYQEPFKNLKTGKY<br>ARMRGAHTNDVKQLTEAVQK<br>VSTESIVIWGKIPKFKLPIQ<br>KETWEAWWMEYWQATWIPEW<br>EFVNTPPLVKLWYQLEKEPI<br>VGAETFYVDGAANRETKLGK<br>AGYVTDRGRQKVVSIADTTN<br>QKTELQAIHLALQDSGLEVN<br>IVTDSQYALGIIQAQPDKSE<br>SELVSQIIEQLIKKEKVYL<br>AWVPAHKGIGGNEQV<br>DKLVSAGIRKVLFLNGIDKA<br>QEEHEKYHSNWRAMASDFNL<br>PPVVAKEIVASCDKCQLKGE<br>AMHGQVDCSPGIWQLDCTHL<br>EGKIILVAVHVASGYIEAEV<br>IPAETGQETAYFLLKLAGRW<br>PVKTIHTDNGSNFTSTTVKA<br>ACWWAGIKQEFGIPYNPQSQ<br>GVVESMNNELKKIIGQVRDQ<br>AEHLKTAVQMAVFIHNFKRK | IPR043502,<br>SSF56672,<br>IPR000477,<br>PF00078,<br>cd01645,<br>PF06817,<br>IPR010661,<br>PF06815,<br>IPR010659 |

TABLE 6-continued

Exemplary dimeric retroviral reverse transcriptases and their RT domain signatures

| Name | Accession | Organism | Sequence | RT Signatures |
|---|---|---|---|---|
| | | | GGIGGYSAGERIVDIIATDI<br>QTKELQKQITKIQNFRVYYR<br>DNKDPLWKGPAKLLWKGEGA<br>VVIQDNSDIKVVPRRKAKII<br>RDYGKQMAGDDCVASRQDED<br>(SEQ ID NO: 1572) | |
| POL_FIVPE | P16088 | Feline Immuno-deficiency virus | KEFGKLEGGASCSPSESNAA<br>SSNAICTSNGGETIGFVNYN<br>KVGTTTTLEKRPEILIFVNG<br>YPIKFLLDTGADITILNRRD<br>FQVKNSIENGRQNMIGVGGG<br>KRGTNYINVHLEIRDENYKT<br>QCIFGNVCVLEDNSLIQPLL<br>GRDNMIKFNIRLVMAQISDK<br>IPVVKVKMKDPNKGPQIKQW<br>PLTNEKIEALTEIVERLEKE<br>GKVKRADSNNPWNTPVFAIK<br>KKSGKWRMLIDFRELNKLTE<br>KGAEV0LGLPHPAGLQIKK<br>QVTVLDIGDAYFTIPLD<br>PDYAPYTAFTLPRKNNAGPG<br>RRFVWCSLPQGWILSPLIYQ<br>STLDNIIQPFIRQNPQLDIY<br>QYMDDIYIGSNLSKKEHKEK<br>VEELRKLLLWWGFETPEDKL<br>QEEPPYTWMGYELHPLTWTI<br>QQKQLDIPEQPTLNELQKLA<br>GKINWASQAIPDLSIKALTN<br>MMRGNQNLNSTRQWTKEARL<br>EVQKAKKAIEEQVQLGYYDP<br>SKELYAKLSLVGPHQISYQV<br>YQKDPEKILWYGKMSRQKKK<br>AENTCDIALRACYKIREESI<br>IRIGKEPRYEIPTSREAWES<br>NLINSPYLKAPPPEVEYIHA<br>ALNIKRALSMIKDAPIPGAE<br>TWYIDGGRKLGKAAKAAYWT<br>DTGKWRVMDLEGSNQKAEIQ<br>ALLLALKAGSEEMNIITDSQ<br>YVINIILQQPDMMEGIWQEV<br>LEELEKKTAIFIDWVPGHKG<br>IPGNEEVDKLCQTMMIIEGD<br>GILDKRSEDAGYDLLAAKEI<br>HLLPGEVKVIPTGVKLMLPK<br>GYWGLIIGKSSIGSKGLDVL<br>GGVIDEGYRGEIGVIMINVS<br>RKSITLMERQKIAQLIILPC<br>KHEVLEQGKVVMDSERGDNG<br>YGSTGVFSSWVDRIEEAEIN<br>FIEKFHSDPQYLRTEFNLPK<br>MVAEEIRRKCPVCRIIGEQV<br>GGQLKIGPGIWQMDCTHFDG<br>KIILVGIHVESGYIWAQIIS<br>QETADCTVKAVLQLLSAHNV<br>TELQTDNGPNFKNQKMEGVL<br>NYMGVKHKFGIPGNPQSQAL<br>VENVNHTLKVWIQKFLPETT<br>SLDNALSLAVHSLNFKRRGR<br>IGGMAPYELLAQQESLRIQD<br>YFSAIPQKLQAQWIYYKDQK<br>DKKWKGPMRVEYWGQGSVLL<br>KDEEKGYFLIPRRHIRRVPE<br>PCALPEGDE<br>(SEQ ID NO: 1573) | IPR043502,<br>SSF56672,<br>IPR000477,<br>PF00078,<br>PF06817,<br>IPR010661,<br>PF06815,<br>IPR010659 |
| POL_EIAVY | P03371 | Equine infectious anemia virus | TAWTFLKAMQKCSKKREARG<br>SREAPETNFPDTTEESAQQI<br>CCTRDSSDSKSVPRSERNKK<br>GIQCQGEGSSRGSQPGQFVG<br>VTYNLEKRPTTIVLINDTPL<br>NVLLDTGADTSVLTTAHYNR<br>LKYRGRKYQGTGIIGVGGNV<br>ETFSTPVTIKKKGRHIKTRM | IPR043502,<br>SSF56672,<br>IPR000477,<br>PF00078,<br>PF06817,<br>IPR010661,<br>PF06815,<br>IPR010659 |

TABLE 6-continued

Exemplary dimeric retroviral reverse transcriptases and their RT domain signatures

| Name | Accession | Organism | Sequence | RT Signatures |
|---|---|---|---|---|
| | | | LVADIPVTILGRDILQDLGA KLVLAQLSKEIKFRKIELKE GTMGPKIPQWPLTKEKLEGA KETVQRLLSEGKISEASDNN PYNSPIFVIKKRSGKWRLLQ DLRELNKTVQVGTEISRGLP HPGGLIKCKHMTVLDIGDAY FTIPLDPEFRPYTAFTIPSI NHQEPDKRYVWKCLPQGFVL SPYIYQKTLQEILQPFRERY PEVQLYQYMDDLFVGSNGSK KQHKELIIELRAILQKGFET PDDKLQEVPPYSWLGYQLCP ENWKVQKMQLDMVKNPTLND VQKLMGNITWMSSGVPGLTV KHIAATTKGCLELNQKVIWT EEAQKELEENNEKIKNAQGL QYYNPEEEMLCEVEITKNYE ATYVIKQSQGILWAGKKIMK ANKGWSTVKNLMLLLQHVAT ESITRVGKCPTFKVPFTKEQ VMWEMQKGWYYSWLPEIVYT HQVVHDDWRMKLVEEPTSGI TIYTDGGKQNGEGIAAYVTS NGRTKQKRLGPVTHQVAERM AIQMALEDTRDKQVNIVTDS YYCWKNITEGLGLEGPQNPW WPIIQNIREKEIVYFAWVPG HKGIYGNQLADEAAKIKEEI MLAYQGTQIKEKRDEDAGFD LCVPYDIMIPVSDTKIIPTD VKIQVPPNSFGWVTGKSSMA KQGLLINGGIIDEGYTGEIQ VICTNIGKSNIKLIEGQKFA QLIILQHHSNSRQPWDENKI SQRGDKGFGSTGVFWVENIQ EAQDEHENWHTSPKILARNY KIPLTVAKQITQECPHCTKQ GSGPAGCVMRSPNHWQADCT HLDNKIILHFVESNSGYIHA TLLSKENALCTSLAILEWAR LFSPKSLHTDNGTNFVAEPV VNLLKFLKIAHTTGIPYHPE SQGIVERANRTLKEKIQSHR DNTQTLEAALQLALITCNKG RESMGGQTPWEVFITNQAQV IHEKLLLQQAQSSKKFCFYK IPGEHDWKGPTRVLWKGDGA VVVNDEGKGIIAVPLTRTKL LIKPN (SEQ ID NO: 1574) | |
| POL_BIV29 | P19560 | Bovine immuno-deficiency virus | MKRRELEKKLRKVRVTPQQD KYYTIGNLQWAIRMINLMGI KCVCDEECSAAEVALIITQF SALDLENSPIRGKEEVAIKN TLKVFWSLLAGYKPESTETA LGYWEAFTYREREARADKEG EIKSIYPSLTQNTQNKKQTS NQTNTQSLPAITTQDGTPRF DPDLMKQLKIWSDATERNGV DLHAVNILGVITANLVQEEI KLLLNSTPKWRLDVQLIESK VREKENAHRTWKQHHPEAPK TDEIIGKGLSSAEQATLISV ECRETFRQWVLQAAMEVAQA KHATPGPINIHQGPKEPYTD FINRLVAALEGMAAPETTKE YLLQHLSIDHANEDCQSILR PLGPNTPMEKKLEACRVVGS QKSKMQFLVAAMKEMGIQSP IPAVLPHTPEAYASQTSGPE DGRRCYGCGKTGHLKRNCKQ QKCYHCGKPGHQARNCRSKN | IPR043502, SSF56672, IPR000477, PF00078, PF06817, IPR010661 |

TABLE 6-continued

Exemplary dimeric retroviral reverse transcriptases and their RT domain signatures

| Name | Accession | Organism | Sequence | RT Signatures |
|---|---|---|---|---|
| | | | REVLLCPLWAEEPTTEQFSP EQHEFCDPICTPSYIRLDKQ PFIKVFIGGRWVKGLVDTGA DEVVLKNIHWDRIKGYPGTP IKQIGVNGVNVAKRKTHVEW RFKDKTGIIDVLFSDTPVNL FGRSLLRSIVTCFTLLVHTE KIEPLPVKVRGPGPKVPQWP LTKEKYQALKEIVKDLLAEG KISEAAWDNPYNTPVFVIKK KGTGRWRMLMDFRELNKITV KGQEFSTGLPYPPGIKECEH LTAIDIKDAYFTIPLHEDFR PFTAFSVVPVNREGPIERFQ WNVLPQGWVCSPAIYQTTTQ KIIENIKKSHPDVMLYQYMD DLLIGSNRDDHKQIVQEIRD KLGSYGFKTPDEKVQEERVK WIGFELTPKKWRFQPRQLKI KNPLTVNELQQLVGNCVWVQ PEVKIPLYPLTDLLRDKTNL QEKIQLTPEAIKCVEEFNLK LKDPEWKDRIREGAELVIKI QMVPRGIVFDLLQDGNPIWG GVKGLNYDHSNKIKKILRTM NELNRTVVIMTGREASFLLP GSSEDWEAALQKEESLTQIF PVKFYRHSCRWTSICGPVRE NLTTYYTDGGKKGKTAAAVY WCEGRTKSKVFPGTNQQAEL KAICMALLDGPPKMNIITDS RYAYEGMREEPETWAREGIW LEIAKILPFKQYVGVGWVPA HKGIGGNTEADEGVKKALEQ MAPCSPPEAILLKPGEKQNL ETGIYMQGLRPQSFLPRADL PVAITGTMVDSELQLQLLNI GTEHIRIQKDEVFMTCFLEN IPSATEDHERWHTSPDILVR QFHLPKRIAKEIVARCQECK RTTTSPVRGTNPRGRFLWQM DNTHWNKTIIWVAVETNSGL VEAQVIPEETALQVALCILQ LIQRYTVLHLHSDNGPCFTA HRIENLCKYLGITKTTGIPY NPQSQGVVERAHRDLKDRLA AYQGDCETVEAALSLALVSL NKKRGGIGGHTPYEIYLESE HTKYQDQLEQQFSKQKIEKW CYVRNRRKEWKGPYKVLWDG DGAAVIEEEGKTALYPHRHM RFIPPPDSDIQDGSS (SEQ ID NO: 1575) | |
| A0A142BKH1_ALV | A0A142BKH1 | Avian leukosis and sarcoma virus | TVALHLAIPLKWKPDHTPVW IDQWPLPEGKLVALTQLVEK ELQLGHIEPSLSCWNTPVFV IRKASGSYRLLHDLRAVNAK LVPFGAVQQGAPVLSALPRG WPLMVLDLKDCFFSIPLAEQ DREAFAFTLPSVNNQAPARR FQWKVLPQGMTCSPTICQLV VGQVLEPLRLKHPSLRMLHY MDDLLLAASSHDGLEAAGEE VISTLERAGFTISPDKIQRE PGVQYLGYKLGSTYVAPVGL VAEPRIATLWDVQKLVGSLQ WLRPALGIPPRLMGPFYEQL RGSDPNEAREWNLDMKMAWR EIVQLSTTAALERWDPALPL EGAVARCEQGAIGVLGQGLS THPRPCLWLFSTQPTKAFTA WLEVLTLLITKLRASAVRTF GKEVDVLLLPACFREDLPLP | IPR043502, SSF56672, IPR000477, PF00078, cd01645, PF06817, IPR010661 |

TABLE 6-continued

Exemplary dimeric retroviral reverse transcriptases and their RT domain signatures

| Name | Accession | Organism | Sequence | RT Signatures |
|------|-----------|----------|----------|---------------|
|      |           |          | EGILLALRGFAGKIRSSDTP SIFDIARPLHVSLKVRVTDH PVPGPTVFTDASSSTHKGVV VWREGPRWEIKEIADLGASV QQLEARAVAMALLLWPTTPT NVVTDSAFVAKMLLKMGQEG VPSTAAAFILEDALSQRSAM AAVLHVRSHSEVPGFFTEGN DVADSQATFQAYPLREAKDL HTALHIGPRALSKACNISMQ QAREVVQTCPHCNSAPALEA GVNPRGLGPLQIWQTDFTLE PRMAPRSWLAVTVATASSAI VVTQHGRVTSVAARHHWATA IAVLGRPKAIKTDNGSCFTS KSTREWLARWGIAHTTGIPG NSQGQAMVERANRLLKDKIR VLAEGDGFMKRIPTGKQGEL LAKAMYALNHFERGENTKTP IQKHWRPTVLTEGPPVKIRI ETGEWEKGWNVLVWGRGYAA VKNRDTDKIIWVPSRKVKPD ITQKDELTKKDEASPLFAGI SDWAPWKGEQEGL (SEQ ID NO: 1576) |  |

TABLE 7

InterPro descriptions of signatures present in reverse transcriptases in Table 5 (monomeric viral RTs) and Table 6 (dimeric viral RTs).

| Signature | Database | Short Name | Description |
|-----------|----------|------------|-------------|
| cd01645 | CDD | RT_Rtv | RT_Rtv: Reverse transcriptases (RTs) from retroviruses (Rtvs). RTs catalyze the conversion of single-stranded RNA into double-stranded viral DNA for integration into host chromosomes. Proteins in this subfamily contain long terminal repeats (LTRs) and are multifunctional enzymes with RNA-directed DNA polymerase, DNA directed DNA polymerase, and ribonuclease hybrid (RNase H) activities. The viral RNA genome enters the cytoplasm as part of a nucleoprotein complex, and the process of reverse transcription generates in the cytoplasm forming a linear DNA duplex via an intricate series of steps. This duplex DNA is colinear with its RNA template, but contains terminal duplications known as LTRs that are not present in viral RNA. It has been proposed that two specialized template switches, known as strand-transfer reactions or "jumps", are required to generate the LTRs. [PMID: 9831551, PMID: 15107837, PMID: 11080630, PMID: 10799511, PMID: 7523679, PMID: 7540934, PMID: 8648598, PMID: 1698615] |
| cd03715 | CDD | RT_ZFREV_like | RT_ZFREV_like: A subfamily of reverse transcriptases (RTs) found in sequences similar to the intact endogenous retrovirus ZFERV from zebrafish and to Moloney murine leukemia virus RT. An RT gene is usually indicative of a mobile element such as a retrotransposon or retrovirus. RTs occur in a variety of mobile elements, including retrotransposons, retroviruses, group II introns, bacterial msDNAs, hepadnaviruses, and caulimoviruses. These elements can be divided |

TABLE 7-continued

InterPro descriptions of signatures present in reverse transcriptases in Table 5 (monomeric viral RTs) and Table 6 (dimeric viral RTs).

| Signature | Database | Short Name | Description |
|---|---|---|---|
| | | | into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. Phylogenetic analysis suggests that ZFERV belongs to a distinct group of retroviruses. [PMID: 14694121, PMID: 2410413, PMID: 9684890, PMID: 10669612, PMID: 1698615, PMID: 8828137] |
| PF00078 | Pfam | RVT_1 | A reverse transcriptase gene is usually indicative of a mobile element such as a retrotransposon or retrovirus. Reverse transcriptases occur in a variety of mobile elements, including retrotransposons, retroviruses, group II introns, bacterial msDNAs, hepadnaviruses, and caulimoviruses. [PMID: 1698615] |
| IPR000477 | InterPro | RT_dom | The use of an RNA template to produce DNA, for integration into the host genome and exploitation of a host cell, is a strategy employed in the replication of retroid elements, such as the retroviruses and bacterial retrons. The enzyme catalysing polymerisation is an RNA-directed DNA-polymerase, or reverse trancriptase (RT) (2.7.7.49). Reverse transcriptase occurs in a variety of mobile elements, including retrotransposons, retroviruses, group II introns [PMID: 12758069], bacterial msDNAs, hepadnaviruses, and caulimoviruses. Retroviral reverse transcriptase is synthesised as part of the POL polyprotein that contains; an aspartyl protease, a reverse transcriptase, RNase H and integrase. POL polyprotein undergoes specific enzymatic cleavage to yield the mature proteins. The discovery of retroelements in the prokaryotes raises intriguing questions concerning their roles in bacteria and the origin and evolution of reverse transcriptases and whether the bacterial reverse transcriptases are older than eukaryotic reverse transcriptases [PMID: 8828137], Several crystal structures of the reverse transcriptase (RT) domain have been determined [PMID: 1377403]. |
| IPR043502 | InterPro | DNA/RNA polymerase superfamily | This entry represents the DNA/RNA polymerase superfamily, which includes DNA polymerase I, reverse transcriptase, T7 RNA polymerase, lesion bypass DNA polymerase (Y-family), RNA-dependent RNA-polymerase and dsRNA phage RNA-dependent RNA-polymerase. These enzymes share a similar protein fold at their active site, which resembles the palm subdomain of the right-hand-shaped polymerases. [PMID: 26931141] |
| SSF56672 | Superfamily | DNA/RNA polymerases | This superfamily comprises DNA polymerases and RNA polymerases |
| PF06817 | Pfam | RVT_thumb | This domain is known as the thumb domain. It is composed of a four helix bundle [PMID: 1377403]. |
| IPR010661 | InterPro | RVT_thumb | This domain is known as the thumb domain. It is composed of a four helix bundle. Reverse transcriptase converts the viral RNA genome into double-stranded viral DNA. Reverse transcriptase often occurs in a polyprotein; |

TABLE 7-continued

InterPro descriptions of signatures present in reverse transcriptases in Table 5 (monomeric viral RTs) and Table 6 (dimeric viral RTs).

| Signature | Database | Short Name | Description |
|---|---|---|---|
| | | | with integrase, ribonuclease H and/or protease, which is cleaved before the enzyme takes action. The impact of antiretroviral treatment on the first 400 amino acids of HIV reverse transcriptase is good. Little is known, however, of the antiretroviral drug impact on the C-terminal domains of Pol, which includes the thumb, connection and RNase H. Evidence suggests that these might be well conserved domains. [PMID: 1377403, PMID: 18335052] |
| PF06815 | Pfam | RVT_connect | This domain is known as the connection domain. This domain lies between the thumb and palm domains [PMID: 1377403]. |
| IPR010659 | InterPro | RVT_connect | This domain is known as the connection domain. This domain lies between the thumb and palm domains [PMID: 1377403]. |
| cd03715 | CDD | RT_ZFREV_like | RT_ZFREV_like: A subfamily of reverse transcriptases (RTs) found in sequences similar to the intact endogenous retrovirus ZFERV from zebrafish and to Moloney murine leukemia virus RT. An RT gene is usually indicative of a mobile element such as a retrotransposon or retrovirus. RTs occur in a variety of mobile elements, including retrotransposons, retroviruses, group II introns, bacterial msDNAs, hepadnaviruses, and caulimoviruses. These elements can be divided into two major groups. One group contains retroviruses and DNA viruses whose propagation involves an RNA intermediate. They are grouped together with transposable elements containing long terminal repeats (LTRs). The other group, also called poly(A)-type retrotransposons, contain fungal mitochondrial introns and transposable elements that lack LTRs. Phylogenetic analysis suggests that ZFERV belongs to a distinct group of retroviruses. [PMID: 14694121, PMID: 2410413, PMID: 9684890, PMID: 10669612, PMID: 1698615, PMID: 8828137] |

Table 8 provides a listing of retrotransposase proteins and the associated retrotransposon 5'UTRs and 3'UTRs for use in novel GENE WRITING™ systems. Reverse transcriptase domains in the proteins described here were identified using conserved RT signatures, and annotated to indicate the presence and location of RT domains within the polypeptide sequences. In some embodiments, a system or method described herein involves a polypeptide having an amino acid sequence according to Table 8, or a sequence having at least 70%, 75%, 80%, 85%, 90%, 95%, 96%, 97%, 98%, or 99% identity thereto, or a functional fragment thereof. In some embodiments, a system or method described herein involves a domain (e.g., a reverse transcriptase domain) having an amino acid sequence according to a domain (e.g., a reverse transcriptase domain) of Table 8, or a sequence having at least 70%, 75%, 80%, 85%, 90%, 95%, 96%, 97%, 98%, or 99% identity thereto, or functional fragment thereof. In some embodiments, a system or method described herein involves a template RNA comprising a sequence according to one or both of a predicted 5' UTR and a predicted 3' UTR of Table 8, or a sequence having at least 70%, 75%, 80%, 85%, 90%, 95%, 96%, 97%, 98%, or 99% identity thereto, or functional fragment thereof.

Lengthy table referenced here

US12157898-20241203-T00002

Please refer to the end of the specification for access instructions.

Table 9 provides Retroviral reverse transcriptase domains for use in GENE WRITER™ polypeptides. Wild-type reverse transcriptase enzymes were collected and prioritized as according to the descriptions herein (see Example 33). The Type column indicates whether the sequence corresponds to a wild-type sequence ("root") or comprises mutations that may improve the activity of the enzyme ("derivative").

TABLE 9

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| AVIRE_P03360 | AVIRE | P03360 | root | 3136 | TAPLEEEYRLFLEAPIQNVTLLEQWKREIPKVWAEINPPGLASTQAPIHV QLLSTALPVRVRQYPITLEAKRSLRETIRKFRAAGILRPVHSPWNTPLLP VRKSGTSEYRMVQDLREVNKRVETIHPTVPNPYTLLSLLPPDRIWYSVLD LKDAFFCIPLAPESQLIFAFEWADAEEGESGQLTWTRLPQGFKNSPTLFD EALNRDLQGFRLDHPSVSLLQYVDDLLIAADTQAACLSATRDLLMTLAEL GYRVSGKKAQLCQEEVTYLGFKIHKGSRSLSNSRTQAILQIPVPKTKRQV REFLGTIGYCRLWIPGFAELAQPLYAATRGGNDPLVWGEKEEEAFQSLKL ALTQPPALALPSLDKPFQLFVEETSGAAKGVLTQALGPWKRPVAYLSKRL DPVAAGWPRCLRAIAAAALLTREASKLTFGQDIEITSSHNLESLLRSPPD KWLTNARITQYQVLLLDPPRVRFKQTAALNPATLLPETDDTLPIHHCLDT LDSLTSTRPDLTDQPLAQAEATLFTDGSSYIRDGKRYAGAAVVTLDSVIW AEPLPIGTSAQKAELIALTKALEWSKDKSVNIYTDSRYAFATLHVHGMIY RERGLLTAGGKAIKNAPEILALLTAVWLPKRVAVMHCKGHQKDDAPTSTG NRRADEVAREVAIRPLSTQATIS |
| AVIRE_P03360_3mut | AVIRE | P03360 | derivative | 3137 | TAPLEEEYRLFLEAPIQNVTLLEQWKREIPKVWAEINPPGLASTQAPIHV QLLSTALPVRVRQYPITLEAKRSLRETIRKFRAAGILRPVHSPWNTPLLP VRKSGTSEYRMVQDLREVNKRVETIHPTVPNPYTLLSLLPPDRIWYSVLD LKDAFFCIPLAPESQLIFAFEWADAEEGESGQLTWTRLPQGFKNSPTLFN EALNRDLQGFRLDHPSVSLLQYVDDLLIAADTQAACLSATRDLLMTLAEL GYRVSGKKAQLCQEEVTYLGFKIHKGSRSLSNSRTQAILQIPVPK TKRQVREFLGTIGYCRLWIPGFAELAQPLYAATRPGNDPLVWGEKEEEAF QSLKLALTQPPALALPSLDKPFQLFVEETSGAAKGVLTQALGPWKRPVAY LSKRLDPVAAGWPRCLRAIAAAALLTREASKLTFGQDIEITSSHNLESLL RSPPDKWLTNARITQYQVLLLDPPRVRFKQTAALNPATLLPETDDTLPIH HCLDTLDSLTSTRPDLTDQPLAQAEATLFTDGSSYIRDGKRYAGAAVVTL DSVIWAEPLPIGTSAQKAELIALTKALEWSKDKSVNIYTDSRYAFATLHV HGMIYRERGWLTAGGKAIKNAPEILALLTAVWLPKRVAVMHCKGHQKDDA PTSTGNRRADEVAREVAIRPLSTQATIS |
| AVIRE_P03360_3mutA | AVIRE | P03360 | derivative | 3138 | TAPLEEEYRLFLEAPIQNVTLLEQWKREIPKVWAEINPPGLASTQAPIHV QLLSTALPVRVRQYPITLEAKRSLRETIRKFRAAGILRPVHSPWNTPLLP VRKSGTSEYRMVQDLREVNKRVETIHPTVPNPYTLLSLLPPDRIWYSVLD LKDAFFCIPLAPESQLIFAFEWADAEEGESGQLTWTRLPQGFKNSPTLFN EALNRDLQGFRLDHPSVSLLQYVDDLLIAADTQAACLSATRDLLMTLAEL GYRVSGKKAQLCQEEVTYLGFKIHKGSRSLSNSRTQAILQIPVPKTKRQV REFLGKIGYCRLFIPGFAELAQPLYAATRPGNDPLVWGEKEEEAFQSLKL ALTQPPALALPSLDKPFQLFVEETSGAAKGVLTQALGPWKRPVAYLSKRL DPVAAGWPRCLRAIAAAALLTREASKLTFGQDIEITSSHNLESLLRSPPD KWLTNARITQYQVLLLDPPRVRFKQTAALNPATLLPETDDTLPIHHCLDT LDSLTSTRPDLTDQPLAQAEATLFTDGSSYIRDGKRYAGAAVVTLDSVIW AEPLPIGTSAQKAELIALTKALEWSKDKSVNIYTDSRY AFATLHVHGMIYRERGWLTAGGKAIKNAPEILALLTAVWLPKRVAVMHCK GHQKDDAPTSTGNRRADEVAREVAIRPLSTQATIS |
| BAEVM_P10272 | BAEVM | P10272 | root | 3139 | TVSLQDEHRLFDIPVTTSLPDVWLQDFPQAWAETGGLGRAKCQAPIIIDL KPTAVPVSIKQYPMSLEAHMGIRQHIIKFLELGVLRPCRSPWNTPLLPVK KPGTQDYRPVQDLREINKRTVDIHPTVPNPYNLLSTLKPDYSWYTVLDLK DAFFCLPLAPQSQELFAFEWKDPERGISGQLTWTRLPQGFKNSPTLFDEA LHRDLTDFRTQHPEVTLLQYVDDLLLAAPTKKACTQGTRHLLQELGEKGY RASAKKAQICQTKVTYLGYILSEGKRWLTPGRIETVARIPPPRNPREVRE FLGTAGFCRLWIPGFAELAAPLYALTKESTPFTWQTEHQLAFEALKKALL SAPALGLPDTSKPFTLFLDERQGIAKGVLTQKLGPWKRPVAYLSKKLDPV AAGWPPCLRIMAATAMLVKDSAKLTLGQPLTVITPHTLEAIVRQPPDRWI TNARLTHYQALLLDTDRVQFGPPVTLNPATLLPVPENQPSPHDCRQVLAE THGTREDLKDQELPDADHTWYTDGSSYLDSGTRRAGAAVVDGHNTIWAQS LPPGTSAQKAELIALTKALELSKGKKANIYTDSRYAFATAHTHGSIYERR GLLTSEGKEIKNKAEIIALLKALFLPQEVAIIHCPGHQKGQDPVAVGNRQ ADRVARQAAMAEVLTLATEPDNTSHIT |
| BAEVM_P10272_3mut | BAEVM | P10272 | derivative | 3140 | TVSLQDEHRLFDIPVTTSLPDVWLQDFPQAWAETGGLGRAKCQAPIIIDL KPTAVPVSIKQYPMSLEAHMGIRQHIIKFLELGVLRPCRSPWNTPLLPVK KPGTQDYRPVQDLREINKRTVDIHPTVPNPYNLLSTLKPDYSWYTVLDLK DAFFCLPLAPQSQELFAFEWKDPERGISGQLTWTRLPQGFKNSPTLFNEA LHRDLTDFRTQHPEVTLLQYVDDLLLAAPTKKACTQGTRHLLQELGEKGY RASAKKAQICQTKVTYLGYILSEGKRWLTPGRIETVARIPPPRNPREVRE FLGTAGFCRLWIPGFAELAAPLYALTKPSTPFTWQTEHQLAFEALKKALL SAPALGLPDTSKPFTLFLDERQGIAKGVLTQKLGPWKRPVAYLSKKLDPV AAGWPPCLRIMAATAMLVKDSAKLTLGQPLTVITPHTLEAIVRQPPDRWI |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | TNARLTHYQALLLDTDRVQFGPPVTLNPATLLPVPENQPSPHDCRQVLAE THGTREDLKDQELPDADHTWYTDGSSYLDSGTRRAGAAVVDGHNTIWAQS LPPGTSAQKAELIALTKALELSKGKKANIYTDSRYAFATAHTHGSIYERR GWLTSEGKEIKNKAEIIALLKALFLPQEVAIIHCPGHQKGQDPVAVGNRQ ADRVARQAAMAEVLTLATEPDNTSHIT |
| BAEVM_P10272_3mutA | BAEVM | P10272 | derivative | 3141 | TVSLQDEHRLFDIPVTTSLPDVWLQDFPQAWAETGGLGRAKCQAPIIIDL KPTAVPVSIKQYPMSLEAHMGIRQHIIKFLEGVLRPCRSPWNTPLLPVK KPGTQDYRPVQDLREINKRTVDIHPTVPNPYNLLSTLKPDYSWYTVLDLK DAFFCLPLAPQSQELFAFEWKDPERGISGQLTWTRLPQGFKNSPTLFNEA LHRDLTDFRTQHPEVTLLQYVDDLLLAAPTKKACTQGTRHLLQELGEKGY RASAKKAQICQTKVTYLGYILSEGKRWLTPGRIETVARIPPPRNPREVRE FLGKAGFCRLFIPGFAELAAPLYALTKPSTPFTWQTEHQLAFEALKKALL SAPALGLPDTSKPFTLFLDERQGIAKGVLTQKLGPWKRPVAYLSKKLDPV AAGWPPCLRIMAATAMLVKDSAKLTLGQPLTVITPHTLEAIVRQPPDRWI TNARLTHYQALLLDTDRVQFGPPVTLNPATLLPVPENQPSPHDCRQVLAE THGTREDLKDQELPDADHTWYTDGSSYLDSGTRRAGAAVVDGHNTIWAQS LPPGTSAQKAELIALTKALELSKGKKANIYTDSRYAFATAHTHGSIYERR GWLTSEGKEIKNKAEIIALLKALFLPQEVAIIHCPGHQKGQDPVAVGNRQ ADRVARQAAMAEVLTLATEPDNTSHIT |
| BLVAU_P25059 | BLVA | P25059 | root | 3142 | GVLDAPPSHIGLEHLPPPPEVPQFPLNLERLQALQDLVHRSLEAGYISPW DGPGNNPVFPVRKPNGAWRFVHDLRVTNALTKPIPALSPGPPDLTAIPTH LPHIICLDLKDAFFQIPVEDRFRSYFAFTLPTPGGLQPHRRFAWRVLPQG FINSPALFERALQEPLRQVSAAFSQSLLVSYMDDILYVSPTEEQRLQCYQ TMAAHLRDLGFQVASEKTRQTPSPVPFLGQMVHERMVTYQSLPTLQISSP ISLHQLQTVLGDLQWVSRGTPTTRRPLQLLYSSLKGIDDPRAIIHLSPEQ QQGIAELRQALSHNARSRYNEQEPLLAYVHLTRAGSTLVLFQKGAQFPLA YFQTPLTDNQASPWGLLLLLGCQYLQAQALSSYAKTILKYYHNLPKTSLD NWIQSSEDPRVQELLQLWPQISSQGIQPPGPWKTLVTRAEVFLTPQFSPE PIPAALCLFSDGAARRGAYCLWKDHLLDFQAVPAPESA QKGELAGLLAGLAAAPPEPLNIWVDSKYLYSLLRTLVLGAWLQPDPVPSY ALLYKSLLRHPAIFVGHVRSHSSASHPIASLNNYVDQL |
| BLVAU_P25059_2mut | BLVAU | P25059 | derivative | 3143 | GVLDAPPSHIGLEHLPPPPEVPQFPLNLERLQALQDLVHRSLEAGYISPW DGPGNNPVFPVRKPNGAWRFVHDLRVTNALTKPIPALSPGPPDLTAIPTH LPHIICLDLKDAFFQIPVEDRFRSYFAFTLPTPGGLQPHRRFAWRVLPQG FINSPALFQRALQEPLRQVSAAFSQSLLVSYMDDILYVSPTEEQRLQCYQ TMAAHLRDLGFQVASEKTRQTPSPVPFLGQMVHERMVTYQSLPTLQISSP ISLHQLQTVLGDLQWVSRGTPTTRRPLQLLYSSLKPIDDPRAIIHLSPEQ QQGIAELRQALSHNARSRYNEQEPLLAYVHLTRAGSTLVLFQKGAQFPLA YFQTPLTDNQASPWGLLLLLGCQYLQAQALSSYAKTILKYYHNLPKTSLD NWIQSSEDPRVQELLQLWPQISSQGIQPPGPWKTLVTRAEVFLTPQFSPE PIPAALCLFSDGAARRGAYCLWKDHLLDFQAVPAPESAQKGELAGLLAGL AAAPPEPLNIWVDSKYLYSLLRTLVLGAWLQPDPVPSYALLYKSLLRHPA IFVGHVRSHSSASHPIASLNNYVDQL |
| BLVAU_P25059_2mutB | BLVAU | P25059 | derivative | 3144 | GVLDAPPSHIGLEHLPPPPEVPQFPLNLERLQALQDLVHRSLEAGYISPW DGPGNNPVFPVRKPNGAWRFVHDLRVTNALTKPIPALSPGPPDLTAPPTH LPHIICLDLKDAFFQIPVEDRFRSYFAFTLPTPGGLQPHRRFAWRVLPQG FINSPALFQRALQEPLRQVSAAFSQSLLVSYMDDILYVSPTEEQRLQCYQ TMAAHLRDLGFQVASEKTRQTPSPVPFLGQMVHERMVTYQSLPTLQISSP ISLHQLQTVLGDLQWVSRGTPTTRRPLQLLYSSLKPIDDPRAIIHLSPEQ QQGIAELRQALSHNARSRYNEQEPLLAYVHLTRAGSTLVLFQKGAQFPLA YFQTPLTDNQASPWGLLLLLGCQYLQAQALSSYAKTILKYYHNLPKTSLD NWIQSSEDPRVQELLQLWPQISSQGIQPPGPWKTLVTRAEVFLTPQFSPE PIPAALCLFSDGAARRGAYCLWKDHLLDFQAVPAPESAQKGELAGLLAGL AAAPPEPLNIWVDSKYLYSLLRTLVLGAWLQPDPVPSYALLYKSLLRHPA IFVGHVRSHSSASHPIASLNNYVDQL |
| BLVJ_P03361 | BLVJ | P03361 | root | 3145 | GVLDTPPSHIGLEHLPPPPEVPQFPLNLERLQALQDLVHRSLEAGYISPW DGPGNNPVFPVRKPNGAWRFVHDLRATNALTKPIPALSPGPPDLTAIPTH PPHIICLDLKDAFFQIPVEDRFRFYLSFTLPSPGGLQPHRRFAWRVLPQG FINSPALFERALQEPLRQVSAAFSQSLLVSYMDDILYASPTEEQRSQCYQ ALAARLRDLGFQVASEKTSQTPSPVPFLGQMVHEQIVTYQSLPTLQISSP ISLHQLQAVLGDLQWVSRGTPTTRRPLQLLYSSLKRHHDPRAIIQLSPEQ LQGIAELRQALSHNARSRYNEQEPLLAYVHLTRAGSTLVLFQKGAQFPLA YFQTPLTDNQASPWGLLLLLGCQYLQTQALSSYAKPILKYYHNLPKTSLD NWIQSSEDPRVQELLQLWPQISSQGIQPPGPWKTLITRAEVFLTPQFSPD |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_ name | uniprot_ ID | type | SEQ ID NO: | peptide |
|---|---|---|---|---|---|
| | | | | | PIPAALCLFSDGATGRGAYCLWKDHLLDFQAVPAPESAQKGELAGLLAGL AAAPPEPVNIWVDSKYLYSLLRTLVLGAWLQPDPVPSYALLYKSLLRHPA IVVGHVRSHSSASHPIASLNNYVDQL |
| BLVJ_ P03361_ 2mut | BLVJ | P03361 | derivative | 3146 | GVLDTPPSHIGLEHLPPPPEVPQFPLNLERLQALQDLVHRSLEAGYISPW DGPGNNPVFPVRKPNGAWRFVHDLRATNALTKPIPALSPGPPDLTAIPTH PPHIICLDLKDAFFQIPVEDRFRFYLSFTLPSPGGLQPHRRFAWRVLPQG FINSPALFNRALQEPLRQVSAAFSQSLLVSYMDDILYASPTEEQRSQCPE QLQGIAELRQALSHNARSRYNEQEPLLAYVHLTRAGSTLVLFQKGAQFPL AYFQTPLTDNQASPWGLLLLLGCQYLQTQALSSYAKPILKYYHNLPKTSL DNWIQSSEDPRVQELLQLWPQISSQGIQPPGPWKTLITRAEVFLTPQFSP DPIPAALCLFSDGATGRGAYCLWKDHLLDFQAVPAPESAQKGELAGLLAG LAAAPPEPVNIWVDSKYLYSLLRTWVLGAWLQPDPVPSYALLYKSLLRHP AIVVGHVRSHSSASHPIASLNNYVDQL |
| BLVJ_ P03361_ 2mutB | BLVJ | P03361 | derivative | 3147 | GVLDTPPSHIGLEHLPPPPEVPQFPLNLERLQALQDLVHRSLEAGYISPW DGPGNNPVFPVRKPNGAWRFVHDLRATNALTKPIPALSPGPPDLTAPP THPPHIICLDLKDAFFQIPVEDRFRFYLSFTLPSPGGLQPHRRFAWRVLP QGFINSPALFQRALQEPLRQVSAAFSQSLLVSYMDDILYASPTEEQRSQC YQALAARLRDLGFVASEKTSQTPSPVPFLGQMVHEQIVTYQSLPTLQIS SPISLHQLQAVLGDLQWVSRGTPTTRRPLQLLYSSLKRHHDPRAIIQLSP EQLQGIAELRQALSHNARSRYNEQEPLLAYVHLTRAGSTLVLFQKGAQFP LAYFQTPLTDNQASPWGLLLLLGCQYLQTQALSSYAKPILKYYHNLPKTS LDNWIQSSEDPRVQELLQLWPQISSQGIQPPGPWKTLITRAEVFLTPQFS PDPIPAALCLFSDGATGRGAYCLWKDHLLDFQAVPAPESAQKGELAGLLA GLAAAPPEPVNIWVDSKYLYSLLRTWVLGAWLQPDPVPSYALLYKSLLRH PAIVVGHVRSHSSASHPIASLNNYVDQL |
| FFV_ O93209 | FFV | O93209 | root | 3148 | MDLLKPLTVERKGVKIKGYWNSQADITCVPKDLLQGEEPVRQQNVTTIHG TQEGDVYYVNLKIDGRRINTEVIGTTLDYANITPGDVPWILKKPLELTIK LDLEEQQGTLLNNSILSKKGKEELKQLFEKYSALWQSWENQVGHRRIRPH KIATGTVKPTPQKQYHINPKAKPDIQIVINDLLKQGVLIQKESTMNTPVY PVPKPNGRWRMVLDYRAVNKVTPLIAVQNQHSYGILGSLFKGRYKTTIDL SNGFWAHPIVPEDYWITAFTWQGKQYCWTVLPQGFLNSPGLFTGDVVDLL QGIPNVEVYVDDVYISHDSEKEHLEYLDILFNRLKEAGYIISLKKSNIAN SIVDFLGFQITNEGRGLTDTFKEKLENITAPTTLKQLQSILGLLNFARNF IPDFTELIAPLYALIPKSTKNYVPWQIEHSTTLETLITKLNGAEYLQGRK GDKTLIMKVNASYTTGYIRYYNEGEKKPISYVSIVFSKTELKFTELEKLL TTVHKGLLKALDLSMGQNIHVYSPIVSMQNIQKTPQTAKKALASRWLSWL SYLEDPRIRFFYDPQMPALKDLPAVDTGKDNKKHPSNFQHIFYTDGSAIT SPTKEGHLNAGMGIVYFINKDGNLQKQQEWSISLGNHTAQFAEIAAFEFA LKKKCLPLGGNILVVTDSNYVAKAYNEELDVWASNGFVNNRKKPLKHISKW KSVADLKRLRPDVVVTHEPGHQKLDSSPHAYGNNLADQLATQASFKVH |
| FFV_ O93209- Pro | FFV | O93209 | derivative | 3149 | VPWILKKPLELTIKLDEEQQGTLLNNSILSKKGKEELKQLFEKYSALWQ SWENQVGHRRIRPHKIATGTVKPTPQKQYHINPKAKPDIQIVINDLLKQG VLIQKESTMNTPVYPVPKPNGRWRMVLDYRAVNKVTPLIAVQNQHSYGIL GSLFKGRYKTTIDLSNGFWAHPIVPEDYWITAFTWQGKQYCWTVLPQGFL NSPGLFTGDVVDLLQGIPNVEVYVDDVYISHDSEKEHLEYLDILFNRLKE AGYIISLKKSNIANSIVDFLGFQITNEGRGLTDTFKEKLENITAPTTLKQ LQSILGLLNFARNFIPDFTELIAPLYALIPKSTKNYVPWQIEHSTTLETL ITKLNGAEYLQGRKGDKTLIMKVNASYTTGYIRYYNEGEKKPISYVSIVF SKTELKFTELEKLLTTVHKGLLKALDLSMGQNIHVYSPIVSMQNIQKTPQ TAKKALASRWLSWLSYLEDPRIRFFYDPQMPALKDLPAVDTGKDNKKHPS NFQHIFYTDGSAITSPTKEGHLNAGMGIVYFINKDGNLQKQQEWSISLGN HTAQFAEIAAFEFALKKCLPLGGNILVVTDSNYVAKAYNEELDVWASNGF VNNRKKPLKHISKWKSVADLKRLRPDVVVTHEPGHQKLDSSPHAYGNNLA DQLATQASFKVH |
| FFV_ O93209- Pro_2 mut | FFV | O93209 | derivative | 3150 | VPWILKKPLELTIKLDEEQQGTLLNNSILSKKGKEELKQLFEKYSALWQ SWENQVGHRRIRPHKIATGTVKPTPQKQYHINPKAKPDIQIVINDLLKQG VLIQKESTMNTPVYPVPKPNGRWRMVLDYRAVNKVTPLIAVQNQHSYGIL GSLFKGRYKTTIDLSNGFWAHPIVPEDYWITAFTWQGKQYCWTVLPQGFL NSPGLFNGDVVDLLQGIPNVEVYVDDVYISHDSEKEHLEYLDILFNRLKE AGYIISLKKSNIANSIVDFLGFQITNEGRGLTDTFKEKLENITAPTTLKQ LQSILGLLNFARNFIPDFTELIAPLYALIPKSPKNYVPWQIEHSTTLETL ITKLNGAEYLQGRKGDKTLIMKVNASYTTGYIRYYNEGEKKPISYVSIVF SKTELKFTELEKLLTTVHKGLLKALDLSMGQNIHVYSPIVSMQNIQKTPQ TAKKALASRWLSWLSYLEDPRIRFFYDPQMPALKDLPAVDTGKDNKKHPS |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | NFQHIFYTDGSAITSPTKEGHLNAGMGIVYFINKDGNLQKQQEWSISLGN HTAQFAEIAAFEFALKKCLPLGGNILVVTDSNYVAKAYNEELDVWASNGF VNNRKKPLKHISKWKSVADLKRLRPDVVVTHEPGHQKLDSSPHAYGNNLA DQLATQASFKVH |
| FFV_O93209-Pro_2mutA | FFV | O93209 | derivative | 3151 | VPWILKKPLELTIKLDLEEQQGTLLNNSILSKKGKEELKQLFEKYSALWQ SWENQVGHRRIRPHKIATGTVKPTPQKQYHINPKAKPDIQIVINDLLKQG VLIQKESTMNTPVYPVPKPNGRWRMVLDYRAVNKVTPLIAVQNQHSYGIL GSLFKGRYKTTIDLSNGFWAHPIVPEDYWITAFTWQGKQYCWTVLPQGFL NSPGLFNGDVVDLLQGIPNVEVYVDDVYISHDSEKEHLEYLDILFNRLKE AGYIISLKKSNIANSIVDFLGFQITNEGRGLTDTFKEKLENITAPTTLKQ LQSILGKLNFARNFIPDFTELIAPLYALIPKSPKNYVPWQIEHSTTLETL ITKLNGAEYLQGRKGDKTLIMKVNASYTTGYIRYYNEGEKKPTGKDNKKH PSNFQHIFYTDGSAITSPTKEGHLNAGMGIVYFINKDGNLQKQQEWSISL GNHTAQFAEIAAFEFALKKCLPLGGNILVVTDSNYVAKAYNEELDVWASN GFVNNRKKPLKHISKWKSVADLKRLRPDVVVTHEPGHQKLDSSPHAYGNN LADQLATQASFKVH |
| FFV_O93209_2mut | FFV | O93209 | derivative | 3152 | MDLLKPLTVERKGVKIKGYWNSQADITCVPKDLLQGEEPVRQQNVTTIHG TQEGDVYYVNLKIDGRRINTEVIGTTLDYAIITPGDVPWILKKPLELTIK LDLEEQQGTLLNNSILSKKGKEELKQLFEKYSALWQSWENQVGHRRIRPH KIATGTVKPTPQKQYHINPKAKPDIQIVINDLLKQGVLIQKESTMNTPVY PVPKPNGRWRMVLDYRAVNKVTPLIAVQNQHSYGILGSLFKGRYKTTIDL SNGFWAHPIVPEDYWITAFTWQGKQYCWTVLPQGFLNSPG LFNGDVVDLLQGIPNVEVYVDDVYISHDSEKEHLEYLDILFNRLKEAGYI ISLKKSNIANSIVDFLGFQITNEGRGLTDTFKEKLENITAPTTLKQLQSI LGLLNFARNFIPDFTELIAPLYALIPKSPKNYVPWQIEHSTTLETLITKL NGAEYLQGRKGDKTLIMKVNASYTTGYIRYYNEGEKKPISYVSIVFSKTE LKFTELEKLLTTVHKGLLKALDLSMGQNIHVYSPIVSMQNIQKTPQTAKK ALASRWLSWLSYLEDPRIRFFYDPQMPALKDLPAVDTGKDNKKHPSNFQH IFYTDGSAITSPTKEGHLNAGMGIVYFINKDGNLQKQQEWSISLGNHTAQ FAEIAAFEFALKKCLPLGGNILVVTDSNYVAKAYNEELDVWASNGFVNNR KKPLKHISKWKSVADLKRLRPDVVVTHEPGHQKLDSSPHAYGNNLADQLA TQASFKVH |
| FFV_O93209_2mutA | FFV | O93209 | derivative | 3153 | MDLLKPLTVERKGVKIKGYWNSQADITCVPKDLLQGEEPVRQQNVTTIHG TQEGDVYYVNLKIDGRRINTEVIGTTLDYAIITPGDVPWILKKPLELTIK LDLEEQQGTLLNNSILSKKGKEELKQLFEKYSALWQSWENQVGHRRIRPH KIATGTVKPTPQKQYHINPKAKPDIQIVINDLLKQGVLIQKESTMNTPVY PVPKPNGRWRMVLDYRAVNKVTPLIAVQNQHSYGILGSLFKGRYKTTIDL SNGFWAHPIVPEDYWITAFTWQGKQYCWTVLPQGFLNSPGLFNGDVVDLL QGIPNVEVYVDDVYISHDSEKEHLEYLDILFNRLKEAGYIISLKKSNIAN SIVDFLGFQITNEGRGLTDTFKEKLENITAPTTLKQLQSILGKLNFARNF IPDFTELIAPLYALIPKSPKNYVPWQIEHSTTLETLITKLNGAEYLQGRK GDKTLIMKVNASYTTGYIRYYNEGEKKPISYVSIVFSKTELKFTELEKLL TTVHKGLLKALDLSMGQNIHVYSPIVSMQNIQKTPQTAKKALASRWLSWL SYLEDPRIRFFYDPQMPALKDLPAVDTGKDNKKHPSNFQHIFYTDGSAIT SPTKEGHLNAGMGIVYFINKDGNLQKQQEWSISLGNHTAQFAEIAAFEFA LKKCLPLGGNILVVTDSNYVAKAYNEELDVWASNGFVNNRKKPLKHISKW KSVADLKRLRPDVVVTHEPGHQKLDSSPHAYGNNLADQLATQASFKVH |
| FLV_P10273 | FIV | P10273 | root | 3154 | TLQLEEEYRLFEPESTQKQEMDIWLKNFPQAWAETGGMGTAHCQAPVLIQ LKATATPISIRQYPMPHEAYQGIKPHIRRMLDQGILKPCQSPWNTPLLPV KKPGTEDYRPVQDLREVNKRVEDIHPTVPNPYNLLSTLPPSHPWYTVLDL KDAFFCLRLHSESQLLFAFEWRDPEIGLSGQLTWTRLPQGFKNSPTLFDE ALHSDLADFRVRYPALVLLQYVDDLLLAAATRTECLEGTKALLETLGNKG YRASAKKAQICLQEVTYLGYSLKDGQRWLTKARKEAILSIPVPKNSRQVR EFLGTAGYCRLWIPGFAELAAPLYPLTRPGTLFQWGTEQQLAFEDIKKAL LSSSPALGLPDITKPFELFIDENSGFAKGVLVQKLGPWKRPVAYLSKKLD TVASGWPPCLRMVAAIAILVKDAGKLTLGQPLTILTSHPVEALVRQPPNKW LSNARMTHYQAMLLDAERVHFGPTVSLNPATLL PLPSGGNHHDCLQILAETHGTRPDLTDQPLPDADLTWYTDGSSFIRNGER EAGAAVTTESEVIWAAPLPPGTSAQRAELIALTQALKMAEGKKLTVYTDS RYAFATTHVHGEIYRRGLLTSEGKEIKNKNEILALLEALFLPKRLSIIH CPGHQKGDSPQAKGNRLADDTAKKAATETHSSLTVLP |
| FLV_P10273_3mut | FLV | P10273 | derivative | 3155 | TLQLEEEYRLFEPESTQKQEMDIWLKNFPQAWAETGGMGTAHCQAPVLIQ LKATATPISIRQYPMPHEAYQGIKPHIRRMLDQGILKPCQSPWNTPLLPV KKPGTEDYRPVQDLREVNKRVEDIHPTVPNPYNLLSTLPPSHPWYTVLDL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_ name | uniprot_ ID | type | SEQ ID NO: | peptide |
|---|---|---|---|---|---|
| | | | | | KDAFFCLRLHSESQLLFAFEWRDPEIGLSGQLTWTRLPQGFKNSPTLFNE ALHSDLADFRVRYPALVLLQYVDDLLLAAATRTECLEGTKALLETLGNKG YRASAKKAQICLQEVTYLGYSLKDGQRWLTKARKEAILSIPVPKNSRQVR EFLGTAGYCRLWIPGFAELAAPLYPLTRPGTLFQWGTEQQLAFEDIKKAL LSSSPALGLPDITKPFELFIDENSGFAKGVLVQKLGPWKRPVAYLSKKLDT VASGWPPCLRMVAAIAILVKDAGKLTLGQPLTILTSHPVEALVRQPPNKW LSNARMTHYQAMLLDAERVHFGPTVSLNPATLLPLPSGGNHHDCLQIIAE THGTRPDLTDQPLPDADLTWYTDGSSFIRNGEREAGAAVTTESEVIWAAP LPPGTSAQRAELIALTQALKMAEGKKLTVYTDSRYAFATTHVHGEIYRRR GWLTSEGKEIKNKNEILALLEALFLPKRLSIIHCPGHQKGDSPQAKGNRL ADDTAKKAATETHSSLTVLP |
| FLV_ P10273_ 3mutA | FLV | P10273 | derivative | 3156 | TLQLEEEYRLFEPESTQKQEMDIWLKNFPQAWAETGGMGTAHCQAPVLIQ LKATATPISIRQYPMPHEAYQGIKPHIRRMLDQGILKPCQSPWNTPLLPV KKPGTEDYRPVQDLREVNKRVEDIHPTVPNPYNLLSTLPPSHPWYTVLDL KDAFFCLRLHSESQLLFAFEWRDPEIGLSGQLTWTRLPQGFKNSPTLFNE ALHSDLADFRVRYPALVLLQYVDDLLLAAATRTECLEGTKALLETLGNKG YRASAKKAQICLQEVTYLGYSLKDGQRWLTKARKEAILSIPVPKNSRQVR EFLGKAGYCRLFIPGFAELAAPLYPLTRPGTLFQWGTEQQLAFEDIKKAL LSSSPALGLPDITKPFELFIDENSGFAKGVLVQKLGPWKRPVAYLSKKLDT VASGWPPCLRMVAAIAILVKDAGKLTLGQPLTILTSHPVEALVRQPPNKW LSNARMTHYQAMLLDAERVHFGPTVSLNPATLLPLPSGGNHHDCLQIIAE THGTRPDLTDQPLPDADLTWYTDGSSFIRNGEREAGAAVTTESEVIWAAP LPPGTSAQRAELIALTQALKMAEGKKLTVYTDSRYAFATTHVHGEIYRRR GWLTSEGKEIKNKNEILALLEALFLPKRLSIIHCPGHQKGDSPQAKGNRL ADDTAKKAATETHSSLTVLP |
| FOAMV_ P14350 | FOAMV | P14350 | root | 3157 | MNPLQLLQPLPAEIKGTKLLAHWNSGATITCIPESFLEDEQPIKKTLIKT IHGEKQQNVYYVTFKVKGRKVEAEVIASPYEYILLSPTDVPWLTQQPLQL TILVPLQEYQEKILSKTALPEDQKQQLKTLFVKYDNLWQHWENQVGHRKI RPHNIATGDYPPRPQKQYPINPKAKPSIQIVIDDLLKQGVLTPQNSTMNT PVYPVPKPDGRWRMVLDYREVNKTIPLTAAQNQHSAGILATIVRQKYKTT LDLANGFWAHPITPESYWLTAFTWQGKQYCWTRLPQGFLNSPALFTADVV DLLKEIPNVQVYVDDIYLSHDDPKEHVQQLEKVFQILLQAGYVVSLKKSE IGQKTVEFLGFNITKEGRGLTDTFKTKLLNITPPKDLKQLQSILGLLNFA RNFIPNFAELVQPLYNLIASAKGKYIEWSEENTKQLNMVIEALNTASNLE ERLPEQRLVIKVNTSPSAGYVRYYNETGKKPIMYLNYVFSKAELKFSMLE KLLTTMHKALIKAMDLAMGQEILVYSPIVSMTKIQKTPLPERKALPIRWI TWMTYLEDPRIQFHYDKTLPELKHIPDVYTSSQSPVKHPSQYEGVFYTDG SAIKSPDPTKSNNAGMGIVHATYKPEYQVLNQWSIPLGNHTAQMAEIAAV EFACKKALKIPGPVLVITDSFYVAESANKELPYWKSNGFVNNKKKPLKHI SKWKSIAECLSMKPDITIQHEKGISLQIPVFILKGNALADKLATQGSYVV N |
| FOAMV_ P14350- Pro | FOAMV | P14350 | derivative | 3158 | VPWLTQQPLQLTILVPLQEYQEKILSKTALPEDQKQQLKTLFVKYDNLWQ HWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGIL ATIVRQKYKTTLDLANGFWAHPITPESYWLTAFTWQGKQYCWTRLPQGFL NSPALFTADVVDLLKEIPNVQVYVDDIYLSHDDPKEHVQQLEKVFQILLQ AGYVVSLKKSEIGQKTVEFLGFNITKEGRGLTDTFKTK LLNITPPKDLKQLQSILGLLNFARNFIPNFAELVQPLYNLIASAKGKYIE WSEENTKQLNMVIEALNTASNLEERLPEQRLVIKVNTSPSAGYVRYYNE TGKKPIMYLNYVFSKAELKFSMLEKLLTTMHKALIKAMDLAMGQEILVYS PIVSMTKIQKTPLPERKALPIRWITWMTYLEDPRIQFHYDKTLPELK HI PDVYTSSQSPVKHPSQYEGVFYTDGSAIKSPDPTKSNNAGMGIVHATYKP EYQVLNQWSIPLGNHTAQMAEIAAVEFACKKALKIPGPVLVITDS FYVA ESANKELPYWKSNGFVNNKKKPLKHISKWKSIAECLSMKPDITIQHEKGI SLQIPVFILKGNALADKLATQGSYVVN |
| FOAMV_ P14350- Pro_2 mut | FOAMV | P14350 | derivative | 3159 | VPWLTQQPLQLTILVPLQEYQEKILSKTALPEDQKQQLKTLFVKYDNLWQ HWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGIL ATIVRQKYKTTLDLANGFWAHPITPESYWLTAFTWQGKQYCWTRLPQGFL NSPALFNADVVDLLKEIPNVQVYVDDIYLSHDDPKEHVQQLEKVFQILLQ AGYVVSLKKSEIGQKTVEFLGFNITKEGRGLTDTFKTKLLNITPPKDLKQ LQSILGLLNFARNFIPNFAELVQPLYNLIAPAKGKYIEWSEENTKQLNMV IEALNTASNLEERLPEQRLVIKVNTSPSAGYVRYYNETGKKPIMYLNYVF SKAELKFSMLEKLLTTMHKALIKAMDLAMGQEILVYSPIVSMTKIQKTPL PERKALPIRWITWMTYLEDPRIQFHYDKTLPELKHIPDVYTSSQSPVKHP |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | SQYEGVFYTDGSAIKSPDPTKSNNAGMGIVHATYKPEYQVLNQWSIPLGN HTAQMAEIAAVEFACKKALKIPGPVLVITDSFYVAESANKELPYWKSNGF VNNKKKPLKHISKWKSIAECLSMKPDITIQHEKGISLQIPVFILKGNALA DKLATQGSYVVN |
| FOAMV_P14350-Pro_2mutA | FOAMV | P14350 | derivative | 3160 | VPWLTQQPLQLTILVPLQEYQEKILSKTALPEDQKQQLKTLFVKYDNLWQ HWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGIL ATIVRQKYKTTLDLANGFWAHPITPESYWLTAFTWQGKQYCWTRLPQGFL NSPALFNADVVDLLKEIPNVQVYVDDIYLSHDDPKEHVQQLEKVFQILLQ AGYVVSLKKSEIGQKTVEFLGFNITKEGRGLTDTFKTKLLNITPPKDLKQ LQSILGKLNFARNFIPNFAELVQPLYNLIAPAKGKYIEWSEENTKQLNMV IEALNTASNLEERLPEQRLVIKVNTSPSAGYVRYYNETGKKPIMYLNYVF SKAELKFSMLEKLLTTMHKALIKAMDLAMGQEILVYSPIVSMTKIQKTPL PERKALPIRWITWMTYLEDPRIQFHYDKTLPELKHIPDVYTSSQSPVKHP SQYEGVFYTDGSAIKSPDPTKSNNAGMGIVHATYKPEYQVLNQWSIPLGN HTAQMAEIAAVEFACKKALKIPGPVLVITDSFYVAESANKELPYWKSNGF VNNKKKPLKHISKWKSIAECLSMKPDITIQHEKGISLQIPVFILKGNALA DKLATQGSYVVN |
| FOAMV_P14350_2mut | FOAMV | P14350 | derivative | 3161 | MNPLQLLQPLPAEIKGTKLLAHWNSGATITCIPESFLEDEQPIKKTLIKT IHGEKQQNVYYVTFKVKGRKVEAEVIASPYEYILLSPTDVPWLTQQPLQL TILVPLQEYQEKILSKTALPEDQKQQLKTLFVKYDNLWQHWENQVGHRKI RPHNIATGDYPPRPQKQYPINPKAKPSIQIVIDDLLKQGVLTPQNSTMNT PVYPVPKPDGRWRMVLDYREVNKTIPLTAAQNQHSAGILATIVRQKYKTT LDLANGFWAHPITPESYWLTAFTWQGKQYCWTRLPQGFLNSPALFNADVV DLLKEIPNVQVYVDDIYLSHDDPKEHVQQLEKVFQILLQAGYVVSLKKSE IGQKTVEFLGFNITKEGRGLTDTFKTKLLNITPPKDLKQLQSILGLLNFA RNFIPNFAELVQPLYNLIAPAKGKYIEWSEENTKQLNMVIEALNTASNLE ERLPEQRLVIKVNTSPSAGYVRYYNETGKKPIMYLNYVFSKAELKFSMLE KLLTTMHKALIKAMDLAMGQEILVYSPIVSMTKIQKTPLPERKALPIRWI TWMTYLEDPRIQFHYDKTLPELKHIPDVYTSSQSPVKHPSQYEGVFYTDG SAIKSPDPTKSNNAGMGIVHATYKPEYQVLNQWSIPLGNHTAQMAEIAAV EFACKKALKIPGPVLVITDSFYVAESANKEL PYWKSNGFVNNKKKPLKHISKWKSIAECLSMKPDITIQHEKGISLQIPVF ILKGNALADKLATQGSYVVN |
| FOAMV_P14350_2mutA | FOAMV | P14350 | derivative | 3162 | MNPLQLLQPLPAEIKGTKLLAHWNSGATITCIPESFLEDEQPIKKTLIKT IHGEKQQNVYYVTFKVKGRKVEAEVIASPYEYILLSPTDVPWLTQQPLQL TILVPLQEYQEKILSKTALPEDQKQQLKTLFVKYDNLWQHWENQVGHRKI RPHNIATGDYPPRPQKQYPINPKAKPSIQIVIDDLLKQGVLTPQNSTMNT PVYPVPKPDGRWRMVLDYREVNKTIPLTAAQNQHSAGILATIVRQKYKTT LDLANGFWAHPITPESYWLTAFTWQGKQYCWTRLPQGFLNSPALFNADVV DLLKEIPNVQVYVDDIYLSHDDPKEHVQQLEKVFQILLQAGYVVSLKKSE IGQKTVEFLGFNITKEGRGLTDTFKTKLLNITPPKDLKQLQSILGKLNFA RNFIPNFAELVQPLYNLIAPAKGKYIEWSEENTKQLNMVIEALNTASNLE ERLPEQRLVIKVNTSPSAGYVRYYNETGKKPIMYLNYVFSKAELKFSMLE KLLTTMHKALIKAMDLAMGQEILVYSPIVSMTKIQKTPLPERKALPIRWI TWMTYLEDPRIQFHYDKTLPELKHIPDVYTSSQSPVKHPSQYEGVFYTDG SAIKSPDPTKSNNAGMGIVHATYKPEYQVLNQWSIPLGNHTAQMAEIAAV EFACKKALKIPGPVLVITDSFYVAESANKELPYWKSNGFVNNKKKPLKHI SKWKSIAECLSMKPDITIQHEKGISLQIPVFILKGNALADKLATQGSYVV N |
| GALV_P21414 | GALV | P21414 | root | 3163 | VLNLEEEYRLHEKPVPSSIDPSWLQLFPTVWAERAGMGLANQVPPVVVEL RSGASPVAVRQYPMSKEAREGIRPHIQKFLDLGVLVPCRSPWNTPLLPVK KPGTNDYRPVQDLREINKRVQDIHPTVPNPYNLLSSLPPSYTWYSVLDLK DAFFCLRLHPNSQPLFAFEWKDPEKGNTGQLTWTRLPQGFKNSPTLFDEA LHRDLAPFRALNPQVVLLQYVDDLLVAAPTYEDCKKGTQKLLQELSKLGY RVSAKKAQLCQREVTYLGYLLKEGKRWLTPARKATVMKIPVPTTPRQVRE FLGTAGFCRLWIPGFASLAAPLYPLTKESIPFIWTEEHQQAFDHIKKALL SAPALALPDLTKPFTLYIDERAGVARGVLTQTLGPWRRPVAYLSKKLDPV ASGWPTCLKAVAAVALLLKDADKLTLGQNVTVIASHSLESIVRQPPDRWM TNARMTHYQSLLLNERVSFAPPAVLNPATLLPVESEATPVHRCSEILAEE TGTRRDLEDQPLPGVPTWYTDGSSFITEGKRRAGAPIVDGKRTVWASSLP EGTSAQKAELVALTQALRLAEGKNINIYTDSRYAFATAHIHGAIYKQRGL LTSAGKDIKNKEEILALLEAIHLPRRVAIIHCPGHQRGSNPVATGNRRAD EAAKQAALSTRVLAGTTKP |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| GALV_P21414_3mut | GALV | P21414 | derivative | 3164 | VLNLEEEYRLHEKPVPSSIDPSWLQLFPTVWAERAGMGLANQVPPVVVEL RSGASPVAVRQYPMSKEAREGIRPHIQKFLDLGVLVPCRSPWNTPLLPVK KPGTNDYRPVQDLREINKRVQDIHPTVPNPYNLLSSLPPSYTWYSVLDLK DAFFCLRLHPNSQPLFAFEWKDPEKGNTGQLTWTRLPQGFKNSPTLFNEA LHRDLAPFRALNPQVVLLQYVDDLLVAAPTYEDCKKGTQKLLQELSKLGY RVSAKKAQLCQREVTYLGYLLKEGKRWLTPARKATVMKIPVPTTPRQVRE FLGTAGFCRLWIPGFASLAAPLYPLTKPSIPFIWTEEHQQAFDHIKKALL SAPALALPDLTKPFTLYIDERAGVARGVLTQTLGPWRRPVAYLSKKLDPV ASGWPTCLKAVAAVALLLKDADKLTLGQNVTVIASHSLESIVRQPPDRWM TNARMTHYQSLLLNERVSFAPPAVLNPATLLPVESEATPVHRCSEILAEE TGTRRDLEDQPLPGVPTWYTDGSSFITEGKRRAGAPIVDGKRTVWASSLP EGTSAQKAELVALTQALRLAEGKNINIYTDSRYAFATAHIHGAIYKQRGW LTSAGKDIKNKEEILALLEAIHLPRRVAIIHCPGHQRGSNPVATGNRRAD EAAKQAALSTRVLAGTTKP |
| GALV_P21414_3mutA | GALV | P21414 | derivative | 3165 | VLNLEEEYRLHEKPVPSSIDPSWLQLFPTVWAERAGMGLANQVPPVVVEL RSGASPVAVRQYPMSKEAREGIRPHIQKFLDLGVLVPCRSPWNTPLLPVK KPGTNDYRPVQDLREINKRVQDIHPTVPNPYNLLSSLPPSYTWYSVLDLK DAFFCLRLHPNSQPLFAFEWKDPEKGNTGQLTWTRLPQGFKNSPTLFNEA LHRDLAPFRALNPQVVLLQYVDDLLVAAPTYEDCKKGTQKLLQELSKLGY RVSAKKAQLCQREVTYLGYLLKEGKRWLTPARKATVMKIPVPTTPRQVRE FLGKAGFCRLFIPGFASLAAPLYPLTKPSIPFIWTEEHQQAFDHIKKALL SAPALALPDLTKPFTLYIDERAGVARGVLTQTLGP wRRPVAYLSKKLDPVASGWPTCLKAVAAVALLLKDADKLTLGQNVTVIAS HSLESIVRQPPDRWMTNARMTHYQSLLLNERVSFAPPAVLNPATL LPVESEATPVHRCSEILAEETGTRRDLEDQPLPGVPTWYTDGSSFITEGK RRAGAPIVDGKRTVWASSLPEGTSAQKAELVALTQALRLAEGKNINIYTD SRYAFATAHIHGAIYKQRGWLTSAGKDIKNKEEILALLEAIHLPRRVAII HCPGHQRGSNPVATGNRRADEAAKQAALSTRVLAGTTKP |
| HTL1A_P03362 | HTL1A | P03362 | root | 3166 | AVLGLEHLPRPPQISQFPLNPERLQALQHLVRKALEAGHIEPYTGPGNNP VFPVKKANGTWRFIHDLRATNSLTIDLSSSSPGPPDLSSLPTTLAHLQTI DLRDAFFQIPLPKQFQPYFAFTVPQQCNYGPGTRYAWKVLPQGFKNSPTL FEMQLAHILQPIRQAFPQCTILQYMDDILLASPSHEDLLLLSEATMASLI SHGLPVSENKTQQTPGTIKFLGQIISPNHLTYDAVPTVPIRSRWALPELQ ALLGEIQWVSKGTPTLRQPLHSLYCALQRHTDPRDQIYLNPSQVQSLVQL RQALSQNCRSRLVQTLPLLGAIMLTLTGTTTVVFQSKEQWPLVWLHAPLP HTSQCPWGQLLASAVLLLDKYTLQSYGLLCQTIHHNISTQTFNQFIQTSD HPSVPILLHHSHRFKNLGAQTGELWNTFLKTAAPLAPVKALMPVFTLSPV IINTAPCLFSDGSTSRAAYILWDKQILSQRSFPLPPPHKSAQRAELLGLL HGLSSARSWRCLNIFLDSKYLYHYLRTLALGTFQGRSSQAPFQALLPRLL SRKVVYLHHVRSHTNLPDPISRLNALTDALLITPVLQL |
| HTL1A_P03362_2mut | HTL1A | P03362 | derivative | 3167 | AVLGLEHLPRPPQISQFPLNPERLQALQHLVRKALEAGHIEPYTGPGNNP VFPVKKANGTWRFIHDLRATNSLTIDLSSSSPGPPDLSSLPTTLAHLQTI DLRDAFFQIPLPKQFQPYFAFTVPQQCNYGPGTRYAWKVLPQGFKNSPTL FQMQLAHILQPIRQAFPQCTILQYMDDILLASPSHEDLLLLSEATMASLI SHGLPVSENKTQQTPGTIKFLGQIISPNHLTYDAVPTVPIRSRWALPELQ ALLGEIQWVSKGTPTLRQPLHSLYCALQPHTDPRDQIYLNPSQVQSLVQL RQALSQNCRSRLVQTLPLLGAIMLTLTGTTTVVFQSKEQWPLVWLHAPLP HTSQCPWGQLLASAVLLLDKYTLQSYGLLCQTIHHNISTQTFNQFIQTSD HPSVPILLHHSHRFKNLGAQTGELWNTFLKTAAPLAPVKALMPVFTLSPV IINTAPCLFSDGSTSRAAYILWDKQILSQRSFPLPPPHKSAQRAELLGLL HGLSSARSWRCLNIFLDSKYLYHYLRTLALGTFQGRSSQAPFQALLPRLL SRKVVYLHHVRSHTNLPDPISRLNALTDALLITPVLQL |
| HTL1A_P03362_2mutB | HTL1A | P03362 | derivative | 3168 | AVLGLEHLPRPPQISQFPLNPERLQALQHLVRKALEAGHIEPYTGPGNNP VFPVKKANGTWRFIHDLRATNSLTIDLSSSSPGPPDLSSPPTTLAHLQTI DLRDAFFQIPLPKQFQPYFAFTVPQQCNYGPGTRYAWKVLPQGFKNSPTL FQMQLAHILQPIRQAFPQCTILQYMDDILLASPSHEDLLLLSEATMASVQ LRQALSQNCRSRLVQTLPLLGAIMLTLTGTTTVVFQSKEQWPLVWLHAPL PHTSQCPWGQLLASAVLLLDKYTLQSYGLLCQTIHHNISTQTFNQFIQTS DHPSVPILLHHSHRFKNLGAQTGELWNTFLKTAAPLAPVKALMPVFTLSP VIINTAPCLFSDGSTSRAAYILWDKQILSQRSFPLPPPHKSAQRAELLGL LHGLSSARSWRCLNIFLDSKYLYHYLRTLALGTFQGRSSQAPFQALLPRL LSRKVVYLHHVRSHTNLPDPISRLNALTDALLITPVLQL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_<br>name | uniprot_<br>ID | type | SEQ<br>ID<br>NO: | peptide |
|---|---|---|---|---|---|
| HTL1C_<br>P14078 | HTL1C | P14078 | root | 3169 | AVLGLEHLPRPPEISQFPLNPERLQALQHLVRKALEAGHIEPYTGPGNNP<br>VFPVKKANGTWRFIHDLRATNSLTIDLSSSSPGPPDLSSLPTTLAHLQTI<br>DLKDAFFQIPLPKQFQPYFAFTVPQQCNYGPGTRYAWRVLPQGFKNSPTL<br>FEMQLAHILQPIRQAFPQCTILQYMDDILLASPSHADLQLLSEATMASVQ<br>LRQALSQNCRSRLVQTLPLLGAIMLTLTGTTTVVFQSKQQWPLVWLHAPL<br>PHTSQCPWGQLLASAVLLLDKYTLQSYGLLCQTIHHNISTQTFNQFIQTS<br>DHPSVPILLHHSHRFKNLGAQTGELWNTFLKTTAPLAPVKALMPVFTLSP<br>VIINTAPCLFSDGSTSQAAYILWDKHILSQRSFPLPPPHKSAQRAELLGL<br>LHGLSSARSWRCLNIFLDSKYLYHYLRTLALGTFQGRSSQAPFQALLPRL<br>LSRKVVYLHHVRSHTNLPDPISRLNALTDALLITPVLQL |
| HTL1C_<br>P14078_2<br>mut | HTL1C | P14078 | derivative | 3170 | AVLGLEHLPRPPEISQFPLNPERLQALQHLVRKALEAGHIEPYTGPGNNP<br>VFPVKKANGTWRFIHDLRATNSLTIDLSSSSPGPPDLSSLPTTLAHLQTI<br>DLKDAFFQIPLPKQFQPYFAFTVPQQCNYGPGTRYAWRVLPQGFKNSPTL<br>FQMQLAHILQPIRQAFPQCTILQYMDDILLASPSHADLQLLSEATMA<br>SLISHGLPVSENKTQQTPGTIKFLGQIISPNHLTYDAVPKVPIRSRWALP<br>ELQALLGEIQWVSKGTPTLRQPLHSLYCALQPHTDPRDQIYLNPSQVQSL<br>VQLRQALSQNCRSRLVQTLPLLGAIMLTLTGTTTVVFQSKQQWPLVWLHA<br>PLPHTSQCPWGQLLASAVLLLDKYTLQSYGLLCQTIHHNISTQTFNQFIQ<br>TSDHPSVPILLHHSHRFKNLGAQTGELWNTFLKTTAPLAPVKALMPVFTL<br>SPVIINTAPCLFSDGSTSQAAYILWDKHILSQRSFPLPPPHKSAQRAELL<br>GLLHGLSSARSWRCLNIFLDSKYLYHYLRTLALGTFQGRSSQAPFQALLP<br>RLLSRKVVYLHHVRSHTNLPDPISRLNALTDALLITPVLQL |
| HTL1C_<br>P14078_2<br>mutB | HTL1C | P14078 | derivative | 3171 | AVLGLEHLPRPPEISQFPLNPERLQALQHLVRKALEAGHIEPYTGPGNNP<br>VFPVKKANGTWRFIHDLRATNSLTIDLSSSSPGPPDLSSPPTTLAHLQTI<br>DLKDAFFQIPLPKQFQPYFAFTVPQQCNYGPGTRYAWRVLPQGFKNSPTL<br>FQMQLAHILQPIRQAFPQCTILQYMDDILLASPSHADLQLLSEATMASLI<br>SHGLPVSENKTQQTPGTIKFLGQIISPNHLTYDAVPKVPIRSRWALPELQ<br>ALLGEIQWVSKGTPTLRQPLHSLYCALQPHTDPRDQIYLNPSQVQSLVQL<br>RQALSQNCRSRLVQTLPLLGAIMLTLTGTTTVVFQSKQQWPLVWLHAPLP<br>HTSQCPWGQLLASAVLLLDKYTLQSYGLLCQTIHHNISTQTFNQFIQTSD<br>HPSVPILLHHSHRFKNLGAQTGELWNTFLKTTAPLAPVKALMPVFTLSPV<br>IINTAPCLFSDGSTSQAAYILWDKHILSQRSFPLPPPHKSAQRAELLGLL<br>HGLSSARSWRCLNIFLDSKYLYHYLRTLALGTFQGRSSQAPFQALLPRLL<br>SRKVVYLHHVRSHTNLPDPISRLNALTDALLITPVLQL |
| HTL1L_<br>P0C211 | HTL1L | P0C211 | root | 3172 | GLEHLPRPPEISQFPLNPERLQALQHLVRKALEAGHIEPYTGPGNNPVFP<br>VKKANGTWRFIHDLRATNSLTVDLSSSSPGPPDLSSLPTTLAHLQTIDLK<br>DAFFQIPLPKQFQPYFAFTVPQQCNYGPGTRYAWKVLPQGFKNSPTLFEM<br>QLASILQPIRQAFPQCVILQYMDDILLASPSPEDLQQLSEATMASLISHG<br>LPVSQDKTQQTPGTIKFLGQUISPNHITYDAVPTVPIRSRWALPELQALL<br>GEIQWVSKGTPTLRQPLHSLYCALQGHTDPRDQIYLNPSQVQSLMQLQQA<br>LSQNCRSRLAQTLPLLGAIMLTLTGTTTVVFQSKQQWPLVWLHAPLPHTS<br>QCPWGQLLASAVLLLDKYTLQSYGLLCQTIHHNISIQTFNQFIQTSDHPS<br>VPILLHHSHRFKNLGAQTGELWNTFLKTAAPLAPVKALTPVFTLSPIIIN<br>TAPCLFSDGSTSQAAYILWDKHILSQRSFPLPPPHKSAQQAELLGLLHGL<br>SSARSWHCLNIFLDSKYLYHYLRTLALGTFQGKSSQAPFQALLPRLLAHK<br>VIYLHHVRSHTNLPDPISKLNALTDALLITPIL |
| HTL1L_<br>P0C211_2<br>mut | HTL1L | P0C211 | derivative | 3173 | GLEHLPRPPEISQFPLNPERLQALQHLVRKALEAGHIEPYTGPGNNPVFP<br>VKKANGTWRFIHDLRATNSLTVDLSSSSPGPPDLSSLPTTLAHLQTIDLK<br>DAFFQIPLPKQFQPYFAFTVPQQCNYGPGTRYAWKVLPQGFKNSPTLFQM<br>QLASILQPIRQAFPQCVILQYMDDILLASPSPEDLQQLSEATMASLISHG<br>LPVSQDKTQQTPGTIKFLGQIISPNHITYDAVPTVPIRSRWALPELQALL<br>GEIQWVSKGTPTLRQPLHSLYCALQGHTDPRDQIYLNPSQVQSLMQLQQA<br>LSQNCRSRLAQTLPLLGAIMLTLTGTTTVVFQSKQQWPLVWLHAPLPHTS<br>QCPWGQLLASAVLLLDKYTLQSYGLLCQTIHHNISIQTFNQFIQTSDHPS<br>VPILLHHSHRFKNLGAQTGELWNTFLKTAAPLAPVKALTPVFTLSPIIIN<br>TAPCLFSDGSTSQAAYILWDKHILSQRSFPLPPPHKSAQQAELLGLLHGL<br>SSARSWHCLNIFLDSKYLYHYLRTLAWGTFQGKSSQAPFQALLPRLLAHK<br>VIYLHHVRSHTNLPDPISKLNALTDALLITPIL |
| HTL1L_<br>P0C211_2<br>mutB | HTL1L | P0C211 | derivative | 3174 | GLEHLPRPPEISQFPLNPERLQALQHLVRKALEAGHIEPYTGPGNNPVFP<br>VKKANGTWRFIHDLRATNSLTVDLSSSSPGPPDLSSPPTTLAHLQTIDLK<br>DAFFQIPLPKQFQPYFAFTVPQQCNYGPGTRYAWKVLPQGFKNSPTLFQM<br>QLASILQPIRQAFPQCVILQYMDDILLASPSPEDLQQLSEATMASLISHG<br>LPVSQDKTQQTPGTIKFLGQUISPNHITYDAVPTVPIRSRWALPELQALL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | GEIQWVSKGTPTLRQPLHSLYCALQGHTDPRDQIYLNPSQVQSLMQLQQA LSQNCRSRLAQTLPLLGAIMLTLTGTTTVVFQSKQQWPLVWLHAPLPHTS QCPWGQLLASAVLLLDKYTLQSYGLLCQTIHHNISIQTFNQFIQTSDHPS VPILLHHSHRFKNLGAQTGELWNTFLKTAAPLAPVKALTPVFTLSPIIIN TAPCLFSDGSTSQAAYILWDKHILSQRSFPLPPPHKSAQQAE LLGLLHGLSSARSWHCLNIFLDSKYLYHYLRTLAWGTFQGKSSQAPFQAL LPRLLAHKVIYLHHVRSHTNLPDPISKLNALTDALLITPIL |
| HTL32_Q0R5R2 | HTL32 | Q0R5R2 | root | 3175 | GLEHLPPPPEVSQFPLNPERLQALTDLVSRALEAKHIEPYQGPGNNPIFP VKKPNGKWRFIHDLRATNSVTRDLASPSPGPPDLTSLPQGLPHLRTIDLT DAFFQIPLPTIFQPYFAFTLPQPNNYGPGTRYSWRVLPQGFKNSPTLFEQ QLSHILTPVRKTFPNSLIIQYMDDILLASPAPGELAALTDKVTNALTKEG LPLSPEKTQATPGPIHFLGQVISQDCITYETLPSINVKSTWSLAELQSML GELQWVSKGTPVLRSSLHQLYLALRGHRDPRDTIKLTSIQVQALRTIQKA LTLNCRSRLVNQLPILALIMLRPTGTTAVLFQTKQKWPLVWLHTPHPATS LRPWGQLLANAVIILDKYSLQHYGQVCKSFHHNISNQALTYYLHTSDQSS VAILLQHSHRFHNLGAQPSGPWRSLLQMPQIFQNIDVLRPPFTISPVVIN HAPCLFSDGSASKAAFIIWDRQVIHQQVLSLPSTCSAQAGELFGLLAGLQ KSQPWVALNIFLDSKFLIGHLRRMALGAFPGPSTQCELHTQLLPLLQGKT VYVHHVRSHTLLQDPISRLNEATDALMLAPLLPL |
| HTL32_Q0R5R2_2 mut | HTL32 | Q0R5R2 | derivative | 3176 | GLEHLPPPPEVSQFPLNPERLQALTDLVSRALEAKHIEPYQGPGNNPIFP VKKPNGKWRFIHDLRATNSVTRDLASPSPGPPDLTSLPQGLPHLRTIDLT DAFFQIPLPTIFQPYFAFTLPQPNNYGPGTRYSWRVLPQGFKNSPTLFQQ QLSHILTPVRKTFPNSLIIQYMDDILLASPAPGELAALTDKVTNALTKEG LPLSPEKTQATPGPIHFLGQVISQDCITYETLPSINVKSTWSLAELQSML GELQWVSKGTPVLRSSLHQLYLALRGHRDPRDTIKLTSIQVQALRTIQKA LTLNCRSRLVNQLPILALIMLRPTGTTAVLFQTKQKWPLVWLHTPHPATS LRPWGQLLANAVIILDKYSLQHYGQVCKSFHHNISNQALTYYLHTSDQSS VAILLQHSHRFHNLGAQPSGPWRSLLQMPQIFQNIDVLRPPFTISPVVIN HAPCLFSDGSASKAAFIIWDRQVIHQQVLSLPSTCSAQAGELFGLLAGLQ KSQPWVALNIFLDSKFLIGHLRRMAWGAFPGPSTQCELHTQLLPLLQGKT VYVHHVRSHTLLQDPISRLNEATDALMLAPLLPL |
| HTL32_Q0R5R2_2 mutB | HTL32 | Q0R5R2 | derivative | 3177 | GLEHLPPPPEVSQFPLNPERLQALTDLVSRALEAKHIEPYQGPGNNPIFP VKKPNGKWRFIHDLRATNSVTRDLASPSPGPPDLTSPPQGLPHLRTIDLT DAFFQIPLPTIFQPYFAFTLPQPNNYGPGTRYSWRVLPQGFKNSPTLFQQ QLSHILTPVRKTFPNSLIIQYMDDILLASPAPGELAALTDKVTNALTKEG LPLSPEKTQATPGPIHFLGQVISQDCITYETLPSINVKSTWSLAELQSML GELQWVSKGTPVLRSSLHQLYLALRGHRDPRDTIKLTSIQVQALRTIQKA LTLNCRSRLVNQLPILALIMLRPTGTTAVLFQTKQKWPLVWLHTPHPATS LRPWGQLLANAVIILDKYSLQHYGQVCKSFHHNISNQALTYYLHTSDQSS VAILLQHSHRFHNLGAQPSGPWRSLLQMPQIFQNIDVLRPPFTISPVVIN HAPCLFSDGSASKAAFIIWDRQVIHQQVLSLPSTCSAQAGELFGLLAGLQ KSQPWVALNIFLDSKFLIGHLRRMAWGAFPGPSTQCELHTQLLPLLQGKT VYVHHVRSHTLLQDPISRLNEATDALMLAPLLPL |
| HTL3P_Q4U0X6 | HTL3P | Q4U0X6 | root | 3178 | GLEHLPPPPEVSQFPLNPERLQALTDLVSRALEAKHIEPYQGPGNNPIFP VKKPNGKWRFIHDLRATNSLTRDLASPSPGPPDLTSLPQDLPHLRTIDLT DAFFQIPLPAVFQPYFAFTLPQPNNHGPGTRYSWRVLPQGFKNSPTLFEQ QLSHILAPVRKAFPNSLIIQYMDDILLASPALRELTALTDKVTNALTKEG LPMSLEKTQATPGSIHFLGQVISPDCITYETLPSIHVKSIWSLAELQSML GELQWVSKGTPVLRSSLHQLYLALRGHRDPRDTIELTSTQVQALKTIQKA LALNCRSRLVSQLPILALIILRPTGTTAVLFQTKQKWPLVWLHTPHPATS LRPWGQLLANAIITLDKYSLQHYGQICKSFHHNISNQALTYYLHTSDQSS VAILLQHSHRFHNLGAQPSGPWRSLLQVPQIFQNIDVLRPPFIISPVVID HAPCLFSDGATSKAAFILWDKQVIHQQVLPLSTCSAQAGELFGLLAGLQ KSKPWPALNIFLDSKFLIGHLRRMALGAFLGPSTQCDLHARLFPLLQGKT VYVHHVRSHTLLQDPISRLNEATDALMLAPLLPL |
| HTL3P_Q4U0X6_2 mut | HTL3P | Q4U0X6 | derivative | 3179 | GLEHLPPPPEVSQFPLNPERLQALTDLVSRALEAKHIEPYQGPGNNPIFP VKKPNGKWRFIHDLRATNSLTRDLASPSPGPPDLTSLPQDLPHLRTIDLT DAFFQIPLPAVFQPYFAFTLPQPNNHGPGTRYSWRVLPQGFKNSPTLFQQ QLSHILAPVRKAFPNSLIIQYMDDILLASPALRELTALTDKVTNALTKE GLPMSLEKTQATPGSIHFLGQVISPDCITYETLPSIHVKSIWSLAELQSM LGELQWVSKGTPVLRSSLHQLYLALRGHRDPRDTIELTSTQVQALKTIQK ALALNCRSRLVSQLPILALIILRPTGTTAVLFQTKQKWPLVWLHTPHPAT SLRPWGQLLANAIITLDKYSLQHYGQICKSFHHNISNQALTYYLHTSDQS SVAILLQHSHRFHNLGAQPSGPWRSLLQVPQIFQNIDVLRPPFIISPVVI |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | DHAPCLFSDGATSKAAFILWDKQVIHQQVLPLPSTCSAQAGELFGLLAGL QKSKPWPALNIFLDSKFLIGHLRRMAWGAFLGPSTQCDLHARLFPLLQGK TVYVHHVRSHTLLQDPISRLNEATDALMLAPLLPL |
| HTL3P_Q4UOX6_2mutB | HTL3P | Q4UOX6 | derivative | 3180 | GLEHLPPPPEVSQFPLNPERLQALTDLVSRALEAKHIEPYQGPGNNPIFP VKKPNGKWRFIHDLRATNSLTRDLASPSPGPPDLTSPPQDLPHLRTIDLT DAFFQIPLPLPAVFQPYFAFTLPQPNNHGPGTRYSWRVLPQGFKNSPTLFQQ QLSHILAPVRKAFPNSLIIQYMDDILLASPALRELTALTDKVTNALTKEG LPMSLEKTQATPGSIHFLGQVISPDCITYETLPSIHVKSIWSLAELQSML GELQWVSKGTPVLRSSLHQLYLALRGHRDPRDTIELTSTQVQALKTIQKA LALNCRSRLVSQLPILALIILRPTGTTAVLFQTKQKWPLVWLHTPHPATS LRPWGQLLANAIITLDKYSLQHYGQICKSFHHNISNQALTYYLHTSDQSS VAILLQHSHRFHNLGAQPSGPWRSLLQVPQIFQNIDVLRPPFIISPVVID HAPCLFSDGATSKAAFILWDKQVIHQQVLPLPSTCSAQAGELFGLLAGLQ KSKPWPALNIFLDSKFLIGHLRRMAWGAFLGPSTQCDLHARLFPLLQGKT VYVHHVRSHTLLQDPISRLNEATDALMLAPLLPL |
| HTLV2_P03363 | HTLV2 | P03363 | root | 3181 | HLPPPPQVDQFPLNLPERLQALNDLVSKALEAGHIEPYSGPGNNPVFPVK KPNGKWRFIHDLRATNAITTTLTSPSPGPPDLTSLPTALPHLQTIDLTDA FFQIPLPKQYQPYFAFTIPQPCNYGPGTRYAWTVLPQGFKNSPTLFEQQL AAVLNPMRKMFPTSTIVQYMDDILLASPTNEELQQLSQLTLQALTTHGLP ISQEKTQQTPGQIRFLGQVISPNHITYESTPTIPIKSQWTLTELQVILGE IQWVSKGTPILRKHLQSLYSALHGYRDPRACITLTPQQLHALHAIQQALO HNCRGRLNPALPLLGLISLSTSGTTSVIFQPKQNWPLAWLHTPHPPTSLC PWGHLLACTILTLDKYTLQHYGQLCQSFHHNMSKQALCDFLRNSPHPSVG ILIHHMGRFHNLGSQPSGPWKTLLHLPTLLQEPRLLRPIFTLSPVVLDTA PCLFSDGSPQKAAYVLWDQTILQQDITPLPSHETHSAQKGELLALICGLR AAKPWPSLNIFLDSKYLIKYLHSLAIGAFLGTSAHQTLQAALPPLLQGKT IYLHHVRSHTNLPDPISTFNEYTDSLILAPLVPL |
| HTLV2_P03363_2mut | HTLV2 | P03363 | derivative | 3182 | HLPPPPQVDQFPLNLPERLQALNDLVSKALEAGHIEPYSGPGNNPVFPVK KPNGKWRFIHDLRATNAITTTLTSPSPGPPDLTSLPTALPHLQTIDLTDA FFQIPLPKQYQPYFAFTIPQPCNYGPGTRYAWTVLPQGFKNSPTLFQQQL AAVLNPMRKMFPTSTIVQYMDDILLASPTNEELQQLSQLTLQALTTHGLP ISQEKTQQTPGQIRFLGQVISPNHITYESTPTIPIKSQWTLTELQVILGE IQWVSKGTPILRKHLQSLYSALHPYRDPRACITLTPQQLHALHAIQQALO HNCRGRLNPALPLLGLISLSTSGTTSVIFQPKQNWPLAWLHTPHPPTSLC PWGHLLACTILTLDKYTLQHYGQLCQSFHHNMSKQALCDFLRNSPHPSVG ILIHHMGRFHNLGSQPSGPWKTLLHLPTLLQEPRLLRPIFTLSPVVLDTA PCLFSDGSPQKAAYVLWDQTILQQDITPLPSHETHSAQKGELLALICGLR AAKPWPSLNIFLDSKYLIKYLHSLAIGAFLGTSAHQTLQAALPPLLQGKT IYLHHVRSHTNLPDPISTFNEYTDSLILAPLVPL |
| HTLV2_P03363_2mutB | HTLV2 | P03363 | derivative | 3183 | HLPPPPQVDQFPLNLPERLQALNDLVSKALEAGHIEPYSGPGNNPVFPVK KPNGKWRFIHDLRATNAITTTLTSPSPGPPDLTSPPTALPHLQTIDLTDA FFQIPLPKQYQPYFAFTIPQPCNYGPGTRYAWTVLPQGFKNSPTLFQQQL AAVLNPMRKMFPTSTIVQYMDDILLASPTNEELQQLSQLTLQALTTHGLP ISQEKTQQTPGQIRFLGQVISPNHITYESTPTIPIKSQWTLTELQVILGE IQWVSKGTPILRKHLQSLYSALHPYRDPRACITLTPQQLHALHAIQQALO HNCRGRLNPALPLLGLISLSTSGTTSVIFQPKQNWPLAWLHTPHPPTSLC PWGHLLACTILTLDKYTLQHYGQLCQSFHHNMSKQALCDFLRNSPHPSVG ILIHHMGRFHNLGSQPSGPWKTLLHLPTLLQEPRLLRPIFTLSPVVLDTA PCLFSDGSPQKAAYVLWDQTILQQDITPLPSHETHSAQKGELL ALICGLRAAKPWPSLNIFLDSKYLIKYLHSLAIGAFLGTSAHQTLQAALP PLLQGKTIYLHHVRSHTNLPDPISTFNEYTDSLILAPLVPL |
| JSRV_P31623 | JSRV | P31623 | root | 3184 | PLGTSDSPVTHADPIDWKSEEPVWVDQWPLTQEKLSAAQQLVQEQLRLGH IEPSTSAWNSPIFVIKKKSGKWRLLQDLRKVNETMMHMGALQPGLPTPSA IPDKSYIIVIDLKDCFYTIPLAPQDCKRFAFSLPSVNFKEPMQRYQWRVL PQGMTNSPTLCQKFVATAIAPVRQRFPQLYLVHYMDDILLAHTDEHLLYQ AFSILKQHLSLNGLVIADEKIQTHFPYNYLGFSLYPRVYNTQLVKLQTDH LKTLNDPQKLLGDINWIRPYLKLPTYTLQPLFDILKGDSDPASPRTLSLE GRTALQSIEEAIRQQQITYCDYQRSWGLYILPTPRAPTGVLYQDKPLRWI YLSATPTKHLLPYYELVAKIIAKGRHEAIQYFGMEPPFICVPYALEQQDW LFQFSDNWSIAFANYPGQITHHYPSDKLLQFASSHAFIFPKIVRRQPIPE ATLIFTDGSNGTAALIINHQTYYAQTSFSSAQVVELFAVHQALLTVPTS FNLFTDSSYVVGALQMIETVPIIGTTSPEVLNLFTLQQVLHCRQHPCFF GHIRAHSTLPGALVQGNHTADVLTKQVFFQS |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| JSRV_P31623_2mutB | JSRV | P31623 | derivative | 3185 | PLGTSDSPVTHADPIDWKSEEPVWVDQWPLTQEKLSAAQQLVQEQLRLGH IEPSTSAWNSPIFVIKKKSGKWRLLQDLRKVNETMMHMGALQPGLPTPSP IPDKSYIIVIDLKDCFYTIPLAPQDCKRFAFSLPSVNFKEPMQRYQWRVL PQGMTNSPTLCQKFVATAIAPVRQRFPQLYLVHYMDDILLAHTDEHLLYQ AFSILKQHLSLNGLVIADEKIQTHFPYNYLGFSLYPRVYNTQLVKLQTDH LKTLNDFQKLLGDINWIRPYLKLPTYTLQPLFDILKGDSDPASPRTLSLE GRTALQSIEEAIRQQQITYCDYQRSWGLYILPTPRAPTGVLYQDKPLRWI YLSATPTKHLLPYYELVAKIIAKGRHEAIQYFGMEPPFICVPYALEQQDW LFQFSDNWSIAFANYPGQITHHYPSDKLLQFASSHAFIFPKIVRRQPIPE ATLIFTDGSSNGTAALIINHQTYYAQTSFSSAQVVELFAVHQALLTVPTS FNLFTDSSYVVGALQMIETVPIIGTTSPEVLNLFTLIQQVLHCRQHPCFF GHIRAHSTLPGALVQGNHTADVLTKQVFFQS |
| KORV_Q9TTC1 | KORV | 101160 | root | 3186 | TLGDQGSRGSDPLPEPRVTLTVEGIPTEFLVNTGAEHSVLTKPMGKMGSK RTVVAGATGSKVYPWTTKRLLKIGQKQVTHSFLVIPECPAPLLGRDLLTK LKAQIQFSTEGPQVTWEDRPAMCLVLNLEEEYRLHEKPVPPSIDPSWLQL FPMVWAEKAGMGLANQVPPVVVELKSDASPVAVRQYPMSKEAREGIRPHI QRFLDLGILVPCQSPWNTPLLPVKKPGTNDYRPVQDLREVNKRVQDIHPT VPNPYNLLSSLPPSHTWYSVLDLKDAFFCLKLHPNSQPLFAFEWRDPEKG NTGQLTWTRLPQGFKNSPTLFDEALHRDLASFRALNPQVVMLQYVDDLLV AAPTYRDCKEGTRRLLQELSKLGYRVSAKKAQLCREEVTYLGYLLKGGKR WLTPARKATVMKIPTPTTPRQVREFLGTAGFCRLWIPGFASLAAPLYPLT REKVPFTWTEAHQEAFGRIKEALLSAPALALPDLTKPFALYVDEKEGVAR GVLTQTLGPWRRPVAYLSKKLDPVASGWPTCLKAIAAVALLLKDADKLTL GQNVLVIAPHNLESIVRQPPDRWMTNARMTHYQSLLLNERVSFAPPAILN PATLLPVESDDTPIHICSEILAEETGTRPDLRDQPLPGVPAWYTDGSSFI MDGRRQAGAAIVDNKRTVWASNLPEGTSAQKAELIALTQALRLAEGKSIN IYTDSRYAFATAHVHGAIYKQRGLLTSAGKDIKNKEEILALLEAIHLPKR VAIIHCPGHQRGTDPVATGNRKADEAAKQAAQSTRILTETTKN |
| KORV_Q9TTC1-Pro | KORV | Q9C1 | derivative | 3187 | LLGRDLLTKLKAQIQFSTEGPQVTWEDRPAMCLVLNLEEEYRLHEKPVPP SIDPSWLQLFPMVWAEKAGMGLANQVPPVVVELKSDASPVAVRQYPMSKE AREGIRPHIQRFLDLGILVPCQSPWNTPLLPVKKPGTNDYRPVQDLREVN KRVQDIHPTVPNPYNLLSSLPPSHTWYSVLDLKDAFFCLKLHPNSQPLFA FEWRDPEKGNTGQLTWTRLPQGFKNSPTLFDEALHRDLASFRALNPQVVM LQYVDDLLVAAPTYRDCKEGTRRLLQELSKLGYRVSAKKAQLCREEVTYL GYLLKGGKRWLTPARKATVMKIPTPTTPRQVREFLGTAGFCRLWIPGFAS LAAPLYPLTREKVPFTWTEAHQEAFGRIKEALLSAPALALPDLTKPFALY VDEKEGVARGVLTQTLGPWRRPVAYLSKKLDPVASGWPTCLKAIAAVALL LKDADKLTLGQNVLVIAPHNLESIVRQPPD RWMTNARMTHYQSLLLNERVSFAPPAILNPATLLPVESDDTPIHICSEIL AEETGTRPDLRDQPLPGVPAWYTDGSSFIMDGRRQAGAAIVDNKRTVWAS NLPEGTSAQKAELIALTQALRLAEGKSINIYTDSRYAFATAHVHGAIYKQ RGLLTSAGKDIKNKEEILALLEAIHLPKRVAIIHCPGHQRGTDPVATGNR KADEAAKQAAQSTRILTETTKN |
| KORV_Q9TTC1-Pro3 mut | KORV | Q9TTC1 | derivative | 3188 | PMSKEAREGIRPHIQRFLDLGILVPCQSPWNTPLLPVKKPGTNDYRPVQD LREVNKRVQDIHPTVPNPYNLLSSLPPSHTWYSVLDLKDAFFCLKLHPNS QPLFAFEWRDPEKGNTGQLTWTRLPQGFKNSPTLFNEALHRDLASFRALN PQVVMLQYVDDLLVAAPTYRDCKEGTRRLLQELSKLGYRVSAKKAQLCRE EVTYLGYLLKGGKRWLTPARKATVMKIPTPTTPRQVREFLGTAGFCRLWI PGFASLAAPLYPLTRPKVPFTWTEAHQEAFGRIKEALLSAPALALPDLTK PFALYVDEKEGVARGVLTQTLGPWRRPVAYLSKKLDPVASGWPTCLKAIA AVALLLKDADKLTLGQNVLVIAPHNLESIVRQPPDRWMTNARMTHYQSLL LNERVSFAPPAILNPATLLPVESDDTPIHICSEILAEETGTRPDLRDQPL PGVPAWYTDGSSFIMDGRRQAGAAIVDNKRTVWASNLPEGTSAQKAELIA LTQALRLAEGKSINIYTDSRYAFATAHVHGAIYKQRGWLTSAGKDIKNKE EILALLEAIHLPKRVAIIHCPGHQRGTDPVATGNRKADEAAKQAAQSTRI LTETTKN |
| KORV_Q9TTC1-Pro3 mutA | KORV | Q9TTC1 | derivative | 3189 | LLGRDLLTKLKAQIQFSTEGPQVTWEDRPAMCLVLNLEEEYRLHEKPVPP SIDPSWLQLFPMVWAEKAGMGLANQVPPVVVELKSDASPVAVRQYPMSKE AREGIRPHIQRFLDLGILVPCQSPWNTPLLPVKKPGTNDYRPVQDLREVN KRVQDIHPTVPNPYNLLSSLPPSHTWYSVLDLKDAFFCLKLHPNSQPLFA FEWRDPEKGNTGQLTWTRLPQGFKNSPTLFNEALHRDLASFRALNPQVVM LQYVDDLLVAAPTYRDCKEGTRRLLQELSKLGYRVSAKKAQLCREEVTYL GYLLKGGKRWLTPARKATVMKIPTPTTPRQVREFLGKAGFCRLFIPGFAS LAAPLYPLTRPKVPFTWTEAHQEAFGRIKEALLSAPALALPDLTKPFALY VDEKEGVARGVLTQTLGPWRRPVAYLSKKLDPVASGWPTCLKAIAAVALL |

TABLE 9-continued

Retroviral reverse transcriptase domains for use in Gene Writer™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | LKDADKLTLGQNVLVIAPHNLESIVRQPPDRWMTNARMTHYQSLLLNERV SFAPPAILNPATLLPVESDDTPIHICSEILAEETGTRPDLRDQPLPGVPA WYTDGSSFIMDGRRQAGAAIVDNKRTVWASNLPEGTSAQKAELIALTQAL RLAEGKSINIYTDSRYAFATAHVHGAIYKQRGWLTSAGKDIKNKEEILAL LEAIHLPKRVAIIHCPGHQRGTDPVATGNRKADEAAKQAAQSTRILTETT KN |
| KORV_Q9TTC1_3mut | KORV | Q9TTC1 | derivative | 3190 | TLGDQGSRGSDPLPEPRVTLTVEGIPTEFLVNTGAEHSVLTKPMGKMGSK RTVVAGATGSKVYPWTTKRLLKIGQKQVTHSFLVIPECPAPLLGRDLLTK LKAQIQFSTEGPQVTWEDRPAMCLVLNLEEEYRLHEKPVPPSIDPSWLQL FPMVWAEKAGMGLANQVPPVVVELKSDASPVAVRQYPMSKEAREGIRPHI QRFLDLGILVPCQSPWNTPLLPVKKPGTNDYRPVQDLREVNKRVQDIHPT VPNPYNLLSSLPPSHTWYSVLDLKDAFFCLKLHPNSQPLFAFEWRDPEKG NTGQLTWTRLPQGFKNSPTLFNEALHRDLASFRALNPQVVMLQYVDDLLV AAPTYRDCKEGTRRLLQELSKLGYRVSAKKAQLCREEVTYLGYLLKGGKR WLTPARKATVMKIPTPTTPRQVREFLGTAGFCRLWIPGFASLAAPLYPLT RPKVPFTWTEAHQEAFGRIKEALLSAPALALPDLTKPFALYVDEKEGVAR GVLTQTLGPWRRPVAYLSKKLDPVASGWPTCLKAIAAVALLLKDADKLTL GQNVLVIAPHNLESIVRQPPDRWMTNARMTHYQSLLLNERVSFAPPAILN PATLLPVESDDTPIHICSEILAEETGTRPDLRDQPLPGVPAWYTDGSSFI MDGRRQAGAAIVDNKRTVWASNLPEGTSAQKAELIALTQALRLAEGKSIN IYTDSRYAFATAHVHGAIYKQRGWLTSAGKDIKNKEEILALLEAIHLPKR VAIIHCPGHQRGTDPVATGNRKADEAAKQAAQSTRILTETTKN |
| KORV_Q9TTC1_3 | KORV mutA | Q9TTC1 | derivative | 3191 | TLGDQGSRGSDPLPEPRVTLTVEGIPTEFLVNTGAEHSVLTKPMGKMGSK RTVVAGATGSKVYPWTTKRLLKIGQKQVTHSFLVIPECPAPLLGRDL REGIRPHIQRFLDLGILVPCQSPWNTPLLPVKKPGTNDYRPVQDLREVNK RVQDIHPTVPNPYNLLSSLPPSHTWYSVLDLKDAFFCLKLHPNSQPLFAF EWRDPEKGNTGQLTWTRLPQGFKNSPTLFNEALHRDLASFRALNPQVVML QYVDDLLVAAPTYRDCKEGTRRLLQELSKLGYRVSAKKAQLCREEVTYLG YLLKGGKRWLTPARKATVMKIPTPTTPRQVREFLGKAGFCRLFIPGFASL AAPLYPLTRPKVPFTWTEAHQEAFGRIKEALLSAPALALPDLTKPFALYV DEKEGVARGVLTQTLGPWRRPVAYLSKKLDPVASGWPTCLKAIAAVALLL KDADKLTLGQNVLVIAPHNLESIVRQPPDRWMTNARMTHYQSLLLNERVS FAPPAILNPATLLPVESDDTPIHICSEILAEETGTRPDLRDQPLPGVPAW YTDGSSFIMDGRRQAGAAIVDNKRTVWASNLPEGTSAQKAELIALTQALR LAEGKSINIYTDSRYAFATAHVHGAIYKQRGWLTSAGKDIKNKEEILALL EAIHLPKRVAIIHCPGHQRGTDPVATGNRKADEAAKQAAQSTRILTETTK N |
| MLVAV_P03356 | MLVAV | P03356 | root | 3192 | TLNLEDEYRLYETSAEPEVSPGSTWLSDFPQAWAETGGMGLAVRQAPLII PLKATSTPVSIKQYPMSQEAKLGIKPHIQRLLDQGILVPCQSPWNTPLLP VKKPGTNDYRPVQDLREVNKRVEDIHPTVPNPYNLLSGLPPSHRWYTVLD LKDAFFCLRLHPTSQPLFAFEWRDPGMGISGQLTWTRLPQGFKNSPTLFD EALHRDLADFRIQHPDLILLQYVDDILLAATSELDCQQGTRALLLTLGNL GYRASAKKAQLCQKQVKYLGYLLKEGQRWLTEARKETVMGQPTPKTPRQL REFLGTAGFCRLWIPGFAEMAAPLYPLTKTGTLFNWGPDQQKAYQEIKQA LLTAPALGLPDLTKPFELFVDEKQGYAKGVLTQKLGPWRRPVAYLSKKLD PVAAGWPPCLRMVAAIAVLRKDAGKLTMGQPLVILAPHAVEALVKQPPDR WLSNARMTHYQAMLLDTDRVQFGPVVALNPATLLPLEEGAPHDCLEILA ETHGTRPDLTDQPIPDADHTWYTDGSSFLQEGQRKAGAAVTTETEVIWAR ALPAGTSAQRAELIALTQALKMAEGKRLNVYTDSRYAFATAHIHGEIYRR RGLLTSEGREIKNKSEILALLKALFLPKRLSIIHCLGHQKGDSAEARGNR LADQAAREAAIKTPPDSTLL |
| MLVAV_P03356_3mut | MLVAV | P03356 | derivative | 3193 | TLNLEDEYRLYETSAEPEVSPGSTWLSDFPQAWAETGGMGLAVRQAPLII PLKATSTPVSIKQYPMSQEAKLGIKPHIQRLLDQGILVPCQSPWNTPLLP VKKPGTNDYRPVQDLREVNKRVEDIHPTVPNPYNLLSGLPPSHRWYTVLD LKDAFFCLRLHPTSQPLFAFEWRDPGMGISGQLTWTRLPQGFKNSPTLFN EALHRDLADFRIQHPDLILLQYVDDILLAATSELDCQQGTRALLLTLGNL GYRASAKKAQLCQKQVKYLGYLLKEGQRWLTEARKETVMGQPTPKTPRQL REFLGTAGFCRLWIPGFAEMAAPLYPLTKPGTLFNWGPDQQKAYQEIKQA LLTAPALGLPDLTKPFELFVDEKQGYAKGVLTQKLGPWRRPVAYLSKKLD PVAAGWPPCLRMVAAIAVLRKDAGKLTMGQPLVILAPHAVEALVKQPPDR WLSNARMTHYQAMLLDTDRVQFGPVVALNPATLLPLEEGAPHDCLEILA ETHGTRPDLTDQPIPDADHTWYTDGSSFLQEGQRKAGAAVTTETEVIWAR ALPAGTSAQRAELIALTQALKMAEGKRLNVYTDSRYAFATAHIHGEIYRR RGWLTSEGREIKNKSEILALLKALFLPKRLSIIHCLGHQKGDSAEARGNR LADQAAREAAIKTPPDSTLL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| MLVAV_P03356_3mutA | MLVAV | P0335 | derivative | 3194 | TLNLEDEYRLYETSAEPEVSPGSTWLSDFPQAWAETGGMGLAVRQAPLII PLKATSTPVSIKQYPMSQEAKLGIKPHIQRLLDQGILVPCQSPWNTPLLP VKKPGTNDYRPVQDLREVNKRVEDIHPTVPNPYNLLSGLPPSHRWYTVLD LKDAFFCLRLHPTSQPLFAFEWRDPGMGISGQLTWTRLPQGFKNSPTLFN EALHRDLADFRIQHPDLILLQYVDDILLAATSELDCQQGTRALLLTLGNL GYRASAKKAQLCQKQVKYLGYLLKEGQRWLTEARKETVMGQPTPKTPRQL REFLGKAGFCRLFIPGFAEMAAPLYPLTKPGTLFNWGPDQQKAYQEIKQA LLTAPALGLPDLTKPFELFVDEKQGYAKGVLTQKLGPWRRPVAYLSKKLD PVAAGWPPCLRMVAAIAVLRKDAGKLTMGQPLVILAPHAVEALVKQPPDR WLSNARMTHYQAMLLDTDRVQFGPVVALNPATLLPLPEEGAPHDCLEILA ETHGTRPDLTDQPIPDADHTWYTDGSSFLQEGQRKAGAAVTTETEVIWAR ALPAGTSAQRAELIALTQALKMAEG KRLNVYTDSRYAFATAHIHGEIYRRRGWLTSEGREIKNKSEILALLKALF LPKRLSIIHCLGHQKGDSAEARGNRLADQAAREAAIKTPPDTSTLL |
| MLVBM_Q7SVK7_3mutAWS | MLVBM | Q7SVK7 | root | 3195 | LGIEDEYRLHETSTEPDVSLGSTWLSDFPQAWAETGGMGLAVRQAPLIIP LKATSTPVSIQQYPMSHEARLGIKPHIQRLLDQGILVPCQSPWNTPLLPV KKPGTNDYRPVQDLREVNKRVEDIHPTVPNPYNLLSGLPPSHQWYTVLDL KDAFFCLRLHPTSQPLFAFEWRDPGMGISGQLTWTRLPQGFKNSPTLFNE ALHRDLADFRIQHPDLILLQYVDDILLAATSELDCQQGTRALLQTLGDLG YRASAKKAQICQKQVKYLGYLLREGQRWLTEARKETVMGQ PVPKTPRQLREFLGKAGFCRLFIPGFAEMAAPLYPLTKPGTLFSWGPDQQ KAYQEIKQALLTAPALGLPDLTKPFELFVDEKQGYAKGVLTQKLGPWRRP VAYLSKKLDPVAAGWPPCLRMVAAIAVLTKDAGKLTMGQPLVILAPHAVE ALVKQPPDRWLSNARMTHYQAMLLDTDRVQFGPVVALNPATLLPLPEEGA PHDCLEILAETHGTRPDLTDQPIPDADHTWYTDGSSFLQEGQRKAGAAVT TETEVIWAGALPAGTSAQRAELIALTQALKMAEGKRLNVYTDSRYAFATA HIHGEIYRRRGWLTSEGREIKNKSEILALLKALFLPKRLSIIHCLGHQKG DSAEARGNRLADQAAREAAIKTPPDTSTLLI |
| MLVBM_Q7SVK7 | MLVBM | Q7SVK7 | derivative | 3196 | TLGIEDEYRLHETSTEPDVSLGSTWLSDFPQAWAETGGMGLAVRQAPLII PLKATSTPVSIQQYPMSHEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPGMGISGQLTWTRLPQGFKNSPTLFD EALHRDLADFRIQHPDLILLQYVDDILLAATSELDCQQGTRALLQTLGDL GYRASAKKAQICQKQVKYLGYLLREGQRWLTEARKETVMGQPVPKTPRQL REFLGTAGFCRLWIPGFAEMAAPLYPLTKTGTLFSWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVALNPATLLPLPEEGAPHDCLEILA ETHGTRPDLTDQPIPDADHTWYTDGSSFLQEGQRKAGAAVTTETEVIWAG ALPAGTSAQRAELIALTQALKMAEGKRLNVYTDSRYAFATAHIHGEIYRR RGLLTSEGREIKNKSEILALLKALFLPKRLSIIHCLGHQKGDSAEARGNR LADQAAREAAIKTPPDTSTLL |
| MLVBM_Q7SVK7_3mut | MLVBM | Q7SVK7 | derivative | 3197 | TLGIEDEYRLHETSTEPDVSLGSTWLSDFPQAWAETGGMGLAVRQAPLII PLKATSTPVSIQQYPMSHEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPGMGISGQLTWTRLPQGFKNSPTLFN EALHRDLADFRIQHPDLILLQYVDDILLAATSELDCQQGTRALLQTLGDL GYRASAKKAQICQKQVKYLGYLLREGQRWLTEARKETVMGQPVPKTPRQL REFLGTAGFCRLWIPGFAEMAAPLYPLTKPGTLFSWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVALNPATLLPLPEEGAPHDCLEILA ETHGTRPDLTDQPIPDADHTWYTDGSSFLQEGQRKAGAAVTTETEVIWAG ALPAGTSAQRAELIALTQALKMAEGKRLNVYTDSRYAFATAHIHGEIYRR RGWLTSEGREIKNKSEILALLKALFLPKRLSIIHCLGHQKGDSAEARGNR LADQAAREAAIKTPPDTSTLL |
| MLVBM_Q7SVK7_3mutAWS | MLVBM | Q7SVK7 | root | 3195 | LGIEDEYRLHETSTEPDVSLGSTWLSDFPQAWAETGGMGLAVRQAPLIIP LKATSTPVSIQQYPMSHEARLGIKPHIQRLLDQGILVPCQSPWNTPLLPV KKPGTNDYRPVQDLREVNKRVEDIHPTVPNPYNLLSGLPPSHQWYTVLDL KDAFFCLRLHPTSQPLFAFEWRDPGMGISGQLTWTRLPQGFKNSPTLFNE ALHRDLADFRIQHPDLILLQYVDDILLAATSELDCQQGTRALLQTLGDLG YRASAKKAQICQKQVKYLGYLLREGQRWLTEARKETVMGQPVPKTPRQLR EFLGKAGFCRLFIPGFAEMAAPLYPLTKPGTLFSWGPDQQKAYQEIKQAL LTAPALGLPDLTKPFELFVDEKQGYAKGVLTQKLGPWRRPVAYLSKKLDP |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | VAAGWPPCLRMVAAIAVLTKDAGKLTMGQPLVILAPHAVEALVKQPPDRW LSNARMTHYQAMLLDTDRVQFGPVVALNP ATLLPLPEEGAPHDCLEILAETHGTRPDLTDQPIPDADHTWYTDGSSFLQ EGQRKAGAAVTTETEVIWAGALPAGTSAQRAELIALTQALKMAEGKRLNV YTDSRYAFATAHIHGEIYRRRGWLTSEGREIKNKSEILALLKALFLPKRL SIIHCLGHQKGDSAEARGNRLADQAAREAAIKTPPDTSTLLI |
| MLVBM_Q7SVK7 | MLVBM | Q7SVK7 | derivative | 3196 | TLGIEDEYRLHETSTEPDVSLGSTWLSDFPQAWAETGGMGLAVRQAPLII PLKATSTPVSIQQYPMSHEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPGMGISGQLTWTRLPQGFKNSPTLFD EALHRDLADFRIQHPDLILLQYVDDILLAATSELDCQQGTRALLQTLGDL GYRASAKKAQICQKQVKYLGYLLREGQRWLTEARKETVMGQPVPKTPRQL REFLGTAGFCRLWIPGFAEMAAPLYPLTKTGTLFSWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVALNPATLLPLPEEGAPHDCLEILA ETHGTRPDLTDQPIPDADHTWYTDGSSFLQEGQRKAGAAVTTETEVIWAG ALPAGTSAQRAELIALTQALKMAEGKRLNVYTDSRYAFATAHIHGEIYRR RGLLTSEGREIKNKSEILALLKALFLPKRLSIIHCLGHQKGDSAEARGNR LADQAAREAAIKTPPDTSTLL |
| MLVBM_Q7SVK7_3mut | MLVBM | Q7SVK7 | derivative | 3197 | TLGIEDEYRLHETSTEPDVSLGSTWLSDFPQAWAETGGMGLAVRQAPLII PLKATSTPVSIQQYPMSHEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPGMGISGQLTWTRLPQGFKNSPTLFN EALHRDLADFRIQHPDLILLQYVDDILLAATSELDCQQGTRALLQTLGDL GYRASAKKAQICQKQVKYLGYLLREGQRWLTEARKETVMGQPVPKTPRQL REFLGTAGFCRLWIPGFAEMAAPLYPLTKPGTLFSWGPDQQKAYQEIKQA LLTAPALGLPDLTKPFELFVDEKQGYAKGVLTQKLGPATLLPLPEEGAPH DCLEILAETHGTRPDLTDQPIPDADHTWYTDGSSFLQEGQRKAGAAVTTE TEVIWAGALPAGTSAQRAELIALTQALKMAEGKRLNVYTDSRYAFATAHI HGEIYRRRGWLTSEGREIKNKSEILALLKALFLPKRLSIIHCLGHQKGDS AEARGNRLADQAAREAAIKTPPDTSTLL |
| MLVCB_P08361 | MLVCB | P08361 | root | 3198 | TLNIEDEYRLHETSKEPDVSLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFD EALHRDLAGFRIQHPDLILLQYVDDLLLAATSELDCQQGTRALLQTLGDL GYRASAKKAQICQKQVKYLGYLLKEGQRWLTEARKETVMGQPIPKTPRQL REFLGTAGFCRLWIPGFAEMAAPLYPLTKTGTLFNWGPDQQKAFQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPVVALNPATLLPLPEEGLQHDCLDILA EAHGTRSDLMDQPLPDADHTWYTDGSSFLQEGQRKAGAAVTTETEVIWAR ALPAGTSAQRAELIALTQALKMAEGKKLNVYTDSRYAFATAHIHGEIYRR RGLLTSEGKEIKNKDEILALLKALFLPKRLSIIHCPGHQKGNSAEARGNR MADQAAREVATRETPETSTLL |
| MLVCB_P08361_3mut | MLVCB | P08361 | derivative | 3199 | TLNIEDEYRLHETSKEPDVSLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFN EALHRDLAGFRIQHPDLILLQYVDDLLLAATSELDCQQGTRALLQTLGDL GYRASAKKAQICQKQVKYLGYLLKEGQRWLTEARKETVMGQPIPKTPRQL REFLGTAGFCRLWIPGFAEMAAPLYPLTKPGTLFNWGPDQQKAFQEIKQA LLTAPALGLPDLTKPFELFVDEKQGYAKGVLTQKLG PATLLPLPEEGLQHDCLDILAEAHGTRSDLMDQPLPDADHTWYTDGSSFL QEGQRKAGAAVTTETEVIWARALPAGTSAQRAELIALTQALKMAEGKKLN VYTDSRYAFATAHIHGEIYRRRGWLTSEGKEIKNKDEILALLKALFLPKR LSIIHCPGHQKGNSAEARGNRMADQAAREVATRETPETSTLL |
| MLVCB_P08361_3mutA | MLVCB | | | 3200 | TLNIEDEYRLHETSKEPDVSLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFN EALHRDLAGFRIQHPDLILLQYVDDLLLAATSELDCQQGTRALLQTLGDL GYRASAKKAQICQKQVKYLGYLLKEGQRWLTEARKETVMGQPIPKTPRQL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | REFLGKAGFCRLFIPGFAEMAAPLYPLTKPGTLFNWGPDQQKAFQEIKQA LLTAPALGLPDLTKPFELFVDEKQGYAKGVLTQKLGPATLLPLPEEGLQH DCLDILAEAHGTRSDLMDQPLPDADHTWYTDGSSFLQEGQRKAGAAVTTE TEVIWARALPAGTSAQRAELIALTQALKMAEGKKLNVYTDSRYAFATAHI HGEIYRRRGWLTSEGKEIKNKDEILALLKALFLPKRLSIIHCPGHQKGNS AEARGNRMADQAAREVATRETPETSTLL |
| MLVF5_P26810 | MLVF5 | P26810 | root | 3201 | TLNIEDEYRLHETSKGPDVPLGSTWLSDFPQAWAETGGMGLAFRQAPLII SLKATSTPVSIKQYPMSQEARLGIKPHIQRLLDQGILVPCQSPWNTPLLP VKKKPGTNDYRPVQDLREVNKRVEDIHPTVPNPYNLLSGLPPSHQWYTVLD LKDAFFCLRLHPTSQSLFAFEWKDPEMGISGQLTWTRLPQGFKNSPTLFD EALHRDLADFRIQHPDLILLQYVDDLLLAATSELDCQQGTRALLQTLGDL GYRASAKKAQICQKQVKYLGYLLKEGQRWLTEARKETVMGQPTPKTPRQL REFLGTAGLCRLWIPGFAEMAAPLYPLTKTGTLFKWGPDQQKAYQEIKQA LLTAPALGLPDLTKPFELFVDEKQGYAKGVLTQKLGPWRRPVAYLSKKLD PVAAGWPPCLRMVAAIAVLTKDVGKLTMGQPLVILAPHAVEALVKQPPDR WLSNARMTHYQALLLDTDRVQFGPIVALNPATLLPLPEEGLQHDCLDILA EAHGTRPDLTDQPLPDADHTWYTDGSSFLQEGQRRAGAAVTTETEVIWAK ALPAGTSAQRAELIALTQALKMAAGKKLNVYTDSRYAFATAHIHGEIYRR RGLLTSEGKEIKNKDEILALLKALFLPKRLSIIHCPGHQKGNHAEARGNR MADQAAREVATRETPETSTLL |
| MLVF5_P26810_3mut | MLVF5 | P26810 | derivative | 3202 | TLNIEDEYRLHETSKGPDVPLGSTWLSDFPQAWAETGGMGLAFRQAPLII SLKATSTPVSIKQYPMSQEARLGIKPHIQRLLDQGILVPCQSPWNTPLLP VKKKPGTNDYRPVQDLREVNKRVEDIHPTVPNPYNLLSGLPPSHQWYTVLD LKDAFFCLRLHPTSQSLFAFEWKDPEMGISGQLTWTRLPQGFKNSPTLFN EALHRDLADFRIQHPDLILLQYVDDLLLAATSELDCQQGTRALLQTLGDL GYRASAKKAQICQKQVKYLGYLLKEGQRWLTEARKETVMGQPTPKTPRQL REFLGTAGLCRLWIPGFAEMAAPLYPLTKPGTLFKWGPDQQKAYQEIKQA LLTAPALGLPDLTKPFELFVDEKQGYAKGVLTQKLGPWRRPVAYLSKKLD PVAAGWPPCLRMVAAIAVLTKDVGKLTMGQPLVILAPHAVEALVKQPPDR WLSNARMTHYQALLLDTDRVQFGPIVALNPATLLPLPEEGLQHDCLDILA EAHGTRPDLTDQPLPDADHTWYTDGSSFLQEGQRRAGAAVTTETEVIWAK ALPAGTSAQRAELIALTQALKMAAGKKLNVYTDSRYAFATAHIHGEIYRR RGWLTSEGKEIKNKDEILALLKALFLPKRLSIIHCPGHQKGNHAEARGNR MADQAAREVATRETPETSTLL |
| MLVF5_P26810_3mutA | MLVF5 | P26810 | derivative | 3203 | TLNIEDEYRLHETSKGPDVPLGSTWLSDFPQAWAETGGMGLAFRQAPLII SLKATSTPVSIKQYPMSQEARLGIKPHIQRLLDQGILVPCQSPWNTPLLP VKKKPGTNDYRPVQDLREVNKRVEDIHPTVPNPYNLLSGLPPSHQWYTVLD LKDAFFCLRLHPTSQSLFAFEWKDPEMGISGQLTWTRLPQGFKNSPTLFN EALHRDLADFRIQHPDLILLQYVDDLLLAATSELDCQQGTRALLQTLGDL GYRASAKKAQICQKQVKYLGYLLKEGQRWLTEARKETVMGQPTPKTPRQL REFLGKAGLCRLFIPGFAEMAAPLYPLTKPGTLFKWGPDQQKAYQEIKQA LLTAPALGLPDLTKPFELFVDEKQGYAKGVLTQKLGPWRRPVAYLSKKLD PVAAGWPPCLRMVAAIAVLTKDVGKLTMGQPLVILAPHAVEALVKQPPDR WLSNARMTHYQALLLDTDRVQFGPIVALNP ATLLPLPEEGLQHDCLDILAEAHGTRPDLTDQPLPDADHTWYTDGSSFLQ EGQRRAGAAVTTETEVIWAKALPAGTSAQRAELIALTQALKMAAGKKLNV YTDSRYAFATAHIHGEIYRRGWLTSEGKEIKNKDEILALLKALFLPKRL SIIHCPGHQKGNHAEARGNRMADQAAREVATRETPETSTLL |
| MLVFF_P26809 | MLVFF | P26809 | root | 3204 | TLNIEDEYRLHETSKGPDVPLGSTWLSDFPQAWAETGGMGLAVRQAPLII PLKATSTPVSIKQYPMSQEARLGIKPHIQRLLDQGILVPCQSPWNTPLLP VKKKPGTNDYRPVQDLREVNKRVEDIHPTVPNPYNLLSGLPPSHQWYTVLD LKDAFFCLRLHPTSQSLFAFEWRDPEMGISGQLTWTRLPQGFKNSPTLFD EALHRDLADFRIQHPDLILLQYVDDLLLAATSELDCQQGTRALLQTLGDL GYRASAKKAQICQKQVKYLGYLLKEGQRWLTEARKETVMGQPTPKTPRQL REFLGTAGFCRLWIPGFAEMAAPLYPLTKTGTLFEWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPIVALNPATLLPLPEEGLQHDCLDILA EAHGTRPDLTDQPLPDADHTWYTDGSSFLQEGQRKAGAAVTTETEVVWAK ALPAGTSAQRAELIALTQALKMAEGKKLNVYTDSRYAFATAHIHGEIYRR RGLLTSEGKEIKNKDEILALLKALFLPKRLSIIHCPGHQKGNRAEARGNR MADQAAREVATRETPETSTLL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| MLVFF_P26809_3mut | MLVFF | P26809 | derivative | 3205 | TLNIEDEYRLHETSKGPDVPLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQSLFAFEWRDPEMGISGQLTWTRLPQGFKNSPTLFN EALHRDLADFRIQHPDLILLQYVDDLLLAATSELDCQQGTRALLQTLGDL GYRASAKKAQICQKQVKYLGYLLKEGQRWLTEARKETVMGQPTPKTPRQL REFLGTAGFCRLWIPGFAEMAAPLYPLTKPGTLFEWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPIVALNPATLLPLPEEGLQHDCLDILA EAHGTRPDLTDQPLPDADHTWYTDGSSFLQEGQRKAGAAVTTETEVVWAK ALPAGTSAQRAELIALTQALKMAEGKKLNVYTDSRYAFATAHIHGEIYRR RGWLTSEGKEIKNKDEILALLKALFLPKRLSIIHCPGHQKGNRAEARGNR MADQAAREVATRETPETSTLL |
| MLVFF_P26809_3mutA | MLVEF | P26809 | derivative | 3206 | TLNIEDEYRLHETSKGPDVPLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQSLFAFEWRDPEMGISGQLTWTRLPQGFKNSPTLFN EALHRDLADFRIQHPDLILLQYVDDLLLAATSELDCQQGTRALLQTLGDL GYRASAKKAQICQKQVKYLGYLLKEGQRWLTEARKETVMGQPTPKTPRQL REFLGKAGFCRLFIPGFAEMAAPLYPLTKPGTLFEWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPIVALN PATLLPLPEEGLQHDCLDILAEAHGTRPDLTDQPLPDADHTWYTDGSSFL QEGQRKAGAAVTTETEVVWAKALPAGTSAQRAELIALTQALKMAEGKKLN VYTDSRYAFATAHIHGEIYRRRGWLTSEGKEIKNKDEILALLKALFLPKR LSIIHCPGHQKGNRAEARGNRMADQAAREVATRETPETSTLL |
| MLVMS_P03355_PLV919 | MLVMS | P03355 | root | 3207 | TLNIEDEYRLHETSKEPDVSLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFN EALHRDLADFRIQHPDLILLQYVDDLLLAATSELDCQQGTRALLQTLGNL GYRASAKKAQICQKQVKYLGYLLKEGQRWLTEARKETVMGQPTPKTPRQL REFLGKAGFCRLFIPGFAEMAAPLYPLTKPGTLFNWGPDQQKAYQEIKQA LLTAPALGLPDLTKPFELFVDEKQGYAKGVLTQKL GPWRRPVAYLSKKLDPVAAGWPPCLRMVAAIAVLTKDAGKLTMGQPLVIL APHAVEALVKQPPDRWLSNARMTHYQALLLDTDRVQFGPVVALNPATLLP LPEEGLQHNCLDILAEAHGTRPDLTDQPLPDADHTWYTDGSSLLQEGQRK AGAAVTTETEVIWAKALPAGTSAQRAELIALTQALKMAEGKKLNVYTDSR YAFATAHIHGEIYRRRGWLTSEGKEIKNKDEILALLKALFLPKRLSIIHC PGHQKGHSAEARGNRMADQAARKAAITETPDTSTLLIENSSPSGGSKRTA DGSEFE |
| MLVMS_P03355 | MLVMS | P03355 | derivative | 1548 | TLNIEDEHRLHETSKEPDVSLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFD EALHRDLADFRIQHPDLILLQYVDDLLLAATSELDCQQGTRALLQTLGNL GYRASAKKAQICQKQVKYLGYLLKEGQRWLTEARKETVMGQPTPKTPRQL REFLGTAGFCRLWIPGFAEMAAPLYPLTKTGTLFNWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPVVALNPATLLPLPEEGLQHNCLDILA EAHGTRPDLTDQPLPDADHTWYTDGSSLLQEGQRKAGAAVTTETEVIWAK ALPAGTSAQRAELIALTQALKMAEGKKLNVYTDSRYAFATAHIHGEIYRR RGLLTSEGKEIKNKDEILALLKALFLPKRLSIIHCPGHQKGHSAEARGNR MADQAARKAAITETPDTSTLL |
| MLVMS_P03355_3mut | MLVMS | P03355 | derivative | 3208 | TLNIEDEHRLHETSKEPDVSLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFN EALHRDLADFRIQHPDLILLQYVDDLLLAATSELDCQQGTRALLQTLGNL GYRASAKKAQICQKQVKYLGYLLKEGQRWLTEARKETVMGQPTPKTPRQL REFLGTAGFCRLWIPGFAEMAAPLYPLTKPGTLFNWGPDQQKAYQEIKQA |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_ name | uniprot_ ID | type | SEQ ID NO: | peptide |
|---|---|---|---|---|---|
| | | | | | LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPVVALNPATLLPLPEEGLQHNCLDILA EAHGTRPDLTDQPLPDADHTWYTDGSSLLQEGQRKAGAAVTTETEVIWAK ALPAGTSAQRAELIALTQALKMAEGKKLNVYTDSRYAFATAHIHGEIYRR RGWLTSEGKEIKNKDEILALLKALFLPKRLSIIHCPGHQKGHSAEARGNR MADQAARKAAITETPDTSTLL |
| MLVMS_ P03355_ 3mutA_ WS | MLVMS | P03355 | derivative | 3209 | TLNIEDEHRLHETSKEPDVSLGSTWLSDFPQAWAETGGMGLAVRQAPLII PLKATSTPVSIKQYPMSQEARLGIKPHIQRLLDQGILVPCQSPWNTPLLP VKKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFN EALHRDLADFRIQHPDLILLQYVDDLLLAATSELDCQQGTRALLQTLGNL GYRASAKKAQICQKQVKYLGYLLKEGQRWLTEARKETVMGQPTPKTPRQL REFLGKAGFCRLFIPGFAEMAAPLYPLTKPGTLFNWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQALLLDTDRVQFGPVVALNPATLLPLPEEGLQHNCLDILA EAHGTRPDLTDQPLPDADHTWYTDGSSLLQEGQRKAGAAVTTETEVIWAK ALPAGTSAQRAELIALTQALKMAEGKKLNVYTDSRYAFATAHIHGEIYRR RGWLTSEGKEIKNKDEILALLKALFLPKRLSIIHCPGHQKGHSAEARGNR MADQAARKAAITETPDTSTLL |
| MLVRD_ P11227 | MLVRD | P11227 | root | 3210 | TLNIEDEYRLHEISTEPDVSPGSTWLSDFPQAWAETGGMGLAVRQAPLII PLKATSTPVSIKQYPMSQEAKLGIKPHIQRLLDQGILVPCQSPWNTPLL PVKKKPGTNDYRPVQGLREVNKRVEDIHPTVPNPYNLLSGLPTSHRWYTVL DLKDAFFCLRLHPTSQPLFASEWRDPGMGISGQLTWTRLPQGFKNSPTLF DEALHRGLADFRIQHPDLILLQYVDDLLLAATSELDCQQGTRALLKTLGN LGYRASAKKAQICQKQVKYLGYLLREGQRWLTEARKETVMGQPTPKTPRQ LREFLGTAGFCRLWIPRFAEMAAPLYPLTKTGTLFNWGPDQQKAYHEIKQ ALLTAPALGLPDLTKPFELFVDEKQGYAKGVLTQKLGPWRRPVAYLSKKL DPVAAGWPPCLRMVAAIAVLTKDAGKLTMGQPLVILAPHAVEALVKQPPD RWLSNARMTHYQAMLLDTDRVQFGPVVALNPATLLPLPEEGAPHDCLEIL AETHGTEPDLTDQPIPDADHTWYTDGSSFLQEGQRKAGAAVTTETEVIWA RALPAGTSAQRAELIALTQALKMAEGKRLNVYTDSRYAFATAHIHGEIYK RRGLLTSEGREIKNKSEILALLKALFLPKRLSIIHCLGHQKGDSAEARGN RLADQAAREAAIKTPPDTSTLL |
| MLVRD_ P11227_ 3mut | MLVRD | P11227 | derivative | 3211 | TLNIEDEYRLHEISTEPDVSPGSTWLSDFPQAWAETGGMGLAVRQAPLII PLKATSTPVSIKQYPMSQEAKLGIKPHIQRLLDQGILVPCQSPWNTPLLP VKKKPGTNDYRPVQGLREVNKRVEDIHPTVPNPYNLLSGLPTSHRWYTVLD LKDAFFCLRLHPTSQPLFASEWRDPGMGISGQLTWTRLPQGFKNSPTLFN EALHRGLADFRIQHPDLILLQYVDDLLLAATSELDCQQGTRALLKTLGNL GYRASAKKAQICQKQVKYLGYLLREGQRWLTEARKETVMGQPTPKTPRQL REFLGTAGFCRLWIPRFAEMAAPLYPLTKPGTLFNWGPDQQKAYHEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVALNPATLLPLPEEGAPHDCLEILA ETHGTEPDLTDQPIPDADHTWYTDGSSFLQEGQRKAGAAVTTETEVIWAR ALPAGTSAQRAELIALTQALKMAEGKRLNVYTDSRYAFATAHIHGEIYKR RGWLTSEGREIKNKSEILALLKALFLPKRLSIIHCLGHQKGDSAEARGNR LADQAAREAAIKTPPDTSTLL |
| MLVRD_ P11227_ 3mutA | MLVRD | P11227 | derivative | 3212 | TLNIEDEYRLHEISTEPDVSPGSTWLSDFPQAWAETGGMGLAVRQAPLII PLKATSTPVSIKQYPMSQEAKLGIKPHIQRLLDQGILVPCQSPWNTPLLP VKKKPGTNDYRPVQGLREVNKRVEDIHPTVPNPYNLLSGLPTSHRWYTVLD LKDAFFCLRLHPTSQPLFASEWRDPGMGISGQLTWTRLPQGFKNSPTLFN EALHRGLADFRIQHPDLILLQYVDDLLLAATSELDCQQGTRALLKTLGNL GYRASAKKAQICQKQVKYLGYLLREGQRWLTEARKETVMGQPTPKTPRQL REFLGKAGFCRLFIPRFAEMAAPLYPLTKPGTLFNWGPDQQKAYHEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVALNPATLLPLPEEGAPHDCLEILA ETHGTEPDLTDQPIPDADHTWYTDGSSFLQEGQRKAGAAVTTETEVIWAR ALPAGTSAQRAELIALTQALKMAEGKRLNVYTDSRYAFATAHIHGEIYKR RGWLTSEGREIKNKSEILALLKALFLPKRLSIIHCLGHQKGDSAEARGNR LADQAAREAAIKTPPDTSTLL |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| MMTVB_P03365_WS | MMTVB | P03365 | root | 3213 | VQEISDSRPMLHIYLNGRRFLGLLDTGADKTCIAGRDWPANWPIHQTESS LQGLGMACGVARSSQPLRWQHEDKSGIIHPFVIPTLPFTLWGRDIMKDIK VRLMTDSPDDSQDLMIGAIESNLFADQISWKSDQPVWLNQWPLKQEKLQA LQQLVTEQLQLGHLEESNSPWNTPVFVIKKKSGKWRLLQDLRAVNATMHD MGALQPGLPSPVAVPKGWEIIIIDLQDCFFNIKLHPEDCKRFAFSVPSPN FKRPYQRFQWKVLPQGMKNSPTLCQKFVDKAILTVRDKYQDSYIVHYMDD ILLAHPSRSIVDEILTSMIQALNKHGLVVSTEKIQKYDNLKYLGTHIQGD SVSYQKLQIRTDKLRTLNDFQKLLGNINWIRPFLKLTTGELKPLFEILNG DSNPISTRKLTPEACKALQLMNERLSTARVKRLDLSQPWSLCILKTEYTP TACLWQDGVVEWIHLPHISPKVITPYDIFCTQLIIKGRHRSKELFSKDPD YIVVPYTKVQFDLLLQEKEDWPISLLGFLGEVHFHLPKDPLLTFTLQTAI IFPHMTSTTPLEKGIVIFTDGSANGRSVTYIQGREPIIKENTQNTAQQAE IVAVITAFEEVSQPFNLYTDSKYVTGLFPEIETATLSPRTKIYTELKHLQ RLIHKRQEKFYIGHIRGHTGLPGPLAQGNAYADSLTRILTA |
| MMTVB_P03365 | MMTVB | P03365 | derivative | 3214 | WVQEISDSRPMLHIYLNGRRFLGLLNTGADKTCIAGRDWPANWPIHQTES SLQGLGMACGVARSSQPLRWQHEDKSGIIHPFVIPTLPFTLWGRDIMKDI KVRLMTDSPDDSQDLMIGAIESNLFADQISWKSDQPVWLNQWPLKQEKLQ ALQQLVTEQLQLGHLEESNSPWNTPVFVIKKKSGKWRLLQDLRAVNATMH DMGALQPGLPSPVAVPKGWEIIIIDLQDCFFNIKLHPEDCKRFAFSVPSP NFKRPYQRFQWKVLPQGMKNSPTLCQKFVDKAILTVRDKYQDSYIVHYMD DILLAHPSRSIVDEILTSMIQALNKHGLVVSTEKIQKYDNLKYLGTHIQG DSVSYQKLQIRTDKLRTLNDFQKLLGNINWIRPFLKLTTGELKPLFEILN GDSNPISTRKLTPEACKALQLMNERLSTARVKRLDLSQPWSLCILKTEYT PTACLWQDGVVEWIHLPHISPKVITPYDIFCTQLIIKGRHRSKELFSKDP DYIVVPYTKVQFDLLLQEKEDWPISLLGFLGEVHFHLPKDPLLTFTLQTA IIFPHMTSTTPLEKGIVIFTDGSANGRSVTYIQGREPIIKENTQNTAQQA EIVAVITAFEEVSQPFNLYTDSKYVTGLFPEIETATLSPRTKIYTELKHL QRLIHKRQEKFYIGHIRGHTGLPGPLAQGNAYADSLTRILT |
| MMTVB_P03365-Pro | MMTVB | P03365 | derivative | 3215 | GRDIMKDIKVRLMTDSPDDSQDLMIGAIESNLFADQISWKSDQPVWLNQW PLKQEKLQALQQLVTEQLQLGHLEESNSPWNTPVFVIKKKSGKWRLLQDL RAVNATMHDMGALQPGLPSPVAVPKGWEIIIIDLQDCFFNIKLHPEDCKR FAFSVPSPNFKRPYQRFQWKVLPQGMKNSPTLCQKFVDKAILTVRDKYQD SYIVHYMDDILLAHPSRSIVDEILTSMIQALNKHGLVVSTEKIQKYDNLK YLGTHIQGDSVSYQKLQIRTDKLRTLNDFQKLLGNINWIR PFLKLTTGELKPLFEILNGDSNPISTRKLTPEACKALQLMNERLSTARVK RLDLSQPWSLCILKTEYTPTACLWQDGVVEWIHLPHISPKVITPYDIFCT QLIIKGRHRSKELFSKDPDYIVVPYTKVQFDLLLQEKEDWPISLLGFLGE VHFHLPKDPLLTFTLQTAIIFPHMTSTTPLEKGIVIFTDGSANGRSVTYI QGREPIIKENTQNTAQQAEIVAVITAFEEVSQPFNLYTDSKYVTGLFPEI ETATLSPRTKIYTELKHLQRLIHKRQEKFYIGHIRGHTGLPGPLAQGNAY ADSLTRILT |
| MMTVB_P03365-Pro_2mut | MMTVB | P03365 | derivative | 3216 | GRDIMKDIKVRLMTDSPDDSQDLMIGAIESNLFADQISWKSDQPVWLNQW PLKQEKLQALQQLVTEQLQLGHLEESNSPWNTPVFVIKKKSGKWRLLQDL RAVNATMHDMGALQPGLPSPVAVPKGWEIIIIDLQDCFFNIKLHPEDCKR FAFSVPSPNFKRPYQRFQWKVLPQGMKNSPTLCQKFVDKAILTVRDKYQD SYIVHYMDDILLAHPSRSIVDEILTSMIQALNKHGLVVSTEKIQKYDNLK YLGTHIQGDSVSYQKLQIRTDKLRTLNDFQKLLGNINWIRPFLKLTTGEL KPLFEILNPDSNPISTRKLTPEACKALQLMNERLSTARVKRLDLSQPWSL CILKTEYTPTACLWQDGVVEWIHLPHISPKVITPYDIFCTQLIIKGRHRS KELFSKDPDYIVVPYTKVQFDLLLQEKEDWPISLLGFLGEVHFHLPKDPL LTFTLQTAIIFPHMTSTTPLEKGIVIFTDGSANGRSVTYIQGREPIIKEN TQNTAQQAEIVAVITAFEEVSQPFNLYTDSKYVTGLFPEIETATLSPRTK IYTELKHLQRLIHKRQEKFYIGHIRGHTGLPGPLAQGNAYADSLTRILT |
| MMTVB_P03365-Pro_2mutB | MMTVB | P03365 | derivative | 3217 | GRDIMKDIKVRLMTDSPDDSQDLMIGAIESNLFADQISWKSDQPVWLNQW PLKQEKLQALQQLVTEQLQLGHLEESNSPWNTPVFVIKKKSGKWRLLQDL RAVNATMHDMGALQPGLPSPVAPPKGWEIIIIDLQDCFFNIKLHPEDCKR FAFSVPSPNFKRPYQRFQWKVLPQGMKNSPTLCQKFVDKAILTVRDKYQD SYIVHYMDDILLAHPSRSIVDEILTSMIQALNKHGLVVSTEKIQKYDNLK YLGTHIQGDSVSYQKLQIRTDKLRTLNDFQKLLGNINWIRPFLKLTTGEL KPLFEILNPDSNPISTRKLTPEACKALQLMNERLSTARVKRLDLSQPWSL CILKTEYTPTACLWQDGVVEWIHLPHISPKVITPYDIFCTQLIIKGRHRS KELFSKDPDYIVVPYTKVQFDLLLQEKEDWPISLLGFLGEVHFHLPKDPL LTFTLQTAIIFPHMTSTTPLEKGIVIFTDGSANGRSVTYIQGREPIIKEN |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | TQNTAQQAEIVAVITAFEEVSQPFNLYTDSKYVTGLFPEIETATLSPRTK IYTELKHLQRLIHKRQEKFYIGHIRGHTGLPGPLAQGNAYADSLTRILT |
| MMTVB_P03365_2mut | MMTVB | P03365 | derivative | 3218 | WVQEISDSRPMLHIYLNGRRFLGLLNTGADKTCIAGRDWPANWPIHQTES SLQGLGMACGVARSSQPLRWQHEDKSGIIHPFVIPTLPFTLWGRDIMRAV NATMHDMGALQPGLPSPVAVPKGWEIIIDLQDCFFNIKLHPEDCKRFAF SVPSPNFKRPYQRFQWKVLPQGMKNSPTLCQKFVDKAILTVRDKYQDSYI VHYMDDILLAHPSRSIVDEILTSMIQALNKHGLVVSTEKIQKYDNLKYLG THIQGDSVSYQKLQIRTDKLRTLNDFQKLLGNINWIRPFLKLTTGELKPL FEILNPDSNPISTRKLTPEACKALQLMNERLSTARVKRLDLSQPWSLCIL KTEYTPTACLWQDGVVEWIHLPHISPKVITPYDIFCTQLIIKGRHRSKEL FSKDPDYIVVPYTKVQFDLLLQEKEDWPISLLGFLGEVHFHLPKDPLLTF TLQTAIIFPHMTSTTPLEKGIVIFTDGSANGRSVTYIQGREPIIKENTQN TAQQAEIVAVITAFEEVSQPFNLYTDSKYVTGLFPEIETATLSPRTKIYT ELKHLQRLIHKRQEKFYIGHIRGHTGLPGPLAQGNAYADSLTRILT |
| MMTVB_P03365_2mutB | MMTVB | P03365 | derivative | 3219 | WVQEISDSRPMLHIYLNGRRFLGLLNTGADKTCIAGRDWPANWPIHQTES SLQGLGMACGVARSSQPLRWQHEDKSGIIHPFVIPTLPFTLWGRDIMKDI KVRLMTDSPDDSQDLMIGAIESNLFADQISWKSDQPVWLNQWPLKQEKLQ ALQQLVTEQLQLGHLEESNSPWNTPVFVIKKKSGKWRLLQDLRAVNATMH DMGALQPGLPSPVAPPKGWEIIIDLQDCFFNIKLHPEDCKRFAFSVPSP NFKRPYQRFQWKVLPQGMKNSPTLCQKFVDKAILTVRDKYQDSYIVHYMD DILLAHPSRSIVDEILTSMIQALNKHGLVVSTEKIQKYDNLKYLGTHIQG DSVSYQKLQIRTDKLRTLNDFQKLLGNINWIRPFLKLTTGELKPLFEILN PDSNPISTRKLTPEACKALQLMNERLSTARVKRLDLSQPWSLCILKTEYT PTACLWQDGVVEWIHLPHISPKVITPYDIFCTQLIIKGRHRSKELFSKDP DYIVVPYTKVQFDLLLQEKEDWPISLLGFLGEVHFHLPKDPLLTFTLQTA IIFPHMTSTTPLEKGIVIFTDGSANGRSVTYIQGREPIIKENTQNTAQQA EIVAVITAFEEVSQPFNLYTDSKYVTGLFPEIETATLSPRTKIYTELKHL QRLIHKRQEKFYIGHIRGHTGLPGPLAQGNAYADSLTRILT |
| MMTVB_P03365_2mutB_WS | MMTVB | P03365 | derivative | 3220 | VQEISDSRPMLHIYLNGRRFLGLLDTGADKTCIAGRDWPANWPIHQTESS LQGLGMACGVARSSQPLRWQHEDKSGIIHPFVIPTLPFTLWGRDIMKDIK VRLMTDSPDDSQDLMIGAIESNLFADQISWKSDQPVWLNQWPLKQEKLQA LQQLVTEQLQLGHLEESNSPWNTPVFVIKKKSGKWRLLQDLRAVNATMHD MGALQPGLPSPPAVPKGWEIIIDLQDCFFNIKLHPEDCKRFAFSVPSPN FKRPYQRFQWKVLPQGMKNSPTLCQKFVDKAILTVRDKYQDSYIVHYMDD ILLAHPSRSIVDEILTSMIQALNKHGLVVSTEKIQKYDNLKYLGTHIQGD SVSYQKLQIRTDKLRTLNDFQKLLGNINWIRPFLKLTTGELKPLFEILNP DSNPISTRKLTPEACKALQLMNERLSTARVKRLDLSQPWSLCILKTEYTP TACLWQDGVVEWIHLPHISPKVITPYDIFCTQLIIKGRHRSKELFSKDPD YIVVPYTKVQFDLLLQEKEDWPISLLGFLGEVHFHLPKDPLLTFTLQTAI IFPHMTSTTPLEKGIVIFTDGSANGRSVTYIQGREPIIKENTQNTAQQAE IVAVITAFEEVSQPFNLYTDSKYVTGLFPEIETATLSPRTKIYTELKHLQ RLIHKRQEKFYIGHIRGHTGLPGPLAQGNAYADSLTRILTA |
| MMTVB_P03365_2mut_WS | MMTVB | P03365 | derivative | 3221 | VQEISDSRPMLHIYLNGRRFLGLLDTGADKTCIAGRDWPANWPIHQTESS LQGLGMACGVARSSQPLRWQHEDKSGIIHPFVIPTLPFTLWGRDIMKDIK VRLMTDSPDDSQDLMIGAIESNLFADQISWKSDQPVWLNQWPLKQEKLQA LQQLVTEQLQLGHLEESNSPWNTPVFVIKKKSGKWRLLQDLRAVNATMHD MGALQPGLPSPVAVPKGWEIIIDLQDCFFNIKLHPEDCKRFAFSVPSPN FKRPYQRFQWKVLPQGMKNSPTLCQKFVDKAILTVRDKYQDSYIVHYMDD ILLAHPSRSIVDEILTSMIQALNKHGLVVSTEKIQKYDNLKYLGTHIQGD SVSYQKLQIRTDKLRTLNDFQKLLGNINWIRPFLKLTTGELKPLFEILNP DSNPISTRKLTPEACKALQLMNERLSTARVKRLDLSQPWSLCILKTEYTP TACLWQDGVVEWIHLPHISPKVITPYDIFCTQLIIKGRHRSKELFSKDPD YIVVPYTKVQFDLLLQEKEDWPISLLGFLGEVHFHLPKDPLLTFTLQTAI IFPHMTSTTPLEKGIVIFTDGSANGRSVTYIQGREP IIKENTQNTAQQAEIVAVITAFEEVSQPFNLYTDSKYVTGLFPEIETATL SPRTKIYTELKHLQRLIHKRQEKFYIGHIRGHTGLPGPLAQGNAYADSLT RILTA |
| MMTVB_P03365_WS | MMTVB | P03365 | root | 3213 | VQEISDSRPMLHIYLNGRRFLGLLDTGADKTCIAGRDWPANWPIHQTESS LQGLGMACGVARSSQPLRWQHEDKSGIIHPFVIPTLPFTLWGRDIMKDIK VRLMTDSPDDSQDLMIGAIESNLFADQISWKSDQPVWLNQWPLKQEKLQA LQQLVTEQLQLGHLEESNSPWNTPVFVIKKKSGKWRLLQDLRAVNATMHD MGALQPGLPSPVAVPKGWEIIIDLQDCFFNIKLHPEDCKRFAFSVPSPN FKRPYQRFQWKVLPQGMKNSPTLCQKFVDKAILTVRDKYQDSYIVHYMDD ILLAHPSRSIVDEILTSMIQALNKHGLVVSTEKIQKYDNLKYLGTHIQGD |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | SVSYQKLQIRTDKLRTLNDFQKLLGNINWIRPFLKTTGELKPLFEILNG<br>DSNPISTRKLTPEACKALQLMNERLSTARVKRLDLSQPWSLCILKTEYTP<br>TACLWQDGVVEWIHLPHISPKVITPYDIFCTQLIIKGRHRSKELFSKDPD<br>YIVVPYTKVQFDLLLQEKEDWPISLLGFLGEVHFHLPKDPLLTFTLQTAI<br>IFPHMTSTTPLEKGIVIFTDGSANGRSVTYIQGREPIIKENTQNTAQQAE<br>IVAVITAFEEVSQPFNLYTDSKYVTGLFPEIETATLSPRTKIYTELKHLQ<br>RLIHKRQEKFYIGHIRGHTGLPGPLAQGNAYADSLTRILTA |
| MMTVB_<br>P03365 | MMTVB | P03365 | derivative | 3214 | WVQEISDSRPMLHIYLNGRRFLGLLNTGADKTCIAGRDWPANWPIHQTES<br>SLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQ<br>ALQQLVTEQLQLGHLEESNSPWNTPVFVIKKKSGKWRLLQDLRAVNATMH<br>DMGALQPGLPSPVAVPKGWEIIIIDLQDCFFNIKLHPEDCKRFAFSVPSP<br>NFKRPYQRFQWKVLPQGMKNSPTLCQKFVDKAILTVRDKYQDSYIVHYMD<br>DILLAHPSRSIVDEILTSMIQALNKHGLVVSTEKIQKYDNLKYLGTHIQG<br>DSVSYQKLQIRTDKLRTLNDFQKLLGNINWIRPFLKTTGELKPLFEILN<br>GDSNPISTRKLTPEACKALQLMNERLSTARVKRLDLSQPWSLCILKTEYT<br>PTACLWQDGVVEWIHLPHISPKVITPYDIFCTQLIIKGRHRSKELFSKDP<br>DYIVVPYTKVQFDLLLQEKEDWPISLLGFLGEVHFHLPKDPLLTFTLQTA<br>IIFPHMTSTTPLEKGIVIFTDGSANGRSVTYIQGREPIIKENTQNTAQQA<br>EIVAVITAFEEVSQPFNLYTDSKYVTGLFPEIETATLSPRTKIYTELKHL<br>QRLIHKRQEKFYIGHIRGHTGLPGPLAQGNAYADSLTRILT |
| MMTVB_<br>P03365-<br>Pro | MMTVB | P03365 | derivative | 3215 | GRDIMKDIKVRLMTDSPDDSQDLMIGAIESNLFADQISWKSDQPVWLNQW<br>PLKQEKLQALQQLVTEQLQLGHLEESNSPWNTPVFVIKKKSGKWRLLQDL<br>RAVNATMHDMGALQPGLPSPVAVPKGWEIIIIDLQDCFFNIKLHPEDCKR<br>FAFSVPSPNFKRPYQRFQWKVLPQGMKNSPTLCQKFVDKAILTVRDKYQD<br>SYIVHYMDDILLAHPSRSIVDEILTSMIQALNKHGLVVSTEKIQKYDNLK<br>YLGTHIQGDSVSYQKLQIRTDKLRTLNDFQKLLGNINWIRPFLKTTGEL<br>KPLFEILNGDSNPISTRKLTPEACKALQLMNERLSTARVKRLDLSQPWSL<br>CILKTEYTPTACLWQDGVVEWIHLPHISPKVITPYDIFCTQLIIKGRHRS<br>KELFSKDPDYIVVPYTKVQFDLLLQEKEDWPISLLGFLGEVHFHLPKDPL<br>LTFTLQTAIIFPHMTSTTPLEKGIVIFTDGSANGRSVTYIQGREPIIKEN<br>TQNTAQQAEIVAVITAFEEVSQPFNLYTDSKYVTGLFPEIETATLSPRTK<br>IYTELKHLQRLIHKRQEKFYIGHIRGHTGLPGPLAQGNAYADSLTRILT |
| MMTVB_<br>P03365-<br>Pro_<br>2mut | MMTVB | P03365 | derivative | 3216 | GRDIMKDIKVRLMTDSPDDSQDLMIGAIESNLFADQISWKSDQPVWLNQW<br>PLKQEKLQALQQLVTEQLQLGHLEESNSPWNTPVFVIKKKSGKWRLLQDL<br>RAVNATMHDMGALQPGLPSPVAVPKGWEIIIIDLQDCFFNIKLHPEDCKR<br>FAFSVPSPNFKRPYQRFQWKVLPQGMKNSPTLCQKFVDKAILTVRDKYQD<br>SYIVHYMDDILLAHPSRSIVDEILTSMIQALNKHGLVVSTEKIQKYDNLK<br>YLGTHIQGDSVSYQKLQIRTDKLRTLNDFQKLLGNINWIRPFLKTTGEL<br>KPLFEILNPDSNPISTRKLTPEACKALQLMNERLSTARVKRLDLSQPWSL<br>CILKTEYTPTACLWQDGVVEWIHLPHISPKVITPYDIFCT<br>QLIIKGRHRSKELFSKDPDYIVVPYTKVQFDLLLQEKEDWPISLLGFLGE<br>VHFHLPKDPLLTFTLQTAIIFPHMTSTTPLEKGIVIFTDGSANGRSVTYI<br>QGREPIIKENTQNTAQQAEIVAVITAFEEVSQPFNLYTDSKYVTGLFPEI<br>ETATLSPRTKIYTELKHLQRLIHKRQEKFYIGHIRGHTGLPGPLAQGNAY<br>ADSLTRILT |
| MMTVB_<br>P03365-<br>Pro_<br>2mutB | MMTVB | P03365 | derivative | 3217 | GRDIMKDIKVRLMTDSPDDSQDLMIGAIESNLFADQISWKSDQPVWLNQW<br>PLKQEKLQALQQLVTEQLQLGHLEESNSPWNTPVFVIKKKSGKWRLLQDL<br>RAVNATMHDMGALQPGLPSPVAPPKGWEIIIIDLQDCFFNIKLHPEDCKR<br>FAFSVPSPNFKRPYQRFQWKVLPQGMKNSPTLCQKFVDKAILTVRDKYQD<br>SYIVHYMDDILLAHPSRSIVDEILTSMIQALNKHGLVVSTEKIQKYDNLK<br>YLGTHIQGDSVSYQKLQIRTDKLRTLNDFQKLLGNINWIRPFLKTTGEL<br>KPLFEILNPDSNPISTRKLTPEACKALQLMNERLSTARVKRLDLSQPWSL<br>CILKTEYTPTACLWQDGVVEWIHLPHISPKVITPYDIFCTQLIIKGRHRS<br>KELFSKDPDYIVVPYTKVQFDLLLQEKEDWPISLLGFLGEVHFHLPKDPL<br>LTFTLQTAIIFPHMTSTTPLEKGIVIFTDGSANGRSVTYIQGREPIIKEN<br>TQNTAQQAEIVAVITAFEEVSQPFNLYTDSKYVTGLFPEIETATLSPRTK<br>IYTELKHLQRLIHKRQEKFYIGHIRGHTGLPGPLAQGNAYADSLTRILT |
| MMTVB_<br>P03365_<br>2mut | MMTVB | P03365 | derivative | 3218 | WVQEISDSRPMLHIYLNGRRFLGLLNTGADKTCIAGRDWPANWPIHQTES<br>SLQGLGMACGVARSSQPLRWQHEDKSGIIHPFVIPTLPFTLWGRDIMKDI<br>KVRLMTDSPDDSQDLMIGAIESNLFADQISWKSDQPVWLNQWPLKQEKLQ<br>ALQQLVTEQLQLGHLEESNSPWNTPVFVIKKKSGKWRLLQDLRAVNATMH<br>DMGALQPGLPSPVAVPKGWEIIIIDLQDCFFNIKLHPEDCKRFAFSVPSP<br>NFKRPYQRFQWKVLPQGMKNSPTLCQKFVDKAILTVRDKYQDSYIVHYMD |

TABLE 9-continued

Retroviral reverse transcriptase domains for use in Gene Writer™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | DILLAHPSRSIVDEILTSMIQALNKHGLVVSTEKIQKYDNLKYLGTHIQG DSVSYQKLQIRTDKLRTLNDFQKLLGNINWIRPFLKTTGELKPLFEILN PDSNPISTRKLTPEACKALQLMNERLSTARVKRLDLSQPWSLCILKTEYT PTACLWQDGVVEWIHLPHISPKVITPYDIFCTQLIIKGRHRSKELFSKDP DYIVVPYTKVQFDLLLQEKEDWPISLLGFLGEVHFHLPKDPLLTFTLQTA IIFPHMTSTTPLEKGIVIFTDGSANGRSVTYIQGREPIIKENTQNTAQQA EIVAVITAFEEVSQPFNLYTDSKYVTGLFPEIETATLSPRTKIYTELKHL QRLIHKRQEKFYIGHIRGHTGLPGPLAQGNAYADSLTRILT |
| MMTVB_P03365_2mutB | MMTVB | P03365 | derivative | 3219 | WVQEISDSRPMLHIYLNGRRFLGLLNTGADKTCIAGRDWPANWPIHQTES SLQGLGMACGVARSSQPLRWQHEDKSGIIHPFVIPTLPFTLWGRDIMKDI KVRLMTDSPDDSQDLMIGAIESNLFADQISWKSDQPVWLNQWPLKQEKLQ ALQQLVTEQLQLGHLEESNSPWNTPVFVIKKKSGKWRLLQDLRAVNATMH DMGALQPGLPSPVAPPKGWEIIIDLQDCFFNIKLHPEDCKRFAFSVPSP NFKRPYQRFQWKVLPQGMKNSPTLCQKFVDKAILTVRDKYQDSYIVHYMD DILLAHPSRSIVDEILTSMIQALNKHGLVVSTEKIQKYDNLKYLGTHIQG DSVSYQKLQIRTDKLRTLNDFQKLLGNINWIRPFLKTTGELKPLFEILN PDSNPISTRKLTPEACKALQLMNERLSTARVKRLDLSQPWSLCILKTEYT PTACLWQDGVVEWIHLPHISPKVITPYDIFCTQLIIK GRHRSKELFSKDPDYIVVPYTKVQFDLLLQEKEDWPISLLGFLGEVHFHL PKDPLLTFTLQTAIIFPHMTSTTPLEKGIVIFTDGSANGRSVTYIQGREP IIKENTQNTAQQAEIVAVITAFEEVSQPFNLYTDSKYVTGLFPEIETATL SPRTKIYTELKHLQRLIHKRQEKFYIGHIRGHTGLPGPLAQGNAYADSLT RILT |
| MMTVB_P03365_2mutB_WS | MMTVB | P03365 | derivative | 3220 | VQEISDSRPMLHIYLNGRRFLGLLDTGADKTCIAGRDWPANWPIHQTESS LQGLGMACGVARSSQPLRWQHEDKSGIIHPFVIPTLPFTLWGRDIMKDIK VRLMTDSPDDSQDLMIGAIESNLFADQISWKSDQPVWLNQWPLKQEKLQA LQQLVTEQLQLGHLEESNSPWNTPVFVIKKKSGKWRLLQDLR AVNATMHDMGALQPGLPSPPAVPKGWEIIIDLQDCFFNIKLHPEDCKRF AFSVPSPNFKRPYQRFQWKVLPQGMKNSPTLCQKFVDKAILTVRDKYQDS YIVHYMDDILLAHPSRSIVDEILTSMIQALNKHGLVVSTEKIQKYDNLKY LGTHIQGDSVSYQKLQIRTDKLRTLNDFQKLLGNINWIRPFLKTTGELK PLFEILNPDSNPISTRKLTPEACKALQLMNERLSTARVKRLDLSQPWSLC ILKTEYTPTACLWQDGVVEWIHLPHISPKVITPYDIFCTQLIIKGRHRSK ELFSKDPDYIVVPYTKVQFDLLLQEKEDWPISLLGFLGEVHFHLPKDPLL TFTLQTAIIFPHMTSTTPLEKGIVIFTDGSANGRSVTYIQGREPIIKENT QNTAQQAEIVAVITAFEEVSQPFNLYTDSKYVTGLFPEIETATLSPRTKI YTELKHLQRLIHKRQEKFYIGHIRGHTGLPGPLAQGNAYADSLTRILTA |
| MMTVB_P03365_2mut_WS | MMTVB | P03365 | derivative | 3221 | VQEISDSRPMLHIYLNGRRFLGLLDTGADKTCIAGRDWPANWPIHQTESS LQGLGMACGVARSSQPLRWQHEDKSGIIHPFVIPTLPFTLWGRDIMKDIK VRLMTDSPDDSQDLMIGAIESNLFADQISWKSDQPVWLNQWPLKQEKLQA LQQLVTEQLQLGHLEESNSPWNTPVFVIKKKSGKWRLLQDLRAVNATMHD MGALQPGLPSPVAVPKGWEIIIDLQDCFFNIKLHPEDCKRFAFSVPSPN FKRPYQRFQWKVLPQGMKNSPTLCQKFVDKAILTVRDKYQDSYIVHYMDD ILLAHPSRSIVDEILTSMIQALNKHGLVVSTEKIQKYDNLKYLGTHIQGD SVSYQKLQIRTDKLRTLNDFQKLLGNINWIRPFLKTTGELKPLFEILNP DSNPISTRKLTPEACKALQLMNERLSTARVKRLDLSQPWSLCILKTEYTP TACLWQDGVVEWIHLPHISPKVITPYDIFCTQLIIKGRHRSKELFSKDPD YIVVPYTKVQFDLLLQEKEDWPISLLGFLGEVHFHLPKDPLLTFTLQTAI IFPHMTSTTPLEKGIVIFTDGSANGRSVTYIQGREPIIKENTQNTAQQAE IVAVITAFEEVSQPFNLYTDSKYVTGLFPEIETATLSPRTKIYTELKHLQ RLIHKRQEKFYIGHIRGHTGLPGPLAQGNAYADSLTRILTA |
| MPMV_P07572 | MPMV | P07572 | root | 3222 | LTAAIDILAPQQCAEPITWKSDEPVWWVDQWPLTNDKLAAAQQLVQEQLEA GHITESSSPWNTPIFVIKKKSGKWRLLQDLRAVNATMVLMGALQPGLPSP VAIPQGYLKIIIDLKDCFFSIPLHPSDQKRFAFSLPSTNFKEPMQRFQWK VLPQGMANSPTLCQKYVATAIHKVRHAWKQMYIIHYMDDILIAGKDGQQV LQCFDQLKQELTAAGLHIAPEKVQLQDPYTYLGFELNGPKITNQKAVIRK DKLQTLNDFQKLLGDINWLRPYLKLTTGDLKPLFDTLKGDSDPNSHRSLS KEALASLEKVETAIAEQFVTHINYSLPLIFLIFNTALTPTGLFWQDNPIM WIHLPASPKKVLLPYYDAIADLIILGRDHSKKYFGIEPSTIIQPYSKSQI DWLMQNTEMWPIACASFVGILDNHYPPNKLIQFCKLHTFVPQIISKTPL NNALLVFTDGSSTGMAAYTLTDTTIKFQTNLNSAQLVELQALIAVLSAFP NQPLNIYTDSAYLAHSIPLLETVAQIKHISETAKLFLCQQLIYNRSIPF YIGHVRAHSGLPGPIAQGNQRADLATKIVASNINT |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| MPMV_P07572_2mut | MPMV | P07572 | derivative | 3223 | LTAAIDILAPQQCAEPITWKSDEPVWVDQWPLTNDKLAAAQQLVQEQLEA GHITESSSPWNTPIFVIKKKSGKWRLLQDLRAVNATMVLMGALQPGLPSP VAIPQGYLKIIIDLKDCFFSIPLHPSDQKRFAFSLPSTNFKEPMQRFQWK VLPQGMANSPTLCQKYVATAIHKVRHAWKQMYIIHYMDDILIAGKDGQQV LQCFDQLKQELTAAGLHIAPEKVQLQDPYTYLGFELNGPKITNQKAVIRK DKLQTLNDFQKLLGDINWLRPYLKLTTGDLKPLFDTLKPDSDPNSHRSLS KEALASLEKVETAIAEQFVTHINYSLPLIFLIFNTALTPTGLFWQDNPIM WIHLPASPKKVLLPYYDAIADLIILGRDHSKKYFGIEPSTIIQPYSKSQI DWLMQNTEMWPIACASFVGILDNHYPPNKLIQFCKLHTFVFPQIISKTPL NNALLVFTDGSSTGMAAYTLTDTTIKFQTNLNSAQLVELQALIAVLSAFP NQPLNIYTDSAYLAHSIPLLETVAQIKHISETAKLFLQCQQLIYNRSIPF YIGHVRAHSGLPGPIAQGNQRADLATKIVASNINT |
| MPMV_P07572_2mutB | MPMV | P07572 | derivative | 3224 | LTAAIDILAPQQCAEPITWKSDEPVWVDQWPLTNDKLAAAQQLVQEQLEA GHITESSSPWNTPIFVIKKKSGKWRLLQDLRAVNATMVLMGALQPGLPSP VAPPQGYLKIIIDLKDCFFSIPLHPSDQKRFAFSLPSTNFKEPMQRFQWK VLPQGMANSPTLCQKYVATAIHKVRHAWKQMYIIHYMDDILIA GKDGQQVLQCFDQLKQELTAAGLHIAPEKVQLQDPYTYLGFELNGPKITN QKAVIRKDKLQTLNDFQKLLGDINWLRPYLKLTTGDLKPLFDTLKPDSDP NSHRSLSKEALASLEKVETAIAEQFVTHINYSLPLIFLIFNTALTPTGLF WQDNPIMWIHLPASPKKVLLPYYDAIADLIILGRDHSKKYFGIEPSTIIQ PYSKSQIDWLMQNTEMWPIACASFVGILDNHYPPNKLIQFCKLHTFVFPQ IISKTPLNNALLVFTDGSSTGMAAYTLTDTTIKFQTNLNSAQLVELQALI AVLSAFPNQPLNIYTDSAYLAHSIPLLETVAQIKHISETAKLFLQCQQLI YNRSIPFYIGHVRAHSGLPGPIAQGNQRADLATKIVASNINT |
| PERV_Q4VFZ2_3mutA_WS | PERV | Q4VFZ2 | root | 3225 | LDDEYRLYSPLVKPDQNIQFWLEQFPQAWAETAGMGLAKQVPPQVIQLKA SATPVSVRQYPLSKEAQEGIRPHVQRLIQQGILVPVQSPWNTPLLPVRKP GTNDYRPVQDLREVNKRVQDIHPTVPNPYNLLCALPPQRSWYTVLDLKDA FFCLRLHPTSQPLFAFEWRDPGTGRTGQLTWTRLPQGFKNSPTIFNEALH RDLANFRIQHPQVTLLQYVDDLLLAGATKQDCLEGTKALLLELSDLGYRA SAKKAQICRREVTYLGYSLRDGQRWLTEARKKTVVQIPAPTTAKQVREFL GKAGFCRLFIPGFATLAAPLYPLTKPKGEFSWAPEHQKAFDAIKKALLSA PALALPDVTKPFTLYVDERKGVARGVLTQTLGPWRRPVAYLSKKLDPVAS GWPVCLKAIAAVAILVKDADKLTLGQNITVIAPHALENIVRQPPDRWMTN ARMTHYQSLLLTERVTFAPPAALNPATLLPEETDEPVTHDCHQLLIEETG VRKDLTDIPLTGEVLTWFTDGSSYVVEGKRMAGAAVVDGTRTIWASSLPE GTSAQKAELMALTQALRLAEGKSINIYTDSRYAFATAHVHGAIYKQRGWL TSAGREIKNKEEILSLLEALHLPKRLAIIHCPGHQKAKDPISRGNQMADR VAKQAAQGVNLLP |
| PERV_Q4VFZ2 | PERV | Q4VFZ2 | derivative | 3226 | TLQLDDEYRLYSPLVKPDQNIQFWLEQFPQAWAETAGMGLAKQVPPQVIQ LKASATPVSVRQYPLSKEAQEGIRPHVQRLIQQGILVPVQSPWNTPLLPV RKPGTNDYRPVQDLREVNKRVQDIHPTVPNPYNLLCALPPQRSWYTVLDL KDAFFCLRLHPTSQPLFAFEWRDPGTGRTGQLTWTRLPQGFKNSPTIFDE ALHRDLANFRIQHPQVTLLQYVDDLLLAGATKQDCLEGTKALLLELSDLG YRASAKKAQICRREVTYLGYSLRDGQRWLTEARKKTVVQIPAPTTAKQVR EFLGTAGFCRLWIPGFATLAAPLYPLTKEKGEFSWAPEHQKAFDAIKKAL LSAPALALPDVTKPFTLYVDERKGVARGVLTQTLGPWRRPVAYLSKKLDP VASGWPVCLKAIAAVAILVKDADKLTLGQNITVIAPHALENIVRQPPDRW MTNARMTHYQSLLLTERVTFAPPAALNPATL LPEETDEPVTHDCHQLLIEETGVRKDLTDIPLTGEVLTWFTDGSSYVVEG KRMAGAAVVDGTRTIWASSLPEGTSAQKAELMALTQALRLAEGKSINIYT DSRYAFATAHVHGAIYKQRGLLTSAGREIKNKEEILSLLEALHLPKRLAI IHCPGHQKAKDPISRGNQMADRVAKQAAQGVNLL |
| PERV_Q4VFZ2_3mut | PERV | Q4VFZ2 | derivative | 3227 | TLQLDDEYRLYSPLVKPDQNIQFWLEQFPQAWAETAGMGLAKQVPPQVIQ LKASATPVSVRQYPLSKEAQEGIRPHVQRLIQQGILVPVQSPWNTPLLPV RKPGTNDYRPVQDLREVNKRVQDIHPTVPNPYNLLCALPPQRSWYTVLDL KDAFFCLRLHPTSQPLFAFEWRDPGTGRTGQLTWTRLPQGFKNSPTIFNE ALHRDLANFRIQHPQVTLLQYVDDLLLAGATKQDCLEGTKALLLELSDLG YRASAKKAQICRREVTYLGYSLRDGQRWLTEARKKTVVQIPAPTTAKQVR EFLGTAGFCRLWIPGFATLAAPLYPLTKPKGEFSWAPEHQKAFDAIKKAL LSAPALALPDVTKPFTLYVDERKGVARGVLTQTLGPWRRPVAYLSKKLDP VASGWPVCLKAIAAVAILVKDADKLTLGQNITVIAPHALENIVRQPPDRW MTNARMTHYQSLLLTERVTFAPPAALNPATLLPEETDEPVTHDCHQLLIE ETGVRKDLTDIPLTGEVLTWFTDGSSYVVEGKRMAGAAVVDGTRTIWASS LPEGTSAQKAELMALTQALRLAEGKSINIYTDSRYAFATAHVHGAIYKQR |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | GWLTSAGREIKNKEEILSLLEALHLPKRLAIIHCPGHQKAKDPISRGNQM ADRVAKQAAQGVNLL |
| PERV_Q4VFZ2_3mutA_WS | PERV | Q4VFZ2 | root | 3225 | LDDEYRLYSPLVKPDQNIQFWLEQFPQAWAETAGMGLAKQVPPQVIQLKA SATPVSVRQYPLSKEAQEGIRPHVQRLIQQGILVPVQSPWNTPLLPVRKP GTNDYRPVQDLREVNKRVQDIHPTVPNPYNLLCALPPQRSWYTVLDLKDA FFCLRLHPTSQPLFAFEWRDPGTGRTGQLTWTRLPQGFKNSP TIFNEALHRDLANFRIQHPQVTLLQYVDDLLLAGATKQDCLEGTKALLLE LSDLGYRASAKKAQICRREVTYLGYSLRDGQRWLTEARKKTVVQIPAPTT AKQVREFLGKAGFCRLFIPGFATLAAPLYPLTKPKGEFSWAPEHQKAFDA IKKALLSAPALALPDVTKPFTLYVDERKGVARGVLTQTLGPWRRPVAYLS KKLDPVASGWPVCLKAIAAVAILVKDADKLTLGQNITVIAPHALENIVRQ PPDRWMTNARMTHYQSLLLTERVTFAPPAALNPATLLPEETDEPVTHDCH QLLIEETGVRKDLTDIPLTGEVLTWFTDGSSYVVEGKRMAGAAVVDGTRT IWASSLPEGTSAQKAELMALTQALRLAEGKSINIYTDSRYAFATAHVHGA IYKQRGWLTSAGREIKNKEEILSLLEALHLPKRLAIIHCPGHQKAKDPIS RGNQMADRVAKQAAQGVNLLP |
| PERV_Q4VFZ2 | PERV | Q4VFZ2 | derivative | 3226 | TLQLDDEYRLYSPLVKPDQNIQFWLEQFPQAWAETAGMGLAKQVPPQVIQ LKASATPVSVRQYPLSKEAQEGIRPHVQRLIQQGILVPVQSPWNTPLLPV RKPGTNDYRPVQDLREVNKRVQDIHPTVPNPYNLLCALPPQRSWYTVLDL KDAFFCLRLHPTSQPLFAFEWRDPGTGRTGQLTWTRLPQGFKNSPTIFDE ALHRDLANFRIQHPQVTLLQYVDDLLLAGATKQDCLEGTKALLLELSDLG YRASAKKAQICRREVTYLGYSLRDGQRWLTEARKKTVVQIPAPTTAKQVR EFLGTAGFCRLWIPGFATLAAPLYPLTKEKGEFSWAPEHQKAFDAIKKAL LSAPALALPDVTKPFTLYVDERKGVARGVLTQTLGPWRRPVAYLSKKLDP VASGWPVCLKAIAAVAILVKDADKLTLGQNITVIAPHALENIVRQPPDRW MTNARMTHYQSLLLTERVTFAPPAALNPATLLPEETDEPVTHDCHQLLIE ETGVRKDLTDIPLTGEVLTWFTDGSSYVVEGKRMAGAAVVDGTRTIWASS LPEGTSAQKAELMALTQALRLAEGKSINIYTDSRYAFATAHVHGAIYKQR GLLTSAGREIKNKEEILSLLEALHLPKRLAIIHCPGHQKAKDPISRGNQM ADRVAKQAAQGVNLL |
| PERV_Q4VFZ2_3mut | PERV | Q4VFZ2 | derivative | 3227 | TLQLDDEYRLYSPLVKPDQNIQFWLEQFPQAWAETAGMGLAKQVPPQVIQ LKASATPVSVRQYPLSKEAQEGIRPHVQRLIQQGILVPVQSPWNTPLLPV RKPGTNDYRPVQDLREVNKRVQDIHPTVPNPYNLLCALPPQRSWYTVLDL KDAFFCLRLHPTSQPLFAFEWRDPGTGRTGQLTWTRLPQGFKNSPTIFNE ALHRDLANFRIQHPQVTLLQYVDDLLLAGATKQDCLEGTKALLLELSDLG YRASAKKAQICRREVTYLGYSLRDGQRWLTEARKKTVVQIPAPTTAKQVR EFLGTAGFCRLWIPGFATLAAPLYPLTKPKGEFSWAPEHQKAFDAIKKAL LSAPALALPDVTKPFTLYVDERKGVARGVLTQTLGPWRRPVAYLSKKLDP VASGWPVCLKAIAAVAILVKDADKLTLGQNITVIAPHALENIVRQPPDRW MTNARMTHYQSLLLTERVTFAPPAALNPATLLPEETDEPVTHDCHQLLIE ETGVRKDLTDIPLTGEVLTWFTDGSSYVVEGKRMAGAAVVDGTRTIWASS LPEGTSAQKAELMALTQALRLAEGKSINIYTDSRYAFATAHVHGAIYKQR GWLTSAGREIKNKEEILSLLEALHLPKRLAIIHCPGHQKAKDPISRGNQM ADRVAKQAAQGVNLL |
| SFV1_P23074 | SFV1 | P23074 | root | 3228 | MDPLQLLQPLEAEIKGTKLKAHWNSGATITCVPEAFLEDERPIQTMLIKT IHGEKQQDVYYLTFKVQGRKVEAEVLASPYDYILLNPSDVPWLMKKPLQL TVLVPLHEYQERLLQQTALPKEQKELLQKLFLKYDALWQHWENQVGHRRI KPHNIATGTLAPRPQKQYPINPKAKPSIQIVIDDLLKQGVLIQQNSTMNT PVYPVPKPDGKWRMVLDYREVNKTIPLIAAQNQHSAGILSSIYRGKYKTT LDLTNGFWAHPITPESYWLTAFTWQGKQYCWTRLPQGFLNSPALFTADVV DLLKEIPNVQAYVDDIYISHDDPQEHLEQEKIFSILLNAGYVVSLKKSE IAQREVEFLGFNITKEGRGLTDTFKQKLLNITPPKDLKQLQSILGLLNFA RNFIPNYSELVKPLYTIVANANGKFISWTEDNSNQLQHIISVLNQADNLE ERNPETRLIIKVNSSPSAGYIRYYNEGSKRPIMYVNYIFSKAEAKFTQTE KLLTTMHKGLIKAMDLAMGQEILVYSPIVSMTKIQRTPLPERKALPVRWI TWMTYLEDPRIQFHYDKSLPELQQIPNVTEDVIAKTKHPSEFAMVFYTDG SAIKHPDVNKSHSAGMGIAQVQFIPEYKIVHQWSIPLGDHTAQLAEIAAV EFACKKALKISGPVLIVTDSFYVAESANKELPYWKSNGFLNNKKKPLRHV SKWKSIAECLQLKPDIIIMHEKGHQQPMTTLHTEGNNLADKLATQGSYVV H |
| SFV1_P23074-Pro | SFV1 | P23074 | derivative | 3229 | VPWLMKKPLQLTVLVPLHEYQERLLQQTALPKEQKELLQKLFLKYDALWQ HWENQVGHRRIKPHNIATGTLAPRPQKQYPINPKAKPSIQIVIDDLLKQG VLIQQNSTMNTPVYPVPKPDGKWRMVLDYREVNKTIPLIAAQNQHSAGIL SSIYRGKYKTTLDLTNGFWAHPITPESYWLTAFTWQGKQYCWTRLPQGFL |

TABLE 9-continued

Retroviral reverse transcriptase domains for use in Gene Writer ™ polypeptides. In some embodiments, a system or method described herein involves a reverse transcriptase domain having an amino acid sequence according to a reverse transcriptase domain of Table 9, or a sequence having at least 70%, 75%, 80%, 85%, 90%, 95%, 96%, 97%, 98%, or 99% identity thereto, or functional fragment thereof.

| name | virus_name | uniprot_ID | type | SEQ ID NO: | peptide |
|---|---|---|---|---|---|
| | | | | | NSPALFTADVVDLLKEIPNVQAYVDDIYISHDDPQEHLEQLEKIFSILLN AGYVVSLKKSEIAQREVEFLGFNITKEGRGLTDTFKQKLLNITPPKDLKQ LQSILGLLNFARNFIPNYSELVKPLYTIVANANGKFISWTEDNSNQLQHI ISVLNQADNLEERNPETRLIIKVNSSPSAGYIRYYNEGSKRPIMYVNYIF SKAEAKFTQTEKLLTTMHKGLIKAMDLAMGQEILVYSPIVSMTKIQRTPL PERKALPVRWITWMTYLEDPRIQFHYDKSLPELQQIPNVTEDVIAKTKHP SEFAMVFYTDGSAIKHPDVNKSHSAGMGIAQVQFIPEYKIVHQWSIPLGD HTAQLAEIAAVEFACKKALKISGPVLIVTDSFYVAESANKELPYWKSNGF LNNKKKPLRHVSKWKSIAECLQLKPDIIIMHEKGHQQPMTTLHTEGNNLA DKLATQGSYVVH |
| SFV1_P23074-Pro_2mut | SFV1 | P23074 | derivative | 3230 | VPWLMKKPLQLTVLVPLHEYQERLLQQTALPKEQKELLQKLFLKYDALWQ HWENQVGHRRIKPHNIATGTLAPRPQKQYPINPKAKPSIQIVIDDLLKQG VLIQQNSTMNTPVYPVPKPDGKWRMVLDYREVNKTIPLIAAQNQHSAGIL SSIYRGKYKTTLDLTNGFWAHPITPESYWLTAFTWQGKQYCWTRLPQGFL NSPALFNADVVDLLKEIPNVQAYVDDIYISHDDPQEHLEQLEKIFSILLN AGYVVSLKKSEIAQREVEFLGFNITKEGRGLTDTFKQKLLNITPPKDLKQ LQSILGLLNFARNFIPNYSELVKPLYTIVAPANGKFISWTEDNSNQLQHI ISVLNQADNLEERNPETRLIIKVNSSPSAGYIRYYNEGSKRPIMYVNYIF SKAEAKFTQTEKLLTTMHKGLIKAMDLAMGQEILVYSPIVSMTKIQRTPL PERKALPVRWITWMTYLEDPRIQFHYDKSLPELQQIPN VTEDVIAKTKHPSEFAMVFYTDGSAIKHPDVNKSHSAGMGIAQVQFIPEY KIVHQWSIPLGDHTAQLAEIAAVEFACKKALKISGPVLIVTDSFYVAESA NKELPYWKSNGFLNNKKKPLRHVSKWKSIAECLQLKPDIIIMHEKGHQQP MTTLHTEGNNLADKLATQGSYVVH |
| SFV1_P23074-Pro_2mutA | SFV1 | P23074 | derivative | 3231 | VPWLMKKPLQLTVLVPLHEYQERLLQQTALPKEQKELLQKLFLKYDALWQ HWENQVGHRRIKPHNIATGTLAPRPQKQYPINPKAKPSIQIVIDDLLKQG VLIQQNSTMNTPVYPVPKPDGKWRMVLDYREVNKTIPLIAAQNQHSAGIL SSIYRGKYKTTLDLTNGFWAHPITPESYWLTAFTWQGKQYCWTRLPQGFL NSPALFNADVVDLLKEIPNVQAYVDDIYISHDDPQEHLEQLEKIFSILLN AGYVVSLKKSEIAQREVEFLGFNITKEGRGLTDTFKQKLLNITPPKDLKQ LQSILGKLNFARNFIPNYSELVKPLYTIVAPANGKFISWTEDNSNQLQHI ISVLNQADNLEERNPETRLIIKVNSSPSAGYIRYYNEGSKRPIMYVNYIF SKAEAKFTQTEKLLTTMHKGLIKAMDLAMGQEILVYSPIVSMTKIQRTPL PERKALPVRWITWMTYLEDPRIQFHYDKSLPELQQIPNVTEDVIAKTKHP SEFAMVFYTDGSAIKHPDVNKSHSAGMGIAQVQFIPEYKIVHQWSIPLGD HTAQLAEIAAVEFACKKALKISGPVLIVTDSFYVAESANKELPYWKSNGF LNNKKKPLRHVSKWKSIAECLQLKPDIIIMHEKGHQQPMTTLHTEGNNLA DKLATQGSYVVH |
| SFV1_P23074_2mut | SFV1 | P23074 | derivative | 3232 | MDPLQLLQPLEAEIKGTKLKAHWNSGATITCVPEAFLEDERPIQTMLIKT IHGEKQQDVYYLTFKVQGRKVEAEVLASPYDYILLNPSDVPWLMKKPLQL TVLVPLHEYQERLLQQTALPKEQKELLQKLFLKYDALWQHWENQVGHRRI KPHNIATGTLAPRPQKQYPINPKAKPSIQIVIDDLLKQGVLIQQNSTMNT PVYPVPKPDGKWRMVLDYREVNKTIPLIAAQNQHSAGILSSIYRGKYKTT LDLTNGFWAHPITPESYWLTAFTWQGKQYCWTRLPQGFLNSPALFNADVV DLLKEIPNVQAYVDDIYISHDDPQEHLEQLEKIFSILLNAGYVVSLKKSE IAQREVEFLGFNITKEGRGLTDTFKQKLLNITPPKDLKQLQSILGLLNFA RNFIPNYSELVKPLYTIVAPANGKFISWTEDNSNQLQHIISVLNQADNLE ERNPETRLIIKVNSSPSAGYIRYYNEGSKRPIMYVNYIFSKAEAKFTQTE KLLTTMHKGLIKAMDLAMGQEILVYSPIVSMTKIQRTPLPERKALPVRWI TWMTYLEDPRIQFHYDKSLPELQQIPNVTEDVIAKT KHPSEFAMVFYTDGSAIKHPDVNKSHSAGMGIAQVQFIPEYKIVHQWSIP LGDHTAQLAEIAAVEFACKKALKISGPVLIVTDSFYVAESANKELPYWKS NGFLNNKKKPLRHVSKWKSIAECLQLKPDIIIMHEKGHQQPMTTLHTEGN NLADKLATQGSYVVH |
| SFV1_P23074_2mutA | SFV1 | P23074 | derivative | 3233 | MDPLQLLQPLEAEIKGTKLKAHWNSGATITCVPEAFLEDERPIQTMLIKT IHGEKQQDVYYLTFKVQGRKVEAEVLASPYDYILLNPSDVPWLMKKPLQL TVLVPLHEYQERLLQQTALPKEQKELLQKLFLKYDALWQHWENQVGHRRI KPHNIATGTLAPRPQKQYPINPKAKPSIQIVIDDLLKQGVLIQQNSTMNT PVYPVPKPDGKWRMVLDYREVNKTIPLIAAQNQHSAGILSSIYRGKYKTT LDLTNGFWAHPITPESYWLTAFTWQGKQYCWTRLPQGFLNSPALFNADVV DLLKEIPNVQAYVDDIYISHDDPQEHLEQLEKIFSILLNAGYVVSLKKSE IAQREVEFLGFNITKEGRGLTDTFKQKLLNITPPKDLKQLQSILGKLNFA RNFIPNYSELVKPLYTIVAPANGKFISWTEDNSNQLQHIISVLNQADNLE ERNPETRLIIKVNSSPSAGYIRYYNEGSKRPIMYVNYIFSKAEAKFTQTE KLLTTMHKGLIKAMDLAMGQEILVYSPIVSMTKIQRTPLPERKALPVRWI |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | TWMTYLEDPRIQFHYDKSLPELQQIPNVTEDVIAKTKHPSEFAMVFYTDG SAIKHPDVNKSHSAGMGIAQVQFIPEYKIVHQWSIPLGDHTAQLAEIAAV EFACKKALKISGPVLIVTDSFYVAESANKELPYWKSNGFLNNKKKPLRHV SKWKSIAECLQLKPDIIIMHEKGHQQPMTTLHTEGNNLADKLATQGSYVV H |
| SFV3L_P27401 | SFV3L | P27401 | root | 3234 | MDPLQLLQPLEAEIKGTKLKAHWNSGATITCVPQAFLEEEVPIKNIWIKT IHGEKEQPVYYLTFKIQGRKVEAEVISSPYDYILVSPSDIPWLMKKPLQL TTLVPLQEYEERLLKQTMLTGSYKEKLQSLFLKYDALWQHWENQVGHRRI KPHHIATGTVNPRPQKQYPINPKAKASIQTVINDLLKQGVLIQQNSIMNT PVYPVPKPDGKWRMVLDYREVNKTIPLIAAQNQHSAGILSSIFRGKYKTT LDLSNGFWAHSITPESYWLTAFTWLGQQYCWTRLPQGFLNSPALFTADVV DLLKEVPNVQVYVDDIYISHDDPREHLEQLEKVFSLLLNAGYVVSLKKSE IAQHEVEFLGFNITKEGRGLTETFKQLLNITPPRDLKQLQSILGLLNFA RNFIPNFSELVKPLYNIIATANGKYITWTTDNSQQLQNIISMLNSAENLE ERNPEVRLIMKVNTSPSAGYIRFYNEFAKRPIMYLNYVYTKAEVKFTNTE KLLTTIHKGLIKALDLGMGQEILVYSPIVSMTKIQKTPLPERKALPIRWI TWMSYLEDPRIQFHYDKTLPELQQVPTVTDDIIAKIKHPSEFSMVFYTDG SAIKHPNVNKSHNAGMGIAQVQFKPEFTVINTWSIPLGDHTAQLAEVAAV EFACKKALKIDGPVLIVTDSFYVAESVNKELPYWQSNGFFNNKKKPLKHV SKWKSIADCIQLKPDIIIIHEKGHQPTASTFHTEGNNLADKLATQGSYVV N |
| SFV3L_P27401=Pro | SFV3L | P27401 | derivative | 3235 | IPWLMKKPLQLTTLVPLQEYEERLLKQTMLTGSYKEKLQSLFLKYDALWQ HWENQVGHRRIKPHHIATGTVNPRPQKQYPINPKAKASIQTVINDLLKQG VLIQQNSIMNTPVYPVPKPDGKWRMVLDYREVNKTIPLIAAQNQHSAGIL SSIFRGKYKTTLDLSNGFWAHSITPESYWLTAFTWLGQQYCWTRLPQGFL NSPALFTADVVDLLKEVPNVQVYVDDIYISHDDPREHLEQLEKVFSLLLN AGYVVSLKKSEIAQHEVEFLGFNITKEGRGLTETFKQLLNITPPRDLKQ LQSILGLLNFARNFIPNFSELVKPLYNIIATANGKYITWTTDNSQQLQNI ISMLNSAENLEERNPEVRLIMKVNTSPSAGYIRFYNEFAKRPIMYLNYVY TKAEVKFTNTEKLLTTIHKGLIKALDLGMGQEILVYSPIVSMTKIQKTPL PERKALPIRWITWMSYLEDPRIQFHYDKTLPELQQVPTVTDDIIAKIKHP SEFSMVFYTDGSAIKHPNVNKSHNAGMGIAQVQFKPEFTVINTWSIPLGD HTAQLAEVAAVEFACKKALKIDGPVLIVTDSFYVAESVNKELPYWQSNGF FNNKKKPLKHVSKWKSIADCIQLKPDIIIIHEKGHQPTASTFHTEGNNLA DKLATQGSYVVN |
| SFV3L_P27401-Pro_2mut | SFV3L | P27401 | derivative | 3236 | IPWLMKKPLQLTTLVPLQEYEERLLKQTMLTGSYKEKLQSLFLKYDALWQ HWENQVGHRRIKPHHIATGTVNPRPQKQYPINPKAKASIQTVINDLLKQG VLIQQNSIMNTPVYPVPKPDGKWRMVLDYREVNKTIPLIAAQNQHSAGIL SSIFRGKYKTTLDLSNGFWAHSITPESYWLTAFTWLGQQYCW TRLPQGFLNSPALFNADVVDLLKEVPNVQVYVDDIYISHDDPREHLEQLE KVFSLLLNAGYVVSLKKSEIAQHEVEFLGFNITKEGRGLTETFKQLLNI TPPRDLKQLQSILGLLNFARNFIPNFSELVKPLYNIIATAPGKYITWTTD NSQQLQNIISMLNSAENLEERNPEVRLIMKVNTSPSAGYIRFYNEFAKRP IMYLNYVYTKAEVKFTNTEKLLTTIHKGLIKALDLGMGQEILVYSPIVSM TKIQKTPLPERKALPIRWITWMSYLEDPRIQFHYDKTLPELQQVPTVTDD IIAKIKHPSEFSMVFYTDGSAIKHPNVNKSHNAGMGIAQVQFKPEFTVIN TWSIPLGDHTAQLAEVAAVEFACKKALKIDGPVLIVTDSFYVAESVNKEL PYWQSNGFFNNKKKPLKHVSKWKSIADCIQLKPDIIIIHEKGHQPTASTF HTEGNNLADKLATQGSYVVN |
| SFV3L_P27401-Pro_2mutA | SFV3L | P27401 | derivative | 3237 | IPWLMKKPLQLTTLVPLQEYEERLLKQTMLTGSYKEKLQSLFLKYDALWQ HWENQVGHRRIKPHHIATGTVNPRPQKQYPINPKAKASIQTVINDLLKQG VLIQQNSIMNTPVYPVPKPDGKWRMVLDYREVNKTIPLIAAQNQHSAGIL SSIFRGKYKTTLDLSNGFWAHSITPESYWLTAFTWLGQQYCWTRLPQGFL NSPALFNADVVDLLKEVPNVQVYVDDIYISHDDPREHLEQLEKVFSLLLN AGYVVSLKKSEIAQHEVEFLGFNITKEGRGLTETFKQLL NITPPRDLKQLQSILGKLNFARNFIPNFSELVKPLYNIIATAPGKYITWT TDNSQQLQNIISMLNSAENLEERNPEVRLIMKVNTSPSAGYIRFYNEFAK RPIMYLNYVYTKAEVKFTNTEKLLTTIHKGLIKALDLGMGQEILVYSPIV SMTKIQKTPLPERKALPIRWITWMSYLEDPRIQFHYDKTLPELQQVPTVT DDIIAKIKHPSEFSMVFYTDGSAIKHPNVNKSHNAGMGIAQVQFKPEFTV INTWSIPLGDHTAQLAEVAAVEFACKKALKIDGPVLIVTDSFYVAESVNK ELPYWQSNGFFNNKKKPLKHVSKWKSIADCIQLKPDIIIIHEKGHQPTAS TFHTEGNNLADKLATQGSYVVN |

TABLE 9-continued

Retroviral reverse transcriptase domains for use in Gene Writer ™ polypeptides.
In some embodiments, a system or method described TABLE 9-continued Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| SFVCP_Q87040-Pro_2mut | SFVCP | 087040 | derivative | 3242 | VPWLTQQPLQLTILVPLQEYQDRILNKTALPEEQKQQLKALFTKYDNLWQ HWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGIL ATIVRQKYKTTLDLANGFWAHPITPDSYWLTAFTWQGKQYCWTRLPQGFL NSPALFNADAVDLLKEVPNVQVYVDDIYLSHDNPHEHIQQLEKVFQILLQ AGYVVSLKKSEIGQRTVEFLGFNITKEGRGLTDTFKTKLLNVTPPKDLKQ LQSILGLLNFARNFIPNFAELVQTLYNLIASSPGKYIEWTEDNTKQLNKV IEALNTASNLEERLPDQRLVIKVNTSPSAGYVRYYNESGKKPIMYLNYVF SKAELKFSMLEKLLTTMHKALIKAMDLAMGQEILVYSPIVSMTKIQKTPL PERKALPIRWITWMTYLEDPRIQFHYDKTLPELKHIPDVYTSSIPPLKHP SQYEGVFCTDGSAIKSPDPTKSNNAGMGIVHAIYNPEYKILNQWSIPLGH HTAQMAEIAAVEFACKKALKVPGPVLVITDSFYVAESANKELPYWKSNGF VNNKKEPLKHISKWKSIAECLSIKPDITIQHEKGHQPINTSIHTEGNALA DKLATQGSYVVN |
| SFVCP_Q87040-Pro_2mutA | SFVCP | 087040 | derivative | 3243 | VPWLTQQPLQLTILVPLQEYQDRILNKTALPEEQKQQLKALFTKYDNLWQ HWENQVGHRKIRPHNIATGDYPPRPQKQYPINPKAKPSIQIVIDDLLKQG VLTPQNSTMNTPVYPVPKPDGRWRMVLDYREVNKTIPLTAAQNQHSAGIL ATIVRQKYKTTLDLANGFWAHPITPDSYWLTAFTWQGKQYCWTRLPQGFL NSPALFNADAVDLLKEVPNVQVYVDDIYLSHDNPHEHIQQLEKVFQILLQ AGYVVSLKKSEIGQRTVEFLGFNITKEGRGLTDTFKTK LLNVTPPKDLKQLQSILGKLNFARNFIPNFAELVQTLYNLIASSPGKYIE WTEDNTKQLNKVIEALNTASNLEERLPDQRLVIKVNTSPSAGYVRYYNES GKKPIMYLNYVFSKAELKFSMLEKLLTTMHKALIKAMDLAMGQEILVYSP IVSMTKIQKTPLPERKALPIRWITWMTYLEDPRIQFHYDKTLPELKHIPD VYTSSIPPLKHPSQYEGVFCTDGSAIKSPDPTKSNNAGMGIVHAIYNPEY KILNQWSIPLGHHTAQMAEIAAVEFACKKALKVPGPVLVITDSFYVAESA NKELPYWKSNGFVNNKKEPLKHISKWKSIAECLSIKPDITIQHEKGHQPI NTSIHTEGNALADKLATQGSYVVN |
| SFVCP_Q87040_2mut | SFVCP | Q87040 | derivative | 3244 | MNPLQLLQPLPAEVKGTKLLAHWNSGATITCIPESFLEDEQPIKQTLIKT IHGEKQQNVYYLTFKVKGRKVEAEVIASPYEYILLSPTDVPWLTQQPLQL TILVPLQEYQDRILNKTALPEEQKQQLKALFTKYDNLWQHWENQVGHRKI RPHNIATGDYPPRPQKQYPINPKAKPSIQIVIDDLLKQGVLTPQNSTMNT PVYPVPKPDGRWRMVLDYREVNKTIPLTAAQNQHSAGILATIVRQKYKTT LDLANGFWAHPITPDSYWLTAFTWQGKQYCWTRLPQGFLNSPALFNADAV DLLKEVPNVQVYVDDIYLSHDNPHEHIQQLEKVFQILLQAGYVVSLKKSE IGQRTVEFLGFNITKEGRGLTDTFKTKLLNVTPPKDLKQLQSILGLLNFA RNFIPNFAELVQTLYNLIASSPGKYIEWTEDNTKQLNKVIEALNTASNLE ERLPDQRLVIKVNTSPSAGYVRYYNESGKKPIMYLNYVFSKAELKFSMLE KLLTTMHKALIKAMDLAMGQEILVYSPIVSMTKIQKTPLPERKALPIRWI TWMTYLEDPRIQFHYDKTLPELKHIPDVYTSSIPPLKHPSQYEGVFCTDG SAIKSPDPTKSNNAGMGIVHAIYNPEYKILNQWSIPLGHHTAQMAEIAAV EFACKKALKVPGPVLVITDSFYVAESANKELPYWKSNGFVNNKKEPLKHI SKWKSIAECLSIKPDITIQHEKGHQPINTSIHTEGNALADKLATQGSYVV N |
| SFVCP_Q87040_2mutA | SFVCP | Q87040 | derivative | 3245 | MNPLQLLQPLPAEVKGTKLLAHWNSGATITCIPESFLEDEQPIKQTLIKT IHGEKQQNVYYLTFKVKGRKVEAEVIASPYEYILLSPTDVPWLTQQPLST MNTPVYPVPKPDGRWRMVLDYREVNKTIPLTAAQNQHSAGILATIVRQKY KTTLDLANGFWAHPITPDSYWLTAFTWQGKQYCWTRLPQGFLNSPALFNA DAVDLLKEVPNVQVYVDDIYLSHDNPHEHIQQLEKVFQILLQAGYVVSLK KSEIGQRTVEFLGFNITKEGRGLTDTFKTKLLNVTPPKDLKQLQSILGKL NFARNFIPNFAELVQTLYNLIASSPGKYIEWTEDNTKQLNKVIEALNTAS NLEERLPDQRLVIKVNTSPSAGYVRYYNESGKKPIMYLNYVFSKAELKFS MLEKLLTTMHKALIKAMDLAMGQEILVYSPIVSMTKIQKTPLPERKALPI RWITWMTYLEDPRIQFHYDKTLPELKHIPDVYTSSIPPLKHPSQYEGVFC TDGSAIKSPDPTKSNNAGMGIVHAIYNPEYKILNQWSIPLGHHTAQMAEI AAVEFACKKALKVPGPVLVITDSFYVAESANKELPYWKSNGFVNNKKEPL KHISKWKSIAECLSIKPDITIQHEKGHQPINTSIHTEGNALADKLATQGS YVVN |
| SMRVH_P03364 | SMRVH | P03364 | root | 3246 | PRSRAIDIPVPHADKISWKITDPVWVDQWPLTYEKTLAAIALVQEQLAAG HIEPTNSPWNTPIFIIKKKSGSWRLLQDLRAVNKVMPMGALQPGLSPV AIPLNYHKIVIDLKDCFFTIPLHPEDRPYFAFSVPQINFQSPMPRYQWKV LPQGMANSPTLCQKFVAAAIAPVRSQWPEAYILHYMDDILLACDSAEAAK ACYAHIISCLTSYGLKIAPDKVQVSEPFSYLGFELHHQQVFTPRVCLKTD HLKTLNDFQKLLGDIQWLRPYLKLPTSALVPLNNILKGDPNPLSVRALTP |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_ name | uniprot_ ID | type | SEQ ID NO: | peptide |
|---|---|---|---|---|---|
| | | | | | EAKQSLALINKAIQNSVQQISYNLPLVLLLLPTPHTPTAVFWQPNGTDP TKNGSPLLWLHLPASPSKVLLTYPSLLAMLIIKGRYTGRQLFGRDPHSII IPYTQDQLTWLLQTSDEWAIALSSFTGDIDNHYPSDPVIQFAKLHQFIFP KITKCAPIPQATLVFTDGSSNGIAAYVIDNQPISIKSPYLSAQLVELYAI LQVFTVLAHQPFNLYTDSAYIAQSVPLLETVPFIKSSTNATPLFSKLQQL ILNRQHPFFIGHLRAHLNLPGPLAEGNALADAATQIFPIISD |
| SMRVH_ P03364_ 2mut | SMRVH | P03364 | derivative | 3247 | PRSRAIDIPVPHADKISWKITDPVWVDQWPLTYEKTLAAIALVQEQLAAG HIEPTNSPWNTPIFIIKKKSGSWRLLQDLRAVNKVMPMGALQPGLPSPV AIPLNYHKIVIDLKDCFFTIPLHPEDRPYFAFSVPQINFQSPMPRYQWKV LPQGMANSPTLCQKFVAAAIAPVRSQWPEAYILHYMDDILLACDS AEEAAKACYAHIISCLTSYGLKIAPDKVQVSEPFSYLGFELHHQQVFTPRV CLKTDHLKTLNDFQKLLGDIQWLRPYLKLPTSALVPLNNILKPDPNPLSV RALTPEAKQSLALINKAIQNSVQQISYNLPLVLLLLPTPHTPTAVFWQP NGTDPTKNGSPLLWLHLPASPSKVLLTYPSLLAMLIIKGRYTGRQLFGRD PHSIIIPYTQDQLTWLLQTSDEWAIALSSFTGDIDNHYPSDPVIQFAKLH QFIFPKITKCAPIPQATLVFTDGSSNGIAAYVIDNQPISIKSPYLSAQLV ELYAILQVFTVLAHQPFNLYTDSAYIAQSVPLLETVPFIKSSTNATPLFS KLQQLILNRQHPFFIGHLRAHLNLPGPLAEGNALADAATQIFPIISD |
| SMRVH_ P03364_2 mutB | SMRVH | P03364 | derivative | 3248 | PRSRAIDIPVPHADKISWKITDPVWVDQWPLTYEKTLAAIALVQEQLAAG HIEPTNSPWNTPIFIIKKKSGSWRLLQDLRAVNKVMPMGALQPGLPSPV APPLNYHKIVIDLKDCFFTIPLHPEDRPYFAFSVPQINFQSPMPRYQWKV LPQGMANSPTLCQKFVAAAIAPVRSQWPEAYILHYMDDILLACDSAEAAK ACYAHIISCLTSYGLKIAPDKVQVSEPFSYLGFELHHQQVFTPRVCLKTD HLKTLNDFQKLLGDIQWLRPYLKLPTSALVPLNNILKPDPNPLSVRALTP EAKQSLALINKAIQNSVQQISYNLPLVLLLLPTPHTPTAVFWQPNGTDP TKNGSPLLWLHLPASPSKVLLTYPSLLAMLIIKGRYTGRQLFGRDPHSII IPYTQDQLTWLLQTSDEWAIALSSFTGDIDNHYPSDPVIQFAKLHQFIFP KITKCAPIPQATLVFTDGSSNGIAAYVIDNQPISIKSPYLSAQLVELYAI LQVFTVLAHQPFNLYTDSAYIAQSVPLLETVPFIKSSTNATPLFSKLQQL ILNRQHPFFIGHLRAHLNLPGPLAEGNALADAATQIFPIISD |
| SRV1_ P04025 | SRV1 | P04025 | root | 3249 | LTAAIDMLAPQQCAEPITWKSDEPVWVDQWPLTSEKLAAAQQLVQEQLEA GHITESNSPWNTPIFVIKKKSGKWRLLQDLRAVNATMVLMGALQPGLPSP VAIPQGYLKIIIDLKDCFFSIPLHPSDQKRFAFSLPSTNFKEPMQRFQWK VLPQRMANSPTLCQKYVATAIHKVRHAWKQMYIIHYMDDILIAGKDGQQV LQCFDQLKQELTIAGLHIAPEKIQLQDPYTYLGFELNGPKITNQKAVIRK DKLQTLNDFQKLLGDINWLRPYLKLTTADLKPLFDTLKGDSNPNSHRSLS KEALALLDKVETAIAEQFVTHINYSLPLMFLIFNTALTPTGLFWQNNPIM WVHLPASPKKVLLPYYDAIADLIILGRDHSKKYFGIEPSVIIQPYSKSQI DWLMQNTEMWPIACASYVGILDNHYPPNKLIQFCKLHAFIFPPQIISKTPL NNALLVFTDGSSTGMAAYTLADTTIKFQTNLNSAQLVELQALIAVLSAFP NQPLNIYTDSAYLAHSIPLLETVAQIKHISETAKLFLQCQQLIYNRSIPF YIGHVRAHSGLPGPIAHGNQKADLATKTVASNINT |
| SRV1_ P04025_ 2mutB | SRV1 | P04025 | derivative | 3250 | LTAAIDMLAPQQCAEPITWKSDEPVWVDQWPLTSEKLAAAQQLVQEQLEA GHITESNSPWNTPIFVIKKKSGKWRLLQDLRAVNATMVLMGALQPGLPSP VAPPQGYLKIIIDLKDCFFSIPLHPSDQKRFAFSLPSTNFKEPMQRFQWK VLPQRMANSPTLCQKYVATAIHKVRHAWKQMYIIHYMDDILIAGKDGQQV LQCFDQLKQELTIAGLHIAPEKIQLQDPYTYLGFELNGPKITNQKAVIRK DKLQTLNDFQKLLGDINWLRPYLKLTTADLKPLFDTLKGDSNPNSHRSLS KEALALLDKVETAIAEQFVTHINYSLPLMFLIFNTALTPTGLFWQNNPIM WVHLPASPKKVLLPYYDAIADLIILGRDHSKKYFGIEPSVIIQPYSKSQI DWLMQNTEMWPIACASYVGILDNHYPPNKLIQFCKLHAFIFPPQIISKTPL NNALLVFTDGSSTGMAAYTLADTTIKFQTNLNSAQLVELQALIAVLSAFP NQPLNIYTDSAYLAHSIPLLETVAQIKHISETAKLFLQCQQLIYNRSIPF YIGHVRAHSGLPGPIAHGNQKADLATKTVASNINT |
| SRV2_ P51517 | SRV2 | P51517 | root | 3251 | LATAVDILAPQRYADPITWKSDEPVWVDQWPLTQEKLAAAQQLVQEQLQA GHIIESNSPWNTPIFVIKKKSGKWRLLQDLRAVNATMVLMGALQPGLPSP VAIPQGYFKIVIDLKDCFFTIPLQPVDQKRFAFSLPSTNFKQPMKRYQWK VLPQGMANSPTLCQKYVAAAIEPVRKSWAQMYIIHYMDDILIAGKLGEQV LQCFAQLKQLIAPEKVQLQDPYTYLGFQINGPKITNQKAVIRR DKLQTLNDFQKLLGDINWLRPYLHLTTGDLKPLFDILKGDSNPNSPRSLS EAALASLQKVETAIAEQFVTQIDYTQPLTFLIFNTTLTPTGLFWQNNPVM WVHLPASPKKVLLPYYDAIADLIILGRDNSKKYFGLEPS PWRRPVAYLSKKLDPVAAGWPPCLRMVAAIAVLTKDAGKLTMGQPLVILA PHAVEALVKQPPDRWLSNARMTHYQALLLDTDRVQFGPVVALN |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | LQALIAVLSAFPHRALNVYTDSAYLAHSIPLLETVSHIKHISDTAKFFLQ CQQLIYNRSIPFYLGHIRAHSGLPGPLSQGNHITDLATKVVATTLTT |
| SRV2_P51517_2mutB | SRV2 | P51517 | derivative | 3252 | LATAVDILAPQRYADPITWKSDEPVWVDQWPLTQEKLAAAQQLVQEQLQA GHIIESNSPWNTPIFVIKKKSGKWRLLQDLRAVNATMVLMGALQPGLPSP VAPPQGYFKIVIDLKDCFFTIPLQPVDQKRFAFSLPSTNFKQPMKRYQWK VLPQGMANSPTLCQKYVAAAIEPVRKSWAQMYIIHYMDDILIAGKLGEQV LQCFAQLKQALTTTGLQIAPEKVQLQDPYTYLGFQINGPKITNQKAVIRR DKLQTLNDFQKLLGDINWLRPYLHLTTGDLKPLFDILKGDSNPNSPRSLS EAALASLQKVETAIAEQFVTQIDYTQPLTFLIFNTTLTPTGLFWQNNPVM WVHLPASPKKVLLPYYDAIADLIILGRDNSKKYFGLEPSTIIQPYSKSQI HWLMQNTETWPIACASYAGNIDNHYPPNKLIQFCKLHAVVFPRIISKTPL DNALLVFTDGSSTGIAAYTFEKTTVRFKTSHTSAQLVELQALIAVLSAFP HRALNVYTDSAYLAHSIPLLETVSHIKHISDTAKFFLQCQQLIYNRSIPF YLGHIRAHSGLPGPLSQGNHITDLATKVVATTLTT |
| WDSV_O92815 | WDSV | O92815 | root | 3253 | SCQTKNTLNIDEYLLQFPDQLWASLPTDIGRMLVPPITIKIKDNASLPSI RQYPLPKDKTEGLRPLISSLENQGILIKCHSPCNTPIFPIKKAGRDEYRM IHDLRAINNIVAPLTAVVASPTTVLSNLAPSLHWFTVIDLSNAFFSVPIH KDSQYLFAFTFEGHQYTWTVLPQGFIHSPTLFSQALYQSLHKIKFKISSE ICIYMDDVLIASKDRDTNLKDTAVMLQHLASEGHKVSKKKLQLCQQEVVY LGQLLTPEGRKILPDRKVTVSQFQQPTTIRQIRAFLGLVGYCRHWIPEFS IHSKFLEKQLKKDTAEPFQLDDQQVEAFNKLKHAITTAPVLVVPDPAKPF QLYTSHSEHASIAVLTQKHAGRTRPIAFLSSKFDAIESGLPPCLKACASI HRSLTQADSFILGAPLIIYTTHAICTLLQRDRSQLVTASRFSKWEADLLR PELTFVACSAVSPAHLYMQSCENNIPPHDCVLLTHTISRPRPDLSDLPIP DPDMTLFSDGSYTTGRGGAAVVMHRPVTDDFIIIHQQPGGASAQTAELLA LAAACHLATDKTVNIYTDSRYAYGVVHDFGHLWMHRGFVTSAGTPIKNHK EIEYLLKQIMKPKQVSVIKIEAHTKGVSMEVRGNAAADEAAKNAVFLVQR |
| WDSV_O92815_2mut | WDSV | O92815 | derivative | 3254 | SCQTKNTLNIDEYLLQFPDQLWASLPTDIGRMLVPPITIKIKDNASLPSI RQYPLPKDKTEGLRPLISSLENQGILIKCHSPCNTPIFPIKKAGRDEYRM IHDLRAINNIVAPLTAVVASPTTVLSNLAPSLHWFTVIDLSNAFFSVPIH KDSQYLFAFTFEGHQYTWTVLPQGFIHSPTLFNQALYQSLHKIKFKISSE ICIYMDDVLIASKDRDTNLKDTAVMLQHLASEGHKVSKKKLQLCQQEVVY LGQLLTPEGRKILPDRKVTVSQFQQPTTIRQIRAFLGLVGYCRHWIPEFS IHSKFLEKQLKPDTAEPFQLDDQQVEAFNKLKHAITTAPVLVVPDPAKPF QLYTSHSEHASIAVLTQKHAGRTRPIAFLSSKFDAIESGLPPCLKACASI HRSLTQADSFILGAPLIIYTTHAICTLLQRDRSQLVTASRFSKWEADLLR PELTFVACSAVSPAHLYMQSCENNIPPHDCVLLTHTISRPRPDLSDLPIP DPDMTLFSDGSYTTGRGGAAVVMHRPVTDDFIIIHQQPGGASAQTAELLA LAAACHLATDKTVNIYTDSRYAYGVVHDFGHLWMHRGFVTSAGTPIKNHK EIEYLLKQIMKPKQVSVIKIEAHTKGVSMEVRGNAAADEAAKNAVFLVQR |
| WDSV_O92815_2mutA | WDSV | O92815 | derivative | 3255 | SCQTKNTLNIDEYLLQFPDQLWASLPTDIGRMLVPPITIKIKDNASLPSI RQYPLPKDKTEGLRPLISSLENQGILIKCHSPCNTPIFPIKKAGRDEYRM IHDLRAINNIVAPLTAVVASPTTVLSNLAPSLHWFTVIDLSNAFFSVPIH KDSQYLFAFTFEGHQYTWTVLPQGFIHSPTLFNQALYQSLHKIKFKISSE ICIYMDDVLIASKDRDTNLKDTAVMLQHLASEGHKVSKKKLQLCQQEVVY LGQLLTPEGRKILPDRKVTVSQFQQPTTIRQIRAFLGKVGYCRHFIPEFS IHSKFLEKQLKPDTAEPFQLDDQQVEAFNKLKHAITTAPVLVVPDPAKPF QLYTSHSEHASIAVLTQKHAGRTRPIAFLSSKFDAIESGLPPCLKACASI HRSLTQADSFILGAPLIIYTTHAICTLLQRDRSQLVTASRFSKWEADLLR PELTFVACSAVSPAHLYMQSCENNIPPHDCVLLTHTISRPRPDLSDLPIP DPDMTLFSDGSYTTGRGGAAVVMHRPVTDDFIIIHQQPGGASAQTAELLA LAAACHLATDKTVNIYTDSRYAYGVVHDFGHLWMHRGFVTSAGTPIKNHK EIEYLLKQIMKPKQVSVIKIEAHTKGVSMEVRGNAAADEAAKNAVFLVQR |
| WMSV_P03359 | WMSV | P03359 | root | 3256 | VLNLEEEYRLHEKPVPSSIDPSWLQLFPTVWAERAGMGLANQVPPVVVEL RSGASPVAVRQYPMSKEAREGIRPHIQRFLDLGVLVPCQSPWNTPLLPVK KPGTNDYRPVQDLREINKRVQDIHPTVPNPYNLLSSLPPSHTWYSVLDLK DAFFCLKLHPNSQPLFAFEWRDPEKGNTGQLTWTRLPQGFKNSPTLFDEA LHRDLAPFRALNPQVVLLQYVDDLLVAAPTYRDCKEGTQKLLQELSKLGY RVSAKKAQLCQKEVTYLGYLLKEGKRWLTPARKATVMKIPPPTTPRQVRE FLGTAGFCRLWIPGFASLAAPLYPLTKESIPFIWTEEHQKAFDRIKEALL SAPALALPDLTKPFTLYVDERAGVARGVLTQTLGPWRRPVAYLSKKLDPV ASGWPTCLKAVAAVALLLKDADKLTLGQNVTVIASHSLESIVRQPPDRWM TNARMTHYQSLLLNERVSFAPPAVLNPATLLPVESEATPVHRCSEILAEE TGTRRDLKDQPLPGVPAWYTDGSSFIAEGKRRAGAAIVDGKRTVWASSLP |

TABLE 9-continued

Retroviral reverse transcriptase domains for use in Gene Writer™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | EGTSAQKAELVALTQALRLAEGKDINIYTDSRYAFATAHIHGAIYKQRGL LTSAGKDIKNKEEILALLEAIHLPKRVAIIHCPGHQKGNDPVATGNRRAD EAAKQAALSTRVLAETTKP |
| WMSV_P03359_3mut | WMSV | P03359 | derivative | 3257 | VLNLEEEYRLHEKPVPSSIDPSWLQLFPTVWAERAGMGLANQVPPVVVEL RSGASPVAVRQYPMSKEAREGIRPHIQRFLDLGVLVPCQSPWNTPLLPVK KPGTNDYRPVQDLREINKRVQDIHPTVPNPYNLLSSLPPSHTWYSVLDLK DAFFCLKLHPNSQPLFAFEWRDPEKGNTGQLTWTRLPQGFKNSPTLFNEA LHRDLAPFRALNPQVVLLQYVDDLLVAAPTYRDCKEGTQKLLQELSKLGY RVSAKKAQLCQKEVTYLGYLLKEGKRWLTPARKATVMKIPPPTTPRQVRE FLGTAGFCRLWIPGFASLAAPLYPLTKPSIPFIWTEEHQKAFDRIKEALL SAPALALPDLTKPFTLYVDERAGVARGVLTQTLGPWRRPVAYLSKKLDPV ASGWPTCLKAVAAVALLLKDADKLTLGQNVTVIASHSLESIVRQPPDRWM TNARMTHYQSLLLNERVSFAPPAVLNPATLLPVESEATPVHRCSEILAEE TGTRRDLKDQPLPGVPAWYTDGSSFIAEGKRRAGAAIVDGKRTVWASSLP EGTSAQKAELVALTQALRLAEGKDINIYTDSRYAFATAHIHGAIYKQRGW LTSAGKDIKNKEEILALLEAIHLPKRVAIIHCPGHQKGNDPVATGNRRAD EAAKQAALSTRVLAETTKP |
| WMSV_P03359_3mutA | WMSV | P03359 | derivative | 3258 | VLNLEEEYRLHEKPVPSSIDPSWLQLFPTVWAERAGMGLANQVPPVVVEL RSGASPVAVRQYPMSKEAREGIRPHIQRFLDLGVLVPCQSPWNTPLLPVK KPGTNDYRPVQDLREINKRVQDIHPTVPNPYNLLSSLPPSHTWYSVLDLK DAFFCLKLHPNSQPLFAFEWRDPEKGNTGQLTWTRLPQGFKNSPTLFNEA LHRDLAPFRALNPQVVLLQYVDDLLVAAPTYRDCKEGTQKLLQELSKLGY RVSAKKAQLCQKEVTYLGYLLKEGKRWLTPARKATVMKIPPPTTPRQVRE FLGKAGFCRLFIPGFASLAAPLYPLTKPSIPFIWTEEHQKAFDRIKEALL SAPALALPDLTKPFTLYVDERAGVARGVLTQTLGPWRRPVAYLSKKLDPV ASGWPTCLKAVAAVALLLKDADKLTLGQNVTVIASHSLESIVRQPPDRWM TNARMTHYQSLLLNERVSFAPPAVLNPATLLPVESEATPVHRCSEILAEE TGTRRDLKDQPLPGVPAWYTDGSSFIAEGKRRAGAAIVDGKRTVWASSLP EGTSAQKAELVALTQALRLAEGKDINIYTDSRYAFATAHIHGAIYKQRGW LTSAGKDIKNKEEILALLEAIHLPKRVAIIHCPGHQKGNDPVATGNRRAD EAAKQAALSTRVLAETTKP |
| XMRV6_A1Z651 | XMRV6 | A1Z651 | root | 3259 | TLNIEDEYRLHETSKEPDVPLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFD EALHRDLADFRIQHPDLILLQYVDDLLLAATSEQDCQRGTRALLQTLGNL GYRASAKKAQICQKQVKYLGYLLKEGQRWLTEARKETVMGQPTPKTPRQL REFLGTAGFCRLWIPGFAEMAAPLYPLTKGTLFNWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVAL NPATLLPLPEKEAPHDCLEILAETHGTRPDLTDQPIPDADYTWYTDGSSF LQEGQRRAGAAVTTETEVIWARALPAGTSAQRAELIALTQALKMAEGKKL NVYTDSRYAFATAHVHGEIYRRRGLLTSEGREIKNKNEILALLKALFLPK RLSIIHCPGHQKGNSAEARGNRMADQAAREAAMKAVLETSTLL |
| XMRV6_A1Z651_3mut | XMRV6 | A1Z651 | derivative | 3260 | TLNIEDEYRLHETSKEPDVPLGSTWLSDFPQAWAETGGMGLAVRQAPLII PLKATSTPVSIKQYPMSQEARLGIKPHIQRLLDQGILVPCQSPWNTPLLP VKKPGTNDYRPVQDLREVNKRVEDIHPTVPNPYNLLSGLPPSHQWYTVLD LKDAFFCLRLHPTSQPLFAFEWRDPEMGISGQLTWTRLPQGFKNSPTLFN EALHRDLADFRIQHPDLILLQYVDDLLLAATSEQDCQRGTRALLQTLGNL GYRASAKKAQICQKQVKYLGYLLKEGQRWLTEARKETVMGQPTPKTPRQL REFLGTAGFCRLWIPGFAEMAAPLYPLTKPGTLFNWGPDQQKAYQEIKQA LLTAPALGLPDLTKPFELFVDEKQGYAKGVLTQKLGPWRRPVAYLSKKLD PVAAGWPPCLRMVAAIAVLTKDAGKLTMGQPLVILAPHAVEALVKQPPDR WLSNARMTHYQAMLLDTDRVQFGPVVALNPATLLPLPEKEAPHDCLEILA ETHGTRPDLTDQPIPDADYTWYTDGSSFLQEGQRRAGAAVTTETEVIWAR ALPAGTSAQRAELIALTQALKMAEGKKLNVYTDSRYAFATAHVHGEIYRR RGWLTSEGREIKNKNEILALLKALFLPKRLSIIHCPGHQKGNSAEARGNR MADQAAREAAMKAVLETSTLL |
| XMRV6_AA1Z651_3mut | XMRV6 | A1Z651 | derivative | 3261 | TLNIEDEYRLHETSKEPDVPLGSTWLSDFPQAWAETGGMGLAVRQAPLIIP LKATSTPVSIKQYPMSQEARLGIKPHIQRLLDQGILVPCQSPWNTPLLPV KKPGTNDYRPVQDLREVNKRVEDIHPTVPNPYNLLSGLPPSHQWYTVLDL KDAFFCLRLHPTSQPLFAFEWRDPEMGISGQLTWTRLPQGFKNSPTLFNE ALHRDLADFRIQHPDLILLQYVDDLLLAATSEQDCQRGTRALLQTLGNLG |

TABLE 9-continued

Retroviral reverse transcriptase domains for use in Gene Writer ™ polypeptides.
In some embodiments, a system or method described herein involves a reverse
transcriptase domain having an amino acid sequence according to a reverse
transcriptase domain of Table 9, or a sequence having at least 70%, 75%,
80%, 85%, 90%, 95%, 96%, 97%, 98%, or 99% identity thereto, or functional
fragment thereof.

| name | virus_name | uniprot_ID | type | SEQ ID NO: | peptide |
|---|---|---|---|---|---|
| | | | | | YRASAKKAQICQKQVKYLGYLLKEGQRWLTEARKETVMGQPTPKTPRQLR EFLGKAGFCRLFIPGFAEMAAPLYPLTKPGTLFNWGPDQQKAYQEIKQAL LTAPALGLPDLTKPFELFVDEKQGYAKGVLTQKLGPWRRPVAYLSKKLDP VAAGWPPCLRMVAAIAVLTKDAGKLTMGQPLVILAPHAVEALVKQPPDRW LSNARMTHYQAMLLDTDRVQFGPVVALNPATLLPLPEKEAPHDCLEILAE THGTRPDLTDQPIPDADYTWYTDGSSFLQEGQRRAGAAVTTETEVIWARA LPAGTSAQRAELIALTQALKMAEGKKLNVYTDSRYAFATAHVHGEIYRRR GWLTSEGREIKNKNEILALLKALFLPKRLSIIHCPGHQKGNSAEARGNRM ADQAAREAAMKAVLETSTLL |

In some embodiments, reverse transcriptase domains are modified, for example by site-specific mutation. In some embodiments, reverse transcriptase domains are engineered to have improved properties, e.g. SuperScript IV (SSIV) reverse transcriptase derived from the MMLV RT. In some embodiments, the reverse transcriptase domain may be engineered to have lower error rates, e.g., as described in WO2001068895, incorporated herein by reference. In some embodiments, the reverse transcriptase domain may be engineered to be more thermostable. In some embodiments, the reverse transcriptase domain may be engineered to be more processive. In some embodiments, the reverse transcriptase domain may be engineered to have tolerance to inhibitors. In some embodiments, the reverse transcriptase domain may be engineered to be faster. In some embodiments, the reverse transcriptase domain may be engineered to better tolerate modified nucleotides in the RNA template. In some embodiments, the reverse transcriptase domain may be engineered to insert modified DNA nucleotides. In some embodiments, the reverse transcriptase domain is engineered to bind a template RNA. In some embodiments, one or more mutations are chosen from D200N, L603W, T330P, D524G, E562Q, D583N, P51L, S67R, E67K, T197A, H204R, E302K, F309N, W313F, L435G, N454K, H594Q, L671P, E69K, or D653N in the RT domain of murine leukemia virus reverse transcriptase or a corresponding mutation at a corresponding position of another RT domain. In some embodiments, one or more mutations are chosen as described in WO2018089860A1, incorporated herein by reference (e.g., a C952S, and/or C956S, and/or C952S, C956S (double mutant), and/or C969S, and/or H970Y, and/or R979Q, and/or R976Q, and/or R1071S, and/or R328A, and/or R329A, and/or Q336A, and/or R328A, R329A, Q336A (triple mutant), and/or G426A, and/or D428A, and/or G426A, D428A (double mutant) mutation, and/or any combination thereof; positions relative to WO2018089860A1 SEQ ID NO: 52), in the RT domain of R2Bm retrotransposase or a corresponding mutation at a corresponding position of another RT domain.

In some embodiments, the RT domain possesses proofreading activity. In some embodiments, the RT domain is evolved from a DNA-dependent DNA polymerase and has gained RNA-dependent DNA polymerase activity. The synthetic evolved proofreading RT known as reverse transcription xenopolymerase (RTX, Genbank: QFN49000.1) was previously generated by taking a DNA-dependent DNA polymerase (KOD, Genbank: ABN15964.1) and selecting for RNA-dependent DNA polymerase activity (Ellefson et al 2016). In some embodiments, the engineered RT may comprise DNA-dependent DNA polymerase signatures as the result of the wild-type enzyme, e.g., IPR006134, PF00136, cd05536.

In some embodiments, the reverse transcription domain only recognizes and reverse transcribes a specific template. In some embodiments, the template comprises of specific sequences. In some embodiments, the template comprises inclusion of a UTR that associates the nucleic acid with the reverse transcriptase domain (e.g. an untranslated region (UTR) from a retrotransposon, e.g. the 3' UTR of an R2 retrotransposon).

The writing domain may also comprise DNA-dependent DNA polymerase activity, e.g., comprise enzymatic activity capable of writing DNA into the genome from a template DNA sequence. In some embodiments, the DNA-dependent DNA polymerase activity is provided by a DNA polymerase domain in the polypeptide. In some embodiments, the DNA-dependent DNA polymerase activity is provided by a reverse transcriptase domain that is also capable of DNA-dependent DNA polymerization, e.g., second strand synthesis.

In some embodiments, a writing domain (e.g., RT domain) comprises an RNA-binding domain, e.g., that specifically binds to an RNA sequence. In some embodiments, a template RNA comprises an RNA sequence that is specifically bound by the RNA-binding domain of the writing domain.

In contrast to other types of reverse transcription machines, e.g., retroviral RTs and LTR retrotransposons, reverse transcription in non-LTR retrotransposons like R2 is performed only on RNA templates containing specific recognition sequences. The R2 retrotransposase requires its template to contain a minimal 3' UTR region in order to initiate TPRT (Luan and Eickbush Mol Cell Biol 15, 3882-91 (1995)). In some embodiments, the GENE WRITER™ polypeptide is derived from a retrotransposase with a required binding motif and the template RNA is designed to contain said binding motif, such that there is specific retrotransposition of only the desired template. In some embodiments, the GENE WRITER™ polypeptide is derived from a retrotransposon selected from Table 4 and the 3' UTR on the RNA template comprises the 3' UTR from the same retrotransposon in Table 4.

Template Nucleic Acid Binding Domain:

The GENE WRITER™ polypeptide typically contains regions capable of associating with the GENE WRITER™ template nucleic acid (e.g., template RNA). In some embodiments, the template nucleic acid binding domain is an RNA binding domain. In some embodiments, the RNA binding domain is a modular domain that can associate with RNA molecules containing specific signatures, e.g., structural motifs, e.g., secondary structures present in the 3' UTR in non-LTR retrotransposons. In other embodiments, the template nucleic acid binding domain (e.g., RNA binding domain) is contained within the reverse transcription domain, e.g., the reverse transcriptase-derived component has a known signature for RNA preference, e.g., secondary structures present in the 3' UTR in non-LTR retrotransposons. In other embodiments, the template nucleic acid binding domain (e.g., RNA binding domain) is contained within the DNA binding domain. For example, in some embodiments, the DNA binding domain is a CRISPR-associated protein that recognizes the structure of a template nucleic acid (e.g., template RNA) comprising a gRNA. In some embodiments, the gRNA is a short synthetic RNA composed of a scaffold sequence that participates in CRISPR-associated protein binding and a user-defined ~20 nucleotide targeting sequence for a genomic target. The structure of a complete gRNA was described by Nishimasu et al. Cell 156, P935-949 (2014). The gRNA (also referred to as sgRNA for single-guide RNA) consists of crRNA- and tracrRNA-derived sequences connected by an artificial tetraloop. The crRNA sequence can be divided into guide (20 nt) and repeat (12 nt) regions, whereas the tracrRNA sequence can be divided into anti-repeat (14 nt) and three tracrRNA stem loops (Nishimasu et al. Cell 156, P935-949 (2014)). In practice, guide RNA sequences are generally designed to have a length of between 17-24 nucleotides (e.g., 19, 20, or 21 nucleotides) and be complementary to a targeted nucleic acid sequence. Custom gRNA generators and algorithms are available commercially for use in the design of effective guide RNAs. In some embodiments, the gRNA comprises two RNA components from the native CRISPR system, e.g. crRNA and tracrRNA. As is well known in the art, the gRNA may also comprise a chimeric, single guide RNA (sgRNA) containing sequence from both a tracrRNA (for binding the nuclease) and at least one crRNA (to guide the nuclease to the sequence targeted for editing/binding). Chemically modified sgRNAs have also been demonstrated to be effective for use with CRISPR-associated proteins; see, for example, Hendel et al. (2015) Nature Biotechnol., 985-991. In some embodiments, a gRNA comprises a nucleic acid sequence that is complementary to a DNA sequence associated with a target gene. In some embodiments, a polypeptide comprises a DNA-binding domain comprising a CRISPR-associated protein that associates with a gRNA that allows the DNA-binding domain to bind a target genomic DNA sequence. In some embodiments, the gRNA is comprised within the template nucleic acid (e.g., template RNA), thus the DNA-binding domain is also the template nucleic acid binding domain. In some embodiments, the polypeptide possesses RNA binding function in multiple domains, e.g., can bind a gRNA structure in a CRISPR-associated DNA binding domain and a 3' UTR structure in a non-LTR retrotransposon derived reverse transcription domain.

Endonuclease Domain:

In some embodiments, a GENE WRITER™ polypeptide possesses the function of DNA target site cleavage via an endonuclease domain. In some embodiments, the endonuclease domain is also a DNA-binding domain. In some embodiments, the endonuclease domain is also a template nucleic acid (e.g., template RNA) binding domain. For example, in some embodiments a polypeptide comprises a CRISPR-associated endonuclease domain that binds a template RNA comprising a gRNA, binds a target DNA sequence (e.g., with complementarity to a portion of the gRNA), and cuts the target DNA sequence. In certain embodiments, the endonuclease/DNA binding domain of an APE-type retrotransposon or the endonuclease domain of an RLE-type retrotransposon can be used or can be modified (e.g., by insertion, deletion, or substitution of one or more residues) in a GENE WRITER™ system described herein. In some embodiments the endonuclease domain or endonuclease/DNA binding domain is altered from its natural sequence to have altered codon usage, e.g. improved for human cells. In some embodiments the endonuclease element is a heterologous endonuclease element, such as Fok1 nuclease, a type-II restriction 1-like endonuclease (RLE-type nuclease), or another RLE-type endonuclease (also known as REL). In some embodiments the heterologous endonuclease activity has nickase activity and does not form double stranded breaks. The amino acid sequence of an endonuclease domain of a GENE WRITER™ system described herein may be at least about 50%, at least about 60%, at least about 70%, at least about 80%, at least about 85%, at least about 90%, at least about 95%, at least about 96%, at least about 97%, at least about 98%, at least about 99% identical to the amino acid sequence of an endonuclease domain of a retrotransposon whose DNA sequence is referenced in Table 2 or Table 4. A person having ordinary skill in the art is capable of identifying endonuclease domains based upon homology to other known endonuclease domains using tools such as Basic Local Alignment Search Tool (BLAST). In certain embodiments, the heterologous endonuclease is Fok1 or a functional fragment thereof. In certain embodiments, the heterologous endonuclease is a Holliday junction resolvase or homolog thereof, such as the Holliday junction resolving enzyme from *Sulfolobus solfataricus*—Ssol Hje (Govindaraju et al., Nucleic Acids Research 44:7, 2016). In certain embodiments, the heterologous endonuclease is the endonuclease of the large fragment of a spliceosomal protein, such as Prp8 (Mahbub et al., Mobile DNA 8:16, 2017). In certain embodiments, the heterologous endonuclease is derived from a CRISPR-associated protein, e.g., Cas9. In certain embodiments, the heterologous endonuclease is engineered to have only ssDNA cleavage activity, e.g., only nickase activity, e.g., be a Cas9 nickase. For example, a GENE WRITER™ polypeptide described herein may comprise a reverse transcriptase domain from an APE- or RLE-type retrotransposon and an endonuclease domain that comprises Fok1 or a functional fragment thereof. In still other embodiments, homologous endonuclease domains are modified, for example by site-specific mutation, to alter DNA endonuclease activity. In still other embodiments, endonuclease domains are modified to remove any latent DNA-sequence specificity.

In some embodiments the endonuclease domain has nickase activity and does not form double stranded breaks. In some embodiments, the endonuclease domain forms single stranded breaks at a higher frequency than double stranded breaks, e.g., at least 90%, 95%, 96%, 97%, 98%, or 99% of the breaks are single stranded breaks, or less than 10%, 5%, 4%, 3%, 2%, or 1% of the breaks are double stranded breaks. In some embodiments, the endonuclease forms substantially no double stranded breaks. In some embodiments, the enonuclease does not form detectable levels of double stranded breaks.

In some embodiments, the endonuclease domain has nickase activity that nicks the target site DNA of the first strand; e.g., in some embodiments, the endonuclease domain cuts the genomic DNA of the target site near to the site of alteration on the strand that will be extended by the writing domain. In some embodiments, the endonuclease domain has nickase activity that nicks the target site DNA of the first strand and does not nick the target site DNA of the second strand. For example, when a polypeptide comprises a CRISPR-associated endonuclease domain having nickase activity and that does not form double stranded breaks, in some embodiments said CRISPR-associated endonuclease domain nicks the target site DNA strand containing the PAM site (e.g., and does not nick the target site DNA strand that does not contain the PAM site). As a further example, when a polypeptide comprises a CRISPR-associated endonuclease domain having nickase activity and that does not form double stranded breaks, in some embodiments said CRISPR-associated endonuclease domain nicks the target site DNA strand not containing the PAM site (e.g., and does not nick the target site DNA strand that contains the PAM site).

In some other embodiments, the endonuclease domain has nickase activity that nicks the target site DNA of the first strand and the second strand. Without wishing to be bound by theory, after a writing domain (e.g., RT domain) of a polypeptide described herein polymerizes (e.g., reverse transcribes) from the heterologous object sequence of a template nucleic acid (e.g., template RNA), the cellular DNA repair machinery must repair the nick on the first DNA strand. The target site DNA now contains two different sequences for the first DNA strand: one corresponding to the original genomic DNA and a second corresponding to that polymerized from the heterologous object sequence. It is thought that the two different sequences equilibrate with one another, first one hybridizing the second strand, then the other, and which the cellular DNA repair apparatus incorporates into its repaired target site is thought to be random. Without wishing to be bound by theory, it is thought that introducing an additional nick to the second strand may bias the cellular DNA repair machinery to adopt the heterologous object sequence-based sequence more frequently than the original genomic sequence. In some embodiments, the additional nick is positioned at least 10, 15, 20, 25, 30, 35, 40, 45, 50, 55, 60, 65, 70, 75, 80, 85, 90, 95, 100, 105, 110, 115, 120, 125, 130, 135, 140, 145, or 150 nucleotides 5' or 3' of the target site modification (e.g., the insertion, deletion, or substitution) or to the nick on the first strand.

Alternatively or additionally, without wishing to be bound by theory, it is thought that an additional nick to the second strand may promote second strand synthesis. In some embodiments, where the GENE WRITER™ has inserted or substituted a portion of the first strand, synthesis of a new sequence corresponding to the insertion/substitution in the second strand is necessary.

In some embodiments, the polypeptide comprises a single domain having endonuclease activity (e.g., a single endonuclease domain) and said domain nicks both the first strand and the second strand. For example, in such an embodiment the endonuclease domain may be a CRISPR-associated endonuclease domain, and the template nucleic acid (e.g., template RNA) comprises a gRNA that directs nicking of the first strand and an additional gRNA that directs nicking of the second strand. In some embodiments, the polypeptide comprises a plurality of domains having endonuclease activity, and a first endonuclease domain nicks the first strand and a second endonuclease domain nicks the second strand (optionally, the first endonuclease domain does not (e.g., cannot) nick the second strand and the second endonuclease domain does not (e.g., cannot) nick the first strand).

In some embodiments, the endonuclease domain is capable of nicking a first strand and a second strand. In some embodiments, the first and second strand nicks occur at the same position in the target site but on opposite strands. In some embodiments, the second strand nick occurs in a staggered location, e.g., upstream or downstream, from the first nick. In some embodiments, the endonuclease domain generates a target site deletion if the second strand nick is upstream of the first strand nick. In some embodiments, the endonuclease domain generates a target site duplication if the second strand nick is downstream of the first strand nick. In some embodiments, the endonuclease domain generates no duplication and/or deletion if the first and second strand nicks occur in the same position of the target site (e.g., as described in Gladyshev and Arkhipova Gene 2009, incorporated by reference herein in its entirety). In some embodiments, the endonuclease domain has altered activity depending on protein conformation or RNA-binding status, e.g., which promotes the nicking of the first or second strand (e.g., as described in Christensen et al. PNAS 2006; incorporated by reference herein in its entirety).

In some embodiments, a GENE WRITER™ polypeptide comprises a modification to an endonuclease domain, e.g., relative to the wild-type polypeptide. In some embodiments, the endonuclease domain comprises an addition, deletion, replacement, or modification to the amino acid sequence of the original endonuclease domain. In some embodiments, the endonuclease domain is modified to include a heterologous functional domain that binds specifically to and/or induces endonuclease cleavage of a target nucleic acid (e.g., DNA) sequence of interest. In some embodiments, the endonuclease domain comprises a zinc finger. In some embodiments, the endonuclease domain comprises a Cas domain (e.g., a Cas9 or a mutant or variant thereof). In embodiments, the endonuclease domain comprising the Cas domain is associated with a guide RNA (gRNA), e.g., as described herein. In some embodiments, the endonuclease domain is modified to include a functional domain that does not target a specific target nucleic acid (e.g., DNA) sequence. In embodiments, the endonuclease domain comprises a Fok1 domain.

In some embodiments, the endonuclease domain comprises a meganuclease, or a functional fragment thereof. In some embodiments, the endonuclease domain comprises a homing endonuclease, or a functional fragment thereof. In some embodiments, the endonuclease domain comprises a meganuclease from the LAGLIDADG (SEQ ID NO: 1577), GIY-YIG, HNH, His-Cys Box, or PD-(D/E) XK families, or a functional fragment or variant thereof, e.g., which possess conserved amino acid motifs, e.g., as indicated in the family names. In some embodiments, the endonuclease domain comprises a meganuclease, or fragment thereof, chosen from, e.g., I-SmaMI (Uniprot F7WD42), I-Scel (Uniprot P03882), I-AniI (Uniprot P03880), I-Dmol (Uniprot P21505), I-CreI (Uniprot P05725), I-TevI (Uniprot P13299), I-OnuI (Uniprot Q4VWW5), or I-BmoI (Uniprot Q9ANR6). In some embodiments, the meganuclease is naturally monomeric, e.g., I-Scel, I-TevI, or dimeric, e.g., I-CreI, in its functional form. For example, the LAGLIDADG (SEQ ID NO: 1577) meganucleases with a single copy of the LAGLIDADG motif (SEQ ID NO: 1577) generally form homodimers, whereas members with two copies of the LAGLIDADG motif (SEQ ID NO: 1577) are generally found as monomers. In some embodiments, a meganuclease that normally forms as a dimer is expressed as a fusion, e.g., the two subunits are expressed as a single ORF and, optionally, connected by a linker, e.g., an I-CreI dimer fusion (Rodriguez-Fornes et al. Gene Therapy 2020; incorporated by reference herein in its entirety). In some embodiments, a meganuclease, or a functional fragment thereof, is altered to favor nickase activity for one strand of a double-stranded DNA molecule, e.g., I-Scel (K1221 and/or K223I) (Niu et al. J Mol Biol 2008), I-AniI (K227M) (McConnell Smith et al. PNAS 2009), I-Dmol (Q42A and/or K120M) (Molina et al. J Biol Chem 2015). In some embodiments, a meganuclease or functional fragment thereof possessing this preference for single-strand cleavage is used as an endonuclease domain, e.g., with nickase activity. In some embodiments, an endonuclease domain comprises a meganuclease, or a functional fragment thereof, which naturally targets or is engineered to target a safe harbor site, e.g., an I-CreI targeting SH6 site (Rodriguez-Fornes et al., supra). In some embodiments, an endonuclease domain comprises a meganuclease, or a functional fragment thereof, with a sequence tolerant catalytic domain, e.g., I-TevI recognizing the minimal motif CNNNG (Kleinstiver et al. PNAS 2012). In some embodiments, a target sequence tolerant catalytic domain is fused to a DNA binding domain, e.g., to direct activity, e.g., by fusing I-TevI to: (i) zinc fingers to create Tev-ZFEs (Kleinstiver et al. PNAS 2012), (ii) other meganucleases to create MegaTevs (Wolfs et al. Nucleic Acids Res 2014), and/or (iii) Cas9 to create TevCas9 (Wolfs et al. PNAS 2016).

In some embodiments, the endonuclease domain comprises a restriction enzyme, e.g., a Type IIS or Type IIP restriction enzyme. In some embodiments, the endonuclease domain comprises a Type IIS restriction enzyme, e.g., FokI, or a fragment or variant thereof. In some embodiments, the endonuclease domain comprises a Type IIP restriction enzyme, e.g., PvuII, or a fragment or variant thereof. In some embodiments, a dimeric restriction enzyme is expressed as a fusion such that it functions as a single chain, e.g., a FokI dimer fusion (Minczuk et al. Nucleic Acids Res 36 (12): 3926-3938 (2008)).

The use of additional endonuclease domains is described, for example, in Guha and EdgeII Int J Mol Sci 18 (22): 2565 (2017), which is incorporated herein by reference in its entirety.

In some embodiments, an endonuclease domain comprises a CRISPR/Cas domain (also referred to herein as a CRISPR-associated protein). In some embodiments, a DNA-binding domain comprises a CRISPR/Cas domain. In some embodiments, a CRISPR/Cas domain comprises a protein involved in the clustered regulatory interspaced short palindromic repeat (CRISPR) system, e.g., a Cas protein, and optionally binds a guide RNA, e.g., single guide RNA (sgRNA).

CRISPR systems are adaptive defense systems originally discovered in bacteria and archaca. CRISPR systems use RNA-guided nucleases termed CRISPR-associated or "Cas" endonucleases (e.g., Cas9 or Cpf1) to cleave foreign DNA. For example, in a typical CRISPR/Cas system, an endonuclease is directed to a target nucleotide sequence (e.g., a site in the genome that is to be sequence-edited) by sequence-specific, non-coding "guide RNAs" that target single- or double-stranded DNA sequences. Three classes (I-III) of CRISPR systems have been identified. The class II CRISPR systems use a single Cas endonuclease (rather than multiple Cas proteins). One class II CRISPR system includes a type II Cas endonuclease such as Cas9, a CRISPR RNA ("crRNA"), and a trans-activating crRNA ("tracrRNA"). The crRNA contains a "guide RNA", typically about 20-nucleotide RNA sequence that corresponds to a target DNA sequence. In the wild-type system, and in some engineered systems, crRNA also contains a region that binds to the tracrRNA to form a partially double-stranded structure which is cleaved by RNase III, resulting in a crRNA/tracrRNA hybrid. A crRNA/tracrRNA hybrid then directs Cas9 endonuclease to recognize and cleave a target DNA sequence. A target DNA sequence is generally adjacent to a "protospacer adjacent motif" ("PAM") that is specific for a given Cas endonuclease; however, PAM sequences appear throughout a given genome. CRISPR endonucleases identified from various prokaryotic species have unique PAM sequence requirements; examples of PAM sequences include 5'-NGG (*Streptococcus pyogenes*), 5'-NNAGAA (*Streptococcus thermophilus* CRISPR1), 5'-NGGNG (*Streptococcus thermophilus* CRISPR3), and 5'-NNNGATT (*Neisseria meningitidis*). Some endonucleases, e.g., Cas9 endonucleases, are associated with G-rich PAM sites, e.g., 5'-NGG, and perform blunt-end cleaving of the target DNA at a location 3 nucleotides upstream from (5' from) the PAM site. Another class II CRISPR system includes the type V endonuclease Cpf1, which is smaller than Cas9; examples include AsCpf1 (from Acidaminococcus sp.) and LbCpf1 (from Lachnospiraceae sp.). Cpf1-associated CRISPR arrays are processed into mature crRNAs without the requirement of a tracrRNA; in other words, a Cpf1 system, in some embodiments, comprises only Cpf1 nuclease and a crRNA to cleave a target DNA sequence. Cpf1 endonucleases, are typically associated with T-rich PAM sites, e.g., 5'-TTN. Cpf1 can also recognize a 5'-CTA PAM motif. Cpf1 typically cleaves a target DNA by introducing an offset or staggered double-strand break with a 4- or 5-nucleotide 5' overhang, for example, cleaving a target DNA with a 5-nucleotide offset or staggered cut located 18 nucleotides downstream from (3' from) from a PAM site on the coding strand and 23 nucleotides downstream from the PAM site on the complimentary strand; the 5-nucleotide overhang that results from such offset cleavage allows more precise genome editing by DNA insertion by homologous recombination than by insertion at blunt-end cleaved DNA. See, e.g., Zetsche et al. (2015) Cell, 163:759-771.

A variety of CRISPR associated (Cas) genes or proteins can be used in the technologies provided by the present disclosure and the choice of Cas protein will depend upon the particular conditions of the method. Specific examples of Cas proteins include class II systems including Cas1, Cas2, Cas3, Cas4, Cas5, Cas6, Cas7, Cas8, Cas9, Cas 10, Cpf1, C2C1, or C2C3. In some embodiments, a Cas protein, e.g., a Cas9 protein, may be from any of a variety of prokaryotic species. In some embodiments a particular Cas protein, e.g., a particular Cas9 protein, is selected to recognize a particular protospacer-adjacent motif (PAM) sequence. In some embodiments, a DNA-binding domain or endonuclease domain includes a sequence targeting polypeptide, such as a Cas protein, e.g., Cas9. In certain embodiments a Cas protein, e.g., a Cas9 protein, may be obtained from a bacteria or archaea or synthesized using known methods. In certain embodiments, a Cas protein may be from a gram positive bacteria or a gram negative bacteria. In certain embodiments, a Cas protein may be from a *Streptococcus* (e.g., a *S. pyogenes*, or a *S. thermophilus*), a *Francisella* (e.g., an *F. novicida*), a *Staphylococcus* (e.g., an *S. aureus*), an Acidaminococcus (e.g., an Acidaminococcus sp. BV3L6), a *Neisseria* (e.g., an *N. meningitidis*), a *Cryptococcus*, a *Corynebacterium*, a *Haemophilus*, a *Eubacterium*, a *Pasteurella*, a *Prevotella*, a *Veillonella*, or a *Marinobacter*.

In some embodiments, a Cas protein requires a protospacer adjacent motif (PAM) to be present in or adjacent to a target DNA sequence for the Cas protein to bind and/or function. In some embodiments, the PAM is or comprises, from 5' to 3', NGG, YG, NNGRRT, NNNRRT, NGA, TYCV, TATV, NTTN, or NNNGATT, where N stands for any nucleotide, Y stands for C or T, R stands for A or G, and V stands for A or C or G. In some embodiments, a Cas protein is a protein listed in Table 10. In some embodiments, a Cas protein comprises one or more mutations altering its PAM. In some embodiments, a Cas protein comprises E1369R, E1449H, and R1556A mutations or analogous substitutions to the amino acids corresponding to said positions. In some embodiments, a Cas protein comprises E782K, N968K, and R1015H mutations or analogous substitutions to the amino acids corresponding to said positions. In some embodiments, a Cas protein comprises D1135V, R1335Q, and T1337R mutations or analogous substitutions to the amino acids corresponding to said positions. In some embodiments, a Cas protein comprises S542R and K607R mutations or analogous substitutions to the amino acids corresponding to said positions. In some embodiments, a Cas protein comprises S542R, K548V, and N552R mutations or analogous substitutions to the amino acids corresponding to said positions.

interfere with (e.g., decrease or prevent) genomic complex (e.g., ASMC) formation and/or maintenance. In some embodiments, a DNA-binding domain comprises a catalytically inactive Cas9, e.g., dCas9. Many catalytically inactive Cas9 proteins are known in the art. In some embodiments, dCas9 comprises mutations in each endonuclease domain of the Cas protein, e.g., D10A and H840A or N863A mutations. In some embodiments, a catalytically inactive or partially inactive CRISPR/Cas domain comprises a Cas protein comprising one or more mutations, e.g., one or more of the mutations listed in Table 10. In some embodiments, a Cas protein described on a given row of Table 10 comprises one, two, three, or all of the mutations listed in the same row of Table 10. In some embodiments, a Cas protein, e.g., not described in Table 10, comprises one, two, three, or all of the mutations listed in a row of Table 10 or a corresponding mutation at a corresponding site in that Cas protein.

In some embodiments, a catalytically inactive, e.g., dCas9, or partially deactivated Cas9 protein comprises a D11 mutation (e.g., D11A mutation) or an analogous substitution to the amino acid corresponding to said position. In some embodiments, a catalytically inactive Cas9 protein, e.g., dCas9, or partially deactivated Cas9 protein comprises a H969 mutation (e.g., H969A mutation) or an analogous substitution to the amino acid corresponding to said posi-

TABLE 10

CRISPR/Cas Proteins, Species, and Mutations

| Name | Enzyme | Species | # of AAs | PAM | Mutations to alter PAM recognition | Mutations to make catalytically dead |
|---|---|---|---|---|---|---|
| FnCas9 | Cas9 | Francisella novicida | 1629 | 5'-NGG-3' | Wt | D11A/H969A/N995A |
| FnCas9 RHA | Cas9 | Francisella novicida | 1629 | 5'-YG-3' | E1369R/E1449H/ R1556A | D11A/H969A/N995A |
| SaCas9 | Cas9 | Staphylococcus aureus | 1053 | 5'-NNGRRT-3' | Wt | D10A/H557A |
| SaCas9 KKH | Cas9 | Staphylococcus aureus | 1053 | 5'-NNNRRT-3' | E782K/N968K/ R1015H | D10A/H557A |
| SpCas9 | Cas9 | Streptococcus pyogenes | 1368 | 5'-NGG-3' | Wt | D10A/D839A/H840A/ N863A |
| SpCas9 VQR | Cas9 | Streptococcus pyogenes | 1368 | 5'-NGA-3' | D1135V/R1335Q/ T1337R | D10A/D839A/H840A/ N863A |
| AsCpf1 RR | Cpf1 | Acidaminococcus sp. BV3L6 | 1307 | 5'-TYCV-3' | S542R/K607R | E993A |
| AsCpf1 RVR | Cpf1 | Acidaminococcus sp. BV3L6 | 1307 | 5'-TATV-3' | S542R/K548V/ N552R | E993A |
| FnCpf1 | Cpf1 | Francisella novicida | 1300 | 5'-NTTN-3' | Wt | D917A/E1006A/ D1255A |
| NmCas9 | Cas9 | Neisseria meningitidis | 1082 | 5'-NNNGATT-3' | Wt | D16A/D587A/H588A/ N611A |

In some embodiments, the Cas protein is catalytically active and cuts one or both strands of the target DNA site. In some embodiments, cutting the target DNA site is followed by formation of an alteration, e.g., an insertion or deletion, e.g., by the cellular repair machinery.

In some embodiments, the Cas protein is modified to deactivate or partially deactivate the nuclease, e.g., nuclease-deficient Cas9. Whereas wild-type Cas9 generates double-strand breaks (DSBs) at specific DNA sequences targeted by a gRNA, a number of CRISPR endonucleases having modified functionalities are available, for example: a "nickase" version of Cas9 that has been partially deactivated generates only a single-strand break; a catalytically inactive Cas9 ("dCas9") does not cut target DNA. In some embodiments, dCas9 binding to a DNA sequence may interfere with transcription at that site by steric hindrance. In some embodiments, dCas9 binding to an anchor sequence may tion. In some embodiments, a catalytically inactive Cas9 protein, e.g., dCas9, or partially deactivated Cas9 protein comprises a N995 mutation (e.g., N995A mutation) or an analogous substitution to the amino acid corresponding to said position. In some embodiments, a catalytically inactive Cas9 protein, e.g., dCas9, comprises mutations at one, two, or three of positions D11, H969, and N995 (e.g., D11A, H969A, and N995A mutations) or analogous substitutions to the amino acids corresponding to said positions.

In some embodiments, a catalytically inactive Cas9 protein, e.g., dCas9, or partially deactivated Cas9 protein comprises a D10 mutation (e.g., a D10A mutation) or an analogous substitution to the amino acid corresponding to said position. In some embodiments, a catalytically inactive Cas9 protein, e.g., dCas9, or partially deactivated Cas9 protein comprises a H557 mutation (e.g., a H557A mutation) or an analogous substitution to the amino acid corresponding to said position. In some embodiments, a catalytically inactive Cas9 protein, e.g., dCas9, comprises a D10 mutation (e.g., a D10A mutation) and a H557 mutation (e.g., a H557A mutation) or analogous substitutions to the amino acids corresponding to said positions.

In some embodiments, a catalytically inactive Cas9 protein, e.g., dCas9, or partially deactivated Cas9 protein comprises a D839 mutation (e.g., a D839A mutation) or an analogous substitution to the amino acid corresponding to said position. In some embodiments, a catalytically inactive Cas9 protein, e.g., dCas9, or partially deactivated Cas9 protein comprises a H840 mutation (e.g., a H840A mutation) or an analogous substitution to the amino acid corresponding to said position. In some embodiments, a catalytically inactive Cas9 protein, e.g., dCas9, or partially deactivated Cas9 protein comprises a N863 mutation (e.g., a N863A mutation) or an analogous substitution to the amino acid corresponding to said position. In some embodiments, a catalytically inactive Cas9 protein, e.g., dCas9, comprises a D10 mutation (e.g., D10A), a D839 mutation (e.g., D839A), a H840 mutation (e.g., H840A), and a N863 mutation (e.g., N863A) or analogous substitutions to the amino acids corresponding to said positions.

In some embodiments, a catalytically inactive Cas9 protein, e.g., dCas9, or partially deactivated Cas9 protein comprises a E993 mutation (e.g., a E993A mutation) or an analogous substitution to the amino acid corresponding to said position.

In some embodiments, a catalytically inactive Cas9 protein, e.g., dCas9, or partially deactivated Cas9 protein comprises a a D917 mutation (e.g., a D917A mutation) or an analogous substitution to the amino acid corresponding to said position. In some embodiments, a catalytically inactive Cas9 protein, e.g., dCas9, or partially deactivated Cas9 protein comprises a a E1006 mutation (e.g., a E1006A mutation) or an analogous substitution to the amino acid corresponding to said position. In some embodiments, a catalytically inactive Cas9 protein, e.g., dCas9, or partially deactivated Cas9 protein comprises a D1255 mutation (e.g., a D1255A mutation) or an analogous substitution to the amino acid corresponding to said position. In some embodiments, a catalytically inactive Cas9 protein, e.g., dCas9, comprises a D917 mutation (e.g., D917A), a E1006 mutation (e.g., E1006A), and a D1255 mutation (e.g., D1255A) or analogous substitutions to the amino acids corresponding to said positions.

In some embodiments, a catalytically inactive Cas9 protein, e.g., dCas9, or partially deactivated Cas9 protein comprises a a D16 mutation (e.g., a D16A mutation) or an analogous substitution to the amino acid corresponding to said position. In some embodiments, a catalytically inactive Cas9 protein, e.g., dCas9, or partially deactivated Cas9 protein comprises a D587 mutation (e.g., a D587A mutation) or an analogous substitution to the amino acid corresponding to said position. In some embodiments, a catalytically inactive Cas9 protein, e.g., dCas9, or partially deactivated Cas9 protein comprises a H588 mutation (e.g., a H588A mutation) or an analogous substitution to the amino acid corresponding to said position. In some embodiments, a catalytically inactive Cas9 protein, e.g., dCas9, or partially deactivated Cas9 protein comprises a N611 mutation (e.g., a N611A mutation) or an analogous substitution to the amino acid corresponding to said position. In some embodiments, a catalytically inactive Cas9 protein, e.g., dCas9, comprises a D16 mutation (e.g., D16A), a D587 mutation (e.g., D587A), a H588 mutation (e.g., H588A), and a N611 mutation (e.g., N611A) or analogous substitutions to the amino acids corresponding to said positions.

In some embodiments, a DNA-binding domain or endonuclease domain may comprise a Cas molecule comprising or linked (e.g., covalently) to a gRNA (e.g., a template nucleic acid, e.g., template RNA, comprising a gRNA).

In some embodiments, an endonuclease domain or DNA binding domain comprises a *Streptococcus pyogenes* Cas9 (SpCas9) or a functional fragment or variant thereof. In some embodiments, the endonuclease domain or DNA binding domain comprises a modified SpCas9. In embodiments, the modified SpCas9 comprises a modification that alters protospacer-adjacent motif (PAM) specificity. In embodiments, the PAM has specificity for the nucleic acid sequence 5'-NGT-3'. In embodiments, the modified SpCas9 comprises one or more amino acid substitutions, e.g., at one or more of positions L1111, D1135, G1218, E1219, A1322, of R1335, e.g., selected from L1111R, D1135V, G1218R, E1219F, A1322R, R1335V. In embodiments, the modified SpCas9 comprises the amino acid substitution T1337R and one or more additional amino acid substitutions, e.g., selected from L1111, D1135L, S1136R, G1218S, E1219V, D1332A, D1332S, D1332T, D1332V, D1332L, D1332K, D1332R, R1335Q, T1337, T1337L, T1337Q, T1337I, T1337V, T1337F, T1337S, T1337N, T1337K, T1337H, T1337Q, and T1337M, or corresponding amino acid substitutions thereto. In embodiments, the modified SpCas9 comprises: (i) one or more amino acid substitutions selected from D1135L, S1136R, G1218S, E1219V, A1322R, R1335Q, and T1337; and (ii) one or more amino acid substitutions selected from L1111R, G1218R, E1219F, D1332A, D1332S, D1332T, D1332V, D1332L, D1332K, D1332R, T1337L, T1337I, T1337V, T1337F, T1337S, T1337N, T1337K, T1337R, T1337H, T1337Q, and T1337M, or corresponding amino acid substitutions thereto.

In some embodiments, a GENE WRITER™ may comprise a Cas protein as listed in Table 11. The predicted or validated nickase mutations for installing Nickase activity in the Cas protein as shown in Table 11, are based on the signature of the SpCas9 (N863A) mutation. In some embodiments, system described herein comprises a GeneWriter protein of Table 4 and a Cas protein of Table 11. In some embodiments, a protein or domain of Table 4, 8, or 9 is fused to a Cas protein of Table 11.

TABLE 11

CRISPR/Cas Proteins, Species, and Mutations

| Variant | Parental Host | SEQ ID NO: | Protein Sequence | Nickase Mutation |
|---|---|---|---|---|
| Nme2Cas9 | Neisseria meningitidis | 3262 | MAAFKPNPINYILGLDIGIASVGWAMVEIDEEENPIRLIDLGVRVFERAEVPKTGDSLAMARRLAR SVRRLTRRAHRLLRARRLLKREGVLQAADFDENGLIKSLPNTPWQLRAAALDRKLTPLEWSAVL LHLIKHRGYLSQRKNEGETADKELGALLKGVANNAHALQTGDFRTPAELALNKFEKESGHIRNQR GDYSHTFSRKDLQAELILLFEKGFGNPHVSGGLKEGIETLLMTQRPALSGDAVQKMLGHCTFE PAEPKAAKNTYTAERFIWLTKLNNLRILEQGSERPLTDTERATLMDEPYRKSKLITYAQARKLLGL EDTAFFKGLRLYGKDNAEASTLMEMKAYHAISRALEKEGLKDKKSPLNLSSELQDEIGTAPSLFKT DEDITGRLKDRVQPEILEALLKHISFDKFVQISLKALRRIVPLMEQGKRYDEACAEIYGDHYGKKN TEEKIYLPPIPADEIRNPVVLRLSQARKVINGVVRRYGSPARIHIETAREVGKSFKDRKEIEKRQEE NRKDREKAAAKFREYFPNFVGEPKSDIILKLRLYEQQHGKCLYSGKEINLVRLNEKGVEIDHAL PFSRTWDDSFNNKVLVLGSENQNKGNQTPYEYFNGKDNSREWQEFKARVETSRFPRSKKQRILLQ KFDEDGFKECNLNDTRYVNRFLCQFVADHILTGKGKRRVFASNGQITNLLRGFWGLRKVRAEN DRHHALDAVVVACSTVAMQQKITRFVRYKEMNAFDGKTIDKETGKVLHQKTHFPQPWEFFAQE VMIRVFGKPDGKPEFEEADTPEKLRTLLAEKLSSRPEAVHEYVTPLFVSRAPNRKMSGAHKDTLRS AKRFVKHNEKISVKRVWLTEIKLADLENMVNYKNGREIELYEPALKARLEAYGGNAKQAFDPKDN PFYKKGGQLVKAVRVEKTQESGVLLNKKNAYTIADNGMVRVDMVRVDVFCKVDKKGKNQYFIVPIYA WQVAENILPDIDCKGYRIDDSYTFCFSLHKYDLIAFQKDEKSKVEFAYYINCDSSNGRFYLAWHD KGSKEQQFRISTQNLVLIQKYVNELGKEIRPCRLKKRPPVR | N611A |
| PpnCas9 | Pasteurella pneumotropica | 3263 | MQNNPLNYILGLDLGIASIGWAVVEIDESSPIRLIDVGVRTPERAEVAKTGESLALSRRLARSSRR LIKRRAEBRLKKAKRLLKAEKILHSIDEKLPINVWQLRVKGLKEKLERQEWAAVLLHLSKHRGYLS QRCNEGKSDNKELGALLSGIASNHQMLQSSEYRTPAEIAVKKFQVEEGHIRNQRGSYTHTFSRLDL LAEMELLFORQAELGNSYTSTTLLENLTALLMWQKPALAGDAILKMLGKCTFEPSEYKAAKNSY SAERFVWLTKLNNLRILENGTERALNDNERFALLEQPYEKSKLTYAQVRAMLALSDNAIFKGVRY LGEDKKTVESKTTLIEMKFYHQIRKTLGSAELKKEWNELKGNSDLLDEIGTAPSLYKTDDDICRYL EGKLPERVLNALLENLNPDKFIQLSLKALHQIPLMLQGQRYDEAVSAIYGDHYGKKSTETTRLLP TIPADEIRNPVVLRTLTQARKVINAVVRLYGSPARIHIETAREVGKSYQDRKKLEKQQEDNRKQRE SAVKKFKEMPFPHFVGEPKGKDILKMRLYELQQAKCLYSGKSLELHRLLEKGVVEVDHALPFSRT WDDSFNNKVLVLANENQNKGNLTPYEWLDGKNNSERWQHFVVRVQTSGFSYAKKQRILNHKLD EKGFIERNLNDTRYVARFLCNFIADNMLLVGKGKRNVFASNGQITALLRHRWGLQKVREQNDRH HALDAVVVACSTVAMQQKITRFVRYNEGNVFSGERIDRETGEIIPLHFPSPWAFFKENVEIRFSEN PKLELENRLPDYPQYNHEWVQPLFVSRMPTRKMTGQGHMETVKSAKRLNEGLSVLKVPLTQLKL SDLERMVNRDREIALYESKGIKARLEQFGNDPAKAFAEPPYKKGGALVKAVRLEQTQKSGVLVRDG NGVADNASMVRVDVFTKGGKYFLVPIYTWQVAKGILPNRAATQGKDENDWDIMDEMATFQFSL CQNDLIAISVTKKKTIFGYFNGLNRATSNINIKEHDLDKSKGKLGIYLEVGVKLAISLEKYQVDELG KNIRPCRPTKRQHVR | N605A |
| SauCas9 | Staphylococcus aureus | 3264 | MKRNYILGLDIGITSVGYGIIDYETRDVIDAGVRLFKEANVENNEGRRSKRGARRLKRRRHRIQR VKKLLFDYNLLTDHSELSGINPYEARVKGLSQKLSEEEFSAALLHLAKRRGVHNVNEVEEDTGNE LSTKEQISRNSKALEEKYVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVKYAYNADLYNALN VYHDIKDITARKEIIENAELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELAREKNSKDAQKMINEMQKRNPQTNERIEEIIRTTGKENAKYLIEKIKLHDMQEGK CLYSLEAIPLEDLLNNPFNYEVDHIIPRSVSFDNSFNNKVLVKQEENSKKGNRTPFQYLSSSDSKISY ETFKKHILNLAKGKGRISKTKKEYLLEERDINRFSVQKDFINRNLVDTRYATRGLMNLLRSYFRVN | N580A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | NLDVKVKSINGGFTSFLRRKWKFKKERNKGYKHHAEDALIIANADFIPKEWKKLDKAKKVMENQ MFEEKQAESMPEIETEQEYKEIFITPHQIKHIKDFKDYKYSHRVDKKPNRELLINDTLYSTRKDDKGN TLIVNNLNGLYDKDNDKLKKLINKSPEKLLMYHHDPQTYQKLKLIMEQYGDEKNPLYKYYEETG NYLTKYSKKDNGPVIKKIKYYGNKLNAHLDITDDYPNSRNKVVKLSLKPYRFDVYLDNGVYKFV TVKNLDVIKKENYYEVNSKCYEEAKKLKKISNQAEFIASFYNNDLIKINGELYRVIGVNNDLLNRI EVNMIDITYREYLENMNDKRPPRIIKTIASKTQSIKKYSTDILGNLYEVKSKKHPQIIKKG | |
| SauCas9-KKH | Staphylococcus aureus | 3265 | MKRNYILGLDIGITSVGYGIIDYETRDVIDAGVRLFKEANVENNEGRSKRGARRLKRRRHRIQR VKKLLFDYNLLTDHSELSGINPYEARVKGLSQKLSEEEFSAALLHLAKRRGVHNVNEVEEDTGNE LSTKEQISRNSKALEEKVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVIYAYNADLYNALN VYHDIKDITARKEIIENAELLDGIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELAREKNSKDAQKMINEMQKRNPQTNERIEEIIRTTGKENAKYLIEKILHDMQEGK CLYSLEAIPLEDLLNNPFNYEVDHIIPRSVSPDNSFNNKVLVKQEENSKKGNRTPFQYLSSSDSKISY ETPKKHILNLAKGKGRISKTKKEYLLEERDINRFSVQKDFINRNLVDTRYATRGLMNILLRSYPRVN NLDVKVKSINGGFTSFLRRKWKFKKERNKGYKHHAEDALIIANADFIPKEWKLDKAKKVMENQ MFEEKQAESMPEIETEQEYKEIFITPHQIKHIKDFKDYKYSHRVDKKPNRKLINDTLYSTRKDDKG NTLIVNNLNGLYDKDNDKLKKLINKSPEKLLMYHHDPQTYQKLKLIMEQYGDEKNPLYKYYPET GNYLTKYSKKDNGPVIKKIKYYGNKLNAHLDITDDYPNSRNKVVKLSLKPYRFDVYLDNGVYKF VTVKNLDVIKKENYYEVNSKCYEEAKKLKKISNQAEFIASFYKNDLIKINGELYRVIGVNNDLLNR IEVNMIDITYREYLENMNDKRPPHIIKTIASKTQSIKKYSTDILGNLYEVKSKKHPQIIKKG | N580A |
| SauriCas9 | Staphylococcus auricularis | 3266 | MQENQQKQNYILGLDIGITSVGYGLIDSKTREVIDAGVRLFPEADSENNSNRRSKRGARRLKRRRI HRLNRVKDLLADYQMIDLNNVPKSTDPYTIRVKGLREPLTKEEFAIALLHIAKRRGLHNISVSMGD EEQDNELSTKQQLQKNAQQLQDKYVCELQLERLTNINKVRGEKNRFKTEDFVKEVKQLCETORQ YHNIDDQFIQQYIDLVSTRREYFEGPGNGSPYGWDGDLLKWYEKLMGRCTYFPEELRSVKYAYS ADLFNALNDLNNLVVTRDDNPKLEYYEKYHIIENVFKQKKNPTLKQIAKEIGVQDYDIRGYRITKS GKPQFTSFKLYHDLKNIFEQAKYLEDVEMLDEIAKILTIYQDEISIKKALDQLPELLTESEKSQIAQL TGYTGTHRLSLKCIHIVIDELWESPENQMEIFTRLNLKPKKVEMSEIDSIPTTLVDEFILSPVVKRAFI KIKLHDMQEGKCLYSLEAIPLEDLLSNPTHYEVDHIIPRSVSPDNSLNNKVLVKQSENSKKGNRTP YQYLSSNESKISYNQFKQHILNLSKAKDRISKKKRDMLLEERDINKFEVQKEFINRNLVDTRYATR ELSNLLKTYFSTHDYAVKVKTINGGFTNHLRKVWDFKKKHRNHGYKHHAEDALVIANADFLFKTH KALRRTDKILEQPGLEVNDTTVKDTYVKDIKYAKDNEKVKKLFTERPQKILMYQHDPKTFEKLMTILNQYAEAK NPLAAYYEDKGEYVTKYAKKGNGPAIHKIKYIDKKLGSYLDVSNKYPETQNKLVKLSLKSFRFDI YKCEQGYKMVSIGYLDVLKKDNYYYIPKDKYEAEKQKKKKIKESDLFVGSFYYNDLIMYEDELFR VIGVNSDINNLVELNMVDITYKDFCEVNNVTGEKRIKKTIGKRVVLIEKYTTDILGKYKTPLPKKP QLIFKRGEL | N588A |
| SauriCas9-KKH | Staphylococcus auricularis | 3267 | MQENQQKQNYILGLDIGITSVGYGLIDSKTREVIDAGVRLFPEADSENNSNRRSKRGARRLKRRRI HRLNRVKDLLADYQMIDLNNVPKSTDPYTIRVKGLREPLTKEEFAIALLHIAKRRGLHNISVSMGD EEQDNELSTKQQLQKNAQQLQDKYVCELQLERLTNINKVRGEKNRFKTEDFVKEVKQLCETORQ YHNIDDQFIQQYIDLVSTRREYFEGPGNGSPYGWDGDLLKWYEKLMGRCTYFPEELRSVKYAYS ADLFNALNDLNNLVVTRDDNPKLEYYEKYHIIENVFKQKKNPTLKQIAKEIGVQDYDIRGYRITKS GKPQFTSFKLYHDLKNIFEQAKYLEDVEMLDEIAKILTIYQDEISIKKALDQLPELLTESEKSQIAQL TGYTGTHRLSLKCIHIVLSKCIHIVIDELMESPENQMEIFTRLNLKPKKVEMSEIDSIPTTLVDEFILSPVVKRAFI | N588A |

TABLE 11-continued

CRISPR/Cas Proteins, Species, and Mutations

| Variant | Parental Host | SEQ ID NO: | Protein Sequence | Nickase Mutation |
|---|---|---|---|---|
| ScaCas9-SC++ | Streptococcus canis | 3268 | MEKKYSIGLDIGTNSVGWAVITDDYKVPSKKFKVLGNTNRKSIKKNLMGALLFDSGETAEATRLK RTARRRYTRRKNRIRYLQEIFANEMAKLDDSFFQRLEESFLVEEDKKNERHPIFGNLADEVAYHRN YPTIYHLRKKLADSPEKADLRLIYLALAHIIKFRGHFLIEGKLNAENSDVAKLFYQLIQTYNQLFEE SPLDEIEVDAKGILSARLSKSRLEKLIAVFPNEKKNGLFGNIIALALGLTPNFKSNFDLTEDAKLQL SKDTYDDDLDELLGQIGDQYADLFSAAKNLSDAILLSDILRSNSEVTKAPLSASMVKRYDEHHQD LALLKTLVRQQFPEKYAEIFKDDTKNGYAGYVGADKKLKRSGKLATEEEFYKFIKPILEKMDGA EELLAKLNRDDLLRKQRTFDNGSIPHQIHLKELHAILRRQEEFYPFLKENREKIELTFRIPYYVGP LARGNSRPAWLTRKSEEAITPWNFEEVDKGASAQSFIERMTNFDEQLPNKKVLPKHSLLYEFFT VYNELTKVKYVTERMRKPEFLSGEQKKAIVDLLFKTNRKVTVKQLKEDYFKKIECFDSVEIIGVED RFNASLGTYHDLLKIIKDKDFLDNEENEDILEDIVLTLTLFEDREMIEERLKTYAHLFDDKVMKQL KRRHYTGWGRLSRKMINGIRDKQSGKTILDFLKSDGFSNRNFMQLIHDDSLTFKEEIEKAQVSGQG DSLHEQIADLAGSPAIKKGILQTVKIVDELVKVMGHKPENIVIEMARENQTTTKGLQQSRERKKRI EEGIKELESQILKENPVENTQLQNEKLYLYYLQNGRDMYVDQELDINRLSDYDVDHIVPQSFIKDD SIDNKVLTRSVENRGKSDNVPSEEVVKKMKNYWRQLLNAKLITQRKFDNLTKAERGGLSEADKA GFIKRQLVETRQITKHVARILDSRMNTKRDKNDKPIREVKVITLKSKLVSDFRKDFQLYKVRDINN YHHAHDAYINAVVGTALIKKYPKLESEFVYGDYKVYDVRKMIAKSEQEIGKATAKRFFYSNIMN FFKTEVKLANGEIRKRPLIETNGETGEVVWNKEKDFATVRKVLAMPQVNIVKKTEVQTGGFSKES ILSKRESAKLIPRKKGWDTRKYGGFGSPTVAYSILVVAKVEKGKAKKLKSVLVGITIMEKGSY EKDPIGFLEAKGYKDIKELIFKLPKYSLFELENGRRRMLASAKELQKANELVLPQHLVRLLYYTQ NISATTGSNNLGYIEQHREEFKEIFEKIIDFSEKYILNKVNSNLKSSFDEQPAVSDSILLSNSFVSLL KYTSFGASGGFTFLDLDVKQGRLRYQTVTEVLDATLIYQSITGLYETRTDLSQLGGD | N872A |
| SpyCas9 | Streptococcus pyogenes | 3269 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEEDYPFLKDNREKIEKILTFRIPYYVGPLARGNSRFAW MTRKSEETITPWNFEEVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL | N863A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVMDKGRDFATVRKVLSMPQVNIVKKTEVQTGGFSKESILPKKNSDK LIARKKDWDPKKYGGFDSPTVAYSVLVVAKVEKGKSKKLIKSVKELLGITIMERSSFEKNPIDFLEA KGYKEVKKDLIIIKLPKYSLFELENGRKRMLASAGELQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKRYTSTKEVLDATLIHQSITGLYETRIDLSQLGGD | |
| SpyCas9-NG | Streptococcus pyogenes | 3270 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVDKGRDFATVRKVLSMPQVNIVKKTEVQTGGFSKESIRPKKNSDK LIARKKDWDPKKYGGFSPTVAYSVLVVAKVEKGKSKKLIKSVKELLGITIMERSSFEKNPIDFLEA KGYKEVKKDLIIKLPKYSLFELENGRKRMLASARFLQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPRAPKYFDTTIDRKVYRSTKEVLDATLIHQSITGLYETRIDLSQLGGD | N863A |
| SpyCas9-SpRY | Streptococcus pyogenes | 3271 | MDKKYSIGLDIGTNSVGWAVITDEYKVPSKKFKVLGNTDRHSIKKNLIGALLFDSGETAERTRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVYNELTKVKY VTEGMRKPAFLSGEQKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVMDKGRDFATVRKVLSMPQVNIVKKTEVQTGGFSKESIRPKKNSDK | N863A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | LIARKKDWDPKKYGGFLWPTVAYSVLVVAKVEKGKSKKLKSVKELLGITIMERSSFEKNPIDFLE AKGYKEVKKDLIIKLPKYSLFELENGRKRMLASAKQLQKGNELALPSKYVNFLYLASHYEKLKGS PEDNEQKQLFVEQHKHYLDEIIEQISEFSKRVILADANLDKVLSAYNKHRDKPIREQAENIIHLFTLT RLGAPRAPKYFDTTIDPKQYRSTKEVLDATLIHQSITGLYETRIDLSQLGGD | |
| St1Cas9 | Streptococcus thermophilus | 3272 | MSDLVLGLDIGIGSVGVGILNKVTGEIIHKNSRIFPAAQAENNLVRRTNRQGRRLARRKKHRVRL NRLFEESCGLITDFTKISINLNPYQLRVKGLTDELSNEELFIALKNMVKHRGISYLDDASDDGNSSVG DYAQIVKENSKQLETKTPGQIQLERYQTYGQLRGDFTVEKDGKKHRLINVFPTSAYRSEALRILQT QQEFNPQITDEFINRYLEILTGKRKYYHGPGNEKSRTDYGRYRTSGETLDNIFGILIGKCTFYPDEFR AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEQMTILTRLGKQKTTSSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLWHQQGERCLYTGKTISIHDLINNSNQF EVDHILPLSITFDDSLANKVLVYATANQEKGQRTPYQALDSMDDAWSFRELKAFVRESKTLSNKK KEYILLTEEDISKFDVRKKFIERNLVDTRYASRVVLNALQEHFRAHKIDTKVSVVRGQFTSQLRRH WGIEKTRDTYHHHAVDALIIAASSQLNLWKKQKNTLVSYSEDQLLDIETGELISDDEYKESVFKAP YQHFVDTLKSKEFDSILFSYQVDSKFNRKISDATIYATROAKVGKDKADETVLGKIDIYTQDG YDAFMKIYKKDKSKFLMYRHDPQTFEKVIEPILENYPNKQINEKGKEVPCNPPLKYKEEHGYIRKY SKKGNGPEIKSLKYDSKLGNHIDITPKDSNNKVVLQSVSPWRADVYFNKTGKYEIGLKYADL QFEKGTGTYKILSQEKYNDIKKKEGVDSDSEFFKPTLYKNDLLLVKDTETKEQQLFRFLSRTMPKQK HVVELKPYDKQKPEGGEALIKVLGNVANSGQCKKGLGKSNISIYKVRIRTDVLGNQHIIKNEGDKPK LDF | N622A |
| BlatCas9 | Brevibacillus laterosporus | 3273 | MAYTMGIDVGIASCGWAIVDLERQRIIDIGVRTFEKAENPKNGEALAVPRREARSSRRRLRRKKHR IERLKHMFVRNGLAVDIQHLEQTLRSQNEIDVWQLRVDLGDRMLTQKEWLRVLIHLAQRRGFQS NRKTDGSSEDGQVLVNVTENDRLMEEKDYRTVAEMMVKDEKFSDHKRNKNGNYHGVVSRSSL LVEIHTLPETQRQHHNSLASKDFELEVNIWSAQRPVATKDQIEKMIGTCTFLPKEKRAPKASWHF QYFMLLQTINHIRITNVQGTRSLNKEEIEQVVNMALIKSKVSYHDTRKILDLSEEYQPVGLDYGKE DEKKKVESKETIIKLDDYHKLNKIFNEVELAKGETWEADDYDTVAYALTFFKDDEDIRDYLQNKY KDSKNRLVKNLANKEYTNELIGKVSTLSFRKVGHLSLKALRKIIPFLEQGMTYDKACQOAAGFDFQ GISKKKRSVVLPVIDQISNPVVNRALTQTRKVINALIKKYGSPETIHETARELSKTFDERKNITKDY KENRDKNEHAKKHLSELGIINPTGLDIVKYKLMCEQQGRCMYSNQPISFERLKESGYTEVDHIIPY SRSMNDSYNNRVLVMTRENREKGNQTPEYMGNDTQRWYEFEQRVTTNPQIKKEKRONLLLKG FTNRRELEMLERNLNDTRYITKYLSHFISTNLEFSPSDKKKKVVNTSGRITSHLRSRWGLEKNRGQ NDLHHAMDAIVIAVTSDSFIQQVTNYYKRKERRELNGDDKFPLPWKFFREEVIARLSPNPKEQIEA LPNHFYSEDELADLQPIFVSRMPKRSITGEAHQAQFRRVVGKTKEGKNITAKKTALVDISYDKNGD FNMYGRETDPATYEAIKERYLEFGGNVKKAFSTDLHKPKKDGTKGPLIKSVRIMENKTLVHFVNK GKGVVYNSSIVRTDVFQREKEKYLLPVVTVDVTVTKGKLPNKVIVAKKGYHDMIEVDDSFTLFSLY PNDLIFIRQNPKKKISLKKRIESHSISDSKEVQEIHAYYKGVDSSTAAIEFIIHDGSYYAKGVGVQNL DCFEKYQVDILGNYFKVKGEKRLELETSDSNHHKGKDVNSIKSTSR | N607A |
| cCas9-v16 | Staphylococcus aureus | 3274 | MKRNYILGLDIGITSVGYGIIDYETRDVIDAGVRLFKEANVENNEGRRSKRGARRLKRRRRHRIQR VKKLLFDYNLLTDHSELSGINPYEARVKGLSQKLSEEEFSAALLHLAKRRGVHNVNEVEEDTGNE LSTKEQISRNSKALEEKVAEQLQERLKKDGEVRGSINRFKTSDYVKEAKQLLKVQKAYHQLDQS FIDTYIDLLETRRTYYEGPGEGSPFGWDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK | N580A |

TABLE 11-continued

| Variant | Parental Host | SEQ ID NO: | Protein Sequence | Nickase Mutation |
|---|---|---|---|---|
| cCas9-v17 | Staphylococcus aureus |  | VYHDIKDITARKEIIENAELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELAREKNSKDAQKMINEMQKRNQTNERIEEIIRTTGKENAKYLIEKIKLHDMQEGK CLYSLEAIPLEDLLNNPNYEVDHIIPRSVSFDNSFNNKVLVKQEENSKKGNRTPFQYLSSSDSKISY ETFKKHILNLAKGRISKTKKEYLLEERDINRFSVQKDFINRNLVDTRYATRGLMNLLRSYPRVN NLDVKVKSINGGFTSFLRRKWKFPKKERNKGYKHHAEDALIIANADFIFKEWKKLDKAKKVMENQ MFEEKQAESMPEIETEQYKEIFITPHQIKHIKDFKDYKYSHRVDKKPNRKLINDTLYSTRKDDKG NTLIVNNLNGLYDKDNDKLKKLINKSPEKLLMHDPQTYQKLKLIMEQYGDEKNPLYKYYEET GNYLTKYSKKDNGPVIKKIKYYGNKLNAHLDITDDYPNSRNKVVKLSLKPYRPDVYLDNGVYKF VTVKNLDVIKKENYYEVNSKCYEEAKKLKKISNQAEFIASFYKNDLIKINGELYRVIGVNSDKNNL IEVNMIDITYREYLENMNDKRPHIIKTIASKTQSIKKYSTDILGNLYEVKSKKHPQIIKKG | N580A |
| cCas9-v21 | Staphylococcus aureus | 3275 | MKRNYILGLDIGITSVGYGIIDYETRDVIDAGVRLFKEANVENNEGRRSKRGARRLKRRRRHRIQR VKKLLFDYNLLTDHSELSGINPYEARVKGLSQKLSEEEFSAALLHLAKRRGVHNVNEVEEDTGNE LSTKEQISRNSKALEEKYVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELAREKNSKDAQKMINEMQKRNQTNERIEEIIRTTGKENAKYLIEKIKLHDMQEGK CLYSLEAIPLEDLLNNPNYEVDHIIPRSVSFDNSFNNKVLVKQEENSKKGNRTPFQYLSSSDSKISY ETFKKHILNLAKGRISKTKKEYLLEERDINRFSVQKDFINRNLVDTRYATRGLMNLLRSYPRVN NLDVKVKSINGGFTSFLRRKWKFPKKERNKGYKHHAEDALIIANADFIFKEWKKLDKAKKVMENQ MFEEKQAESMPEIETEQYKEIFITPHQIKHIKDFKDYKYSHRVDKKPNRKLINDTLYSTRKDDKG NTLIVNNLNGLYDKDNDKLKKLINKSPEKLLMHDPQTYQKLKLIMEQYGDEKNPLYKYYEET GNYLTKYSKKDNGPVIKKIKYYGNKLNAHLDITDDYPNSRNKVVKLSLKPYRPDVYLDNGVYKF VTVKNLDVIKKENYYEVNSKCYEEAKKLKKISNQAEFIASFYKNDLIKINGELYRVIGVNNSTRNI VELNMIDITYREYLENMNDKRPHIIKTIASKTQSIKKYSTDILGNLYEVKSKKHPQIIKKG | N580A |
| cCas9-v21 | Staphylococcus aureus | 3276 | MKRNYILGLDIGITSVGYGIIDYETRDVIDAGVRLFKEANVENNEGRRSKRGARRLKRRRRHRIQR VKKLLFDYNLLTDHSELSGINPYEARVKGLSQKLSEEEFSAALLHLAKRRGVHNVNEVEEDTGNE LSTKEQISRNSKALEEKYVAELQLERLKKDGEVRGSINRFKTSDYVKEAKQLLKVQKAYHQLDQS FIDTYIDLLETRRTYYEGPGEGSPFGWKDIKEWYEMLMGHCTYFPEELRSVKYAYNADLYNALN DLNNLVITRDENEKLEYYEKFQIIENVFKQKKKPTLKQIAKEILVNEEDIKGYRVTSTGKPEFTNLK VYHDIKDITARKEIIENAELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELAREKNSKDAQKMINEMQKRNQTNERIEEIIRTTGKENAKYLIEKIKLHDMQEGK CLYSLEAIPLEDLLNNPNYEVDHIIPRSVSFDNSFNNKVLVKQEENSKKGNRTPFQYLSSSDSKISY ETFKKHILNLAKGRISKTKKEYLLEERDINRFSVQKDFINRNLVDTRYATRGLMNLLRSYPRVN NLDVKVKSINGGFTSFLRRKWKFPKKERNKGYKHHAEDALIIANADFIFKEWKKLDKAKKVMENQ MFEEKQAESMPEIETEQYKEIFITPHQIKHIKDFKDYKYSHRVDKKPNRKLINDTLYSTRKDDKG NTLIVNNLNGLYDKDNDKLKKLINKSPEKLLMHDPQTYQKLKLIMEQYGDEKNPLYKYYEET GNYLTKYSKKDNGPVIKKIKYYGNKLNAHLDITDDYPNSRNKVVKLSLKPYRPDVYLDNGVYKF VTVKNLDVIKKENYYEVNSKCYEEAKKLKKISNQAEFIASFYKNDLIKINGELYRVIGVNSDDRNII ELNMIDITYREYLENMNDKRPHIIKTIASKTQSIKKYSTDLLGNLYEVKSKKHPQIIKKG | N580A |

TABLE 11-continued

CRISPR/Cas Proteins, Species, and Mutations

| Variant | Parental Host | SEQ ID NO: | Protein Sequence | Nickase Mutation |
|---|---|---|---|---|
| cCas9-v42 | Staphylococcus aureus | 3277 | MKRNYILGLDIGITSVGYGIIDYETRDVIDAGVRLFKEANVENNEGRRSKRGARRLKRRRRHRIQR VKKLLFDYNLLTDHSELSGINPYEARVKGLSQKLSEEEFSAALLHLAKRGVHNVEVEEDTGNE LSTKEQISRNSKALEEKVAEILQLERLKKDGEVRGSINRFKTSDYVKEAKQLLKVQKAYHQLDQS FIDTYIDLLETRRTYYEGPGEGSPFGWDIKEWYEMLMGHCTYFPEELRSVKYAYNADLYNALN VYHDIKDITARKEIIENAELLDQIAKILTIYQSSEDIQEELTNLNSELTQEEIEQISNLKGYTGTHNLSL KAINLILDELWHTNDNQIAIFNRLKLVPKKVDLSQQKEIPTTLVDDFILSPVVKRSFIQSIKVINAIIK KYGLPNDIIIELAREKNSKDAQKMINEMQKRNQTNERIEEIIRTTGKENAKYLIEKIKLHDMQEGK CLYSLEAIPLEDLLNNPNYEKDIIPRSVRSPDNSFNNKVLVKQEENSKKGNRTPFQYLSSSDSKISY ETFKKHILNLAKGKGRISKTKKEYLLEERDINRFSVQKDFINRNLVDTRYATRGLMNLLRSYFRVN NLDVKVKSINGGFTSFLRRKWKFKKERNKGYKHHAEDALIIANADFIFKEWKLDKAKKVMENQ MFBEKQAESMPEIETEQEYKEIFITPHQLKHIKDFKDYKYSHRVDKKPNRKLINDTLYSTRKDDKG NTLIVNNLNGLYDKDKDLKKLLINKSPEKLLMYHHDPQTYQKLLIMEQYGDEKNPLYKYYEET GNVLTKYSKKDNGPVIKKIKYYGNKLNAHLDITDDYPNSRNKVVKLSLKPYRPDVYLDNGVYKF VTVKNLDVIKKENYYEVNSKCYEEAKKLKKISNQAEFIASFYKNDLLKINGELYRVIGVNNNRLNK IELNMIDITYREYLENMNDKRPPHIIKTIASKTQSIKKYSTDILGNLYEVKSKKHPQLIKKG | N580A |
| cdiCas9 | Corynebacterium diphtheriae | 3278 | MKYHVGIDVGTFSVGLAAIEVDDAGMPIKTLSLVSHIHDSGLDPDEIKSAVTRLASSGIARRTRRL YRRKRRRLQQLDKFIQRQGWPVIELEDYSDPLYPWKVRAELAASYIADEKERGEKLSVALRHIAR HRGWRNPYAKVSSLYLPDGPSDAFKAIREEIKRASGQPVPETATVGQMVTLCELGTLKLRGEGGV LSARLQQSDYARREIQEICRMQEIGQELYRKIIDVVFAAESPKGSASSRVGKDPLQPGKNRALKASD AFQRYRIAALIGNLRVRVDGEKRILSVEEKNLVFDHLVNLTPKKEPEWTIAEILGIDRGQLIGTAT MTDDGERAGARPPTHDTNRSIVNSRIAPLVDWWKTASALEQHAMVKALSNAEVDDFDSPEGAK VQAFFADLDDDVHAKLDSLHLPVGRAAYSEDTIVRLTRRMLSDGVDLYTARLQEFGIEPSWTPPT PRIGEPVGNPAVDRVLKTVSRMLESATKTWGAPERVIIEHVREGFVTEKRAREMDGDMRRRAAR NAKLFQEMQEKLNVQGKPSRADLWRYQSVQRQNCQCAYCGSPITFSNSEMDHIVPRAGQGSTNT RENLVAVCHRCNQSKGNTPFAIWAKNTSIEGVSVKEAVERTRHWVTDTGMRSTDFKKPTKAVVE RPQRATMDEEIDARSMESVAWMANELRSRVAQHFASHGTTVRVYRGSLTAEARRASGISGKLKF FDGVGKSRLDRRHHAIDAAVIAFTSDYVAETLAVRSNLKQSQAHRQEAPQWREFTGKDAEHRAA WRYWCQKMEKLSALLITEDLRDDRVVVMSNVRLRLGNGSAHKETIGKLSKVKLSSQLSVSDIDKA SSEALWCALTREPGFDPKEGLPANPERHIRVNGTHVYAGDNIGLFPVSAGSIALRGGVAELGSSFH HARVYKITSGKKPAFAMLRVYTIDLLPYRNQLFSVELKPQTMSMRQAEKKLRDALATGNAEYL GWLVVDDELIVVDTSKIATDQVKAVEAELGTIRRWRVDGFFSPSKLRLRPLQMSKEGIKKESAPEL SKIIDRPGWLPAVNKLFSDGNVTVVRRDSLGRVRLESTAHLPVTWKVQ | H573A (Alternate) |
| CjeCas9 | Campylobacter jejuni | 3279 | MARILAFDIGISSIGWAFSENDELKDCGVRIFTKVENPKTGESLALPRRLARSARKKLAARRKARLN HLKHLIANEFKLNYEDYQSFDESLAKAYKGSLISPYELRFRALNELLSKQDFARVILHIAKRRGYD DIKNSDDKEKGAILKAIKQNEEKLANYQSVGEYLYKEYFQKFKENSKEFTNVRNKKESYERCIAQ SFLKDELKLIFKKQREFGFSFSKKFEEEVLSVAFYKRALKDFSHLVGNCSFFTDEKRAPKNSPLAFM FVALTRIINLLNLKNTEGILYTKDDLNALLNEVLKNGTLTYKQTKKLLGLSDDYEFKGEKGTYFI EFKKYKEFIKALGEHNLSQDDLNEIAKDITLIKDEIKLKKALAKYDLNQNQIDSLSKLEFKDHLNIS FKALKLVTPLMLEGKKYDEACNELNLKVAINEDKDFLPAFNETYYKDEVTNPVVLRAIKEYRK VLNALLKKYGKVHKINIELAREVGKNHSQRAKIEKEQENYKAKKDABLECEKLGLKINSKNILK LRLFKEQOKEFCAYSGEKIKISDLQDEKMLEIDHIYPYSRSFDDSYMNKVLVFTKQNQEKLNQTPFE AFGNDSAKWQKIEVLAKNLPTKKQKRILDKNYDKEQKNFKDRNLNDTRYIARLVLNYTKDYLD FLPLSDDENTKLNDTQKGSKVHVEAKSGMLTSALRHTWGFSAKDRNNHLHHAIDAVIIAYANNSI VKAFSDFKKEQESNSAELYAKKLSEDYKNKRFEEPFSGFRQKVLDKIDEIFVSKPERKKPSGALH | N582A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | EETFRKEBFYQSYGGKEGVLKALELGKIRKVNGKIVKNGDMFRVDIPKHKKTNKFYAVPIYTMD FALKVLPNKAVARSKKGEIKDWILMDENYEFCFSLYKDSLILIQTKDMQEPEFVYYNAFTSSTVSLI VSKHDNKFETLSNQKILFKNANEKEVIAKSIGIQNLKVFEKYIVSALGEVTKAEFRQREDFKK | |
| GeoCas9 | Geobacillus stearothermophilus | 3280 | MRYKIGLDIGITSVGWAVMNLDIPRIEDLGVRIFDRAENPQTGESLALPRRLARSARRRLRRKHR LERIRRLVIREGILTKEELDKLFEEKHEIDVWQLRVEALDRKLNNDELARVLLHLAKRRGFKSNRK SERSNKENSTMLKHIEENRAILSSYRTVGEMIVKDPKFALHKRNKGENYTNTIARDDLEREIRLIFS KQREFGNMSCTEEFENEYITIWASQRPVASKDDIEKKVGFCTFEPKEKRAPKATYTFQSFIAWEHIN KLRLISPSGARGLTDEBRRLLYEQAFQKNKITYHDIRTLLHLPDDTYFKGIVYDRGESRKQNENIRF LELDAYHQIRKAVDKVYGKGKSSSFLPIDFDTFGYALTLFKDDADIHSYLRNEYEQNGKRMPNLA NKVYDNELIEELLNLSFTKFGHLSLKALRSILPYMEQGEVYSSACERAGYTTGPKKKQKTMLLPN IPPIANPVVMRALTQARKVVNAIIKKYGSPVSIHIELARDLSQTFDERRKTKKEQDENRKKNETAIR QLMEYGLTLNPTGHDIVKFKLWSEQNGRCAYSLQPIEIERLLEPGVEVEDHVIPYSRSLDDSYTNK VLVLTRENREKGNRIPAEYLGVGTERMQQFETFVLTNKQFSKKKKRDRLLRLHYDENEETEFKNRN LNDTRYISRFFANFIREHLKFAESDDKQKVYTVNGRVTAHLRSRWEFNKNREESDLHHAVDAVIV ACTTPSDIAKVTAFYQRREQNKELAKKTEPHPPQPWPHFADELRARLSKHPKESIKALNLGNYDD QKLESLQPVFVSRMPKRSVTGAAHQETLRRYVGIDERSGKIQTVVKTKLSEIKLDASGHFPMYGK ESDPRTYEAIRQRLLEHNNDPKKAFQEPLYKPKKNGEPGPVIRTVKIIDTKNQVIPLNDGKTVAYN SNIVRVDVFEKDGKYYCVPVYTMDIMKGILPNKAIEPNKPYSEWKEMTEDYTFRFSLYPNDLIRIE LPREKTVKTAAGEINVKDVFVYKTIDSANGGLELISHDHRFSLRGVGSRTLKRFEKYQVDVLG NIYKVRGEKRVGLASSAHSKPGKTIRPLQSTRD | N605A |
| iSpyMacCas9 | Streptococcus spp. | 3281 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLKRED LLRKQRTFDNGSIPHQIHLGELHAILRRQEDFYPFLKDNREKIEKILTFRIPYYVGPLARGNSRFAW MTRKSEETITPWNFEEVLDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDDFLKSDGFANRNFMQLIHDDSLTFKEDIQKAQVSGQDSLHEHIANL AGSPAIKKGILQTVKVVDELVKVMGRHKPENIVIEMARENQTTQKGQKNSRERMKRIEEGIKELG SQIIKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQIILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEIQTVQGNGLFDDNPKSPL EVTPSKLVPLKKELNPKYKYGGYQKPTTAYPVLLITDTKQLIPISVMKKQFEQNPVKFLRDRGYQQ VGKNDFIKLPKYTLVDIGDGIKRLWASSKEIHKGNQLVVSKKSQILYHAHHLDSDLSNDYLQNH NQQFDVLFNEIISFSKKCKLGKEHIQKIENVYSNKKNSASIEELAESFIKLLGFTQLGATSPFNFLGV KLNQKQYKGKKDYILPCTEGTLIRQSITGLYETRVDLSKIGEDSGSGSGSKRTADGSEFES | N863A |
| NmeCas9 | Neisseria meningitidis | 3282 | MAAFKPNSINYILGLDIGIASVGWAMVEIDEEENPIRLIDLGVRVFERAEVPKTGDSLAMARRLAR SVRRLTRRAHRLLRTRRLLKREGVLQAANFDENGLIKSLPNTPWQLRAAALDRKLTPLEWSAVL LHLIKHRGYLSQRKNEGETADKELGALLKGVAGNAHALQTGDFRTPAELALNKFEKESGHIRNQR | N611A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | SDYSHTFSRKDLQAELILLFEKQKEFGNPHVSGGLKEGIETLLMTQRPALSGDAVQKMLGHCTFEP<br>AEPKAAKNTYTAERFIWLTKLNNLRILEQGSERPLTDTERATLMDEPYRKSKLTYAQARKLLGLE<br>DTAFFKGLRYGKDNAEASTLMEMKAYHAISRALEKEGLKDKKSPLNLSPELQDEIGTAFSLFKTD<br>EDITGRLKDRIQPEILEALLKHISFDKFVQISLKALRRIVPLMEQGKRYDEACAEIYGDHYGKKNTE<br>EKIYLPPIPADEIRNPVVLRALSQARKVINGVVRRYGSPARIHETAREVGKSFKDRKEIEKRQEENR<br>KDREKAAAKFREYFPNFVGEPKSKDILKLRLYEQOHGKCLYSGKEINLGRLNEKGYVEIDHALPFS<br>RTWDDSFNNKVLVLGSENQNKGNQTPYEYFNGKDNSREWQEFKARVETSRFPRSKKQRILLQKF<br>DEDGFKERNLNDTIRYVNRFLCQFVADRMRLTGKGKKRVFASNGQITNLLRGFWGLRKVRAEND<br>RHHALDAVVVACSTVAMQOKITRFVRYKEMNAPDGKTIDKETGEVLHOKTHPQPWEFFAQEV<br>MIRVFGKPDGKPEFEEADTLEKLRTLLAEKLSSRPEAVHEYVTPLFVSRAPNRKMSGQGHMETVK<br>SAKRLDEGVSVLRVPLTQLKLKDLEKMVNREREPKLYEALKARLEAHKDDPAKAFAEPFYKYDK<br>AGNRTQQVKAVRVEBQVQKTGVMVRNHNGIADNATMVRVDVFEBKGDKYYLVPIYSWQVAKGIL<br>PDRAVVQGKDEEDWQLIDDSFNFKSLHPNDLVEVITKKARMFGYFASCHRGTGNINIRIHDLDH<br>KIGKNGILEGIGVKTALSFQKYQIDELGKEIRPCRLKKRPPVR | |
| ScaCas9 | Streptococcus canis | 3283 | MEKKYSIGLDIGTNSVGWAVITDDYKVPSKKFKVLGNTNRKSIKKNLMGALLFDSGETAEATRLK<br>RTARRRYTRRKNRIRYLQEIFANEMAKLDDSFFQRLEESFLVEEDKKNERHPIFGNLADEVAYHRN<br>YPTIYHLRKKLADSPEKADLRLIYLALAHIIKFPGHFLIEGKLNAENSDVAKLFYQLIQTYNQLFEE<br>SPLDEIEVDAKGILSARLSKSRLEKLIAVFPNEKKNGLFGNIIIALALGLTPNFKSNFDLTEDAKLQL<br>SKDTYDDDLDELLGQIGDQYADLFSAAKNLSDAILLSDILRSNSEVTKAPLSASMVKRYDEHHQD<br>LALLKTLVRQQPEKYAEIFKDDTKNGYAGYVGIGIKHRKRTTKLATQEEFYKFIKPILEKMDGAE<br>ELLAKLNRDDLLRKQRTFDNGSIPHQIHLKELHAILRRQEEFYPFLKENREKIEKILTFRIPYYVGPL<br>ARGNSRFAWLTRKSEEAITPWNFEEVVDKGASAQSFIERMTNFDEQLPNKKVLPKHSLLYEYFTV<br>YNELTKVKYVTERMRKPEFLSGEQKKAIVDLLFKTNRKVTVKQLKEDYFKKIECFDSVEIIGVEDR<br>FNASLGTYHDLLKIIKDKDFLDNEENEDILEDIVLTLTLFEDREMIEERLKTYAHLFDDKVMKQLK<br>RRHYTGWGRLSRKMINGIRDKQSGKTILDFLKSDGFSNRNFMQLIHDDSLTFKEEIEKAQVSQGD<br>SLHEQIADLAGSPAIKKGILQTVKIVDELVKVMGHKPENIVIEMARENQTTTKGLQQSRERKRIEE<br>GIKELESCQILKENPVENTQLQNEKLYLYYLQNGRDMVDQELDINRLSDYDVDHIVPQSFIKDDSI<br>DNKVLTRSVENRGKSDNVPSEEVVKKMKNYWRQLLNAKLITQRKFDNLTKAERGGLSEADKAG<br>FIKRQLVETRQITKHVARILDSRMNTKRDKNDKPIREVKVITLKSKLVSDFRKDFQLYKVRDINNY<br>HHAHDAYLNAVVGTALIKKYPKLESEFVYGDYKVYDVRKMIAKSEQEIGKATAKRFFYSNIMNF<br>FKTEVKLANGEIRKRPLIETNGETGEVVWNKEKDFATVRKVLAMPQVNIVKKTEVQTGGFSKESI<br>LSKRESAKLIPRKKGWDTRKYGGFGSPTVAYSILVVAKVEKGKAKKLKSVKVLVGITIMEKGSYE<br>KDPIGFLEAKGYKDIKKELIFLPKYSLFELENGRRRMLASATELQKANELVLPQHLVRLLYYTON<br>ISATTGSNNLGYIEQHREFPKEIFEKIIDFSEKVILKNKVNSNLKSSPDEQFAVSDSILLSNSFVSLLK<br>YTSFGASGGFTFLDLDVKQGRLRYQTVTEVLDATLIYQSITGLYETRTDLSQLGGD | N872A |
| ScaCas9-HiFi-SC++ | Streptococcus canis | 3284 | MEKKYSIGLDIGTNSVGWAVITDDYKVPSKKFKVLGNTNRKSIKKNLMGALLFDSGETAEATRLK<br>RTARRRYTRRKNRIRYLQEIFANEMAKLDDSFFQRLEESFLVEEDKKNERHPIFGNLADEVAYHRN<br>YPTIYHLRKKLADSPEKADLRLIYLALAHIIKFPGHFLIEGKLNAENSDVAKLFYQLIQTYNQLFEE<br>SPLDEIEVDAKGILSARLSKSRLEKLIAVFPNEKKNGLFGNIIIALALGLTPNFKSNFDLTEDAKLQL<br>SKDTYDDDLDELLGQIGDQYADLFSAAKNLSDAILLSDILRSNSEVTKAPLSASMVKRYDEHHQD<br>LALLKTLVRQQPEKYAEIFKDDTKNGYAGYVGADKKLRKRSGKLATEBEFYKFIKPILEKMDGA<br>EELLAKLNRDDLLRKQRTFDNGSIPHQIHLKELHAILRRQEEFYPFLKENREKIEKILTFRIPYYVGP<br>LARGNSRFAWLTRKSEEAITPWNFEEVVDKGASAQSFIERMTNFDEQLPNKKVLPKHSLLYEYFT<br>VYNELTKVKYVTERMRKPEFLSGEQKKAIVDLLFKTNRKVTVKQLKEDYFKKIECFDSVEIIGVED<br>RFNASLGTYHDLLKIIKDFLDNEENEDILEDIVLTLTLFEDREMIEERLKTYAHLFDDKVMKQL | N872A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | KRRHYTGWGRLSRKMINGIRDKQSGKTILDFLKSDGFSNANFMQLIHDDSLTFKEEIEKAQVSGQ GDSLHEQIADLAGSPAIKKGILQTVKIVDELVKVMGHKPENIVIEMARENQTTKGLQQSRERKKR IEEGIKELESQILKENPVENTQLQNEKLYLYLQNGRDMYVDQELDINRLSDYDVDHIVPQSFIKD DSIDNKVLTRSVENRGKSDNVPSEEVVKKMKNYWRQLLNAKLITQRKFDNLTKAERGGLSEADK AGFIKRQLVETRQITKHVARILDSRMNTKRDKNDKPIREVKVITLKSKLVSDFRKDFQLYKVRDIN NYHHAHDAYLNAVVGTALIKKYPKLESEFVYGDYKVTDVRKMIAKSEQEIGKATAKRFFYSNIM NFPKTEVKLANGEIRKRPLIETNGETGEVVWNKEKDFATVRKVLAMPQVNIVKKTEVQTGGFSKE SILSKRESAKLIPRKKGWDTRKYGGFGSPTVAYSILVVAKVEKGKAKKLKSVKVLVGITIMEKGSY EKDPIGFLEAKGYDIKKELIFKLPKYSLFELENGRRRMLASAKELQKANELVLPQHLVRLLYYTQ NISATTGSNNLGYIEQHREEFKEIFEKIIDFSEKYILKNKVNSNLKSSFDEQPAVSDSILLSNSFVSLL KTTSFGASGGFTFLDLDVKQGRLRYQTVTEVLDATLIYQSITGLYETRTDLSQLGGD | |
| SpyCas9-3var-NRRH | Streptococcus pyogenes | 3285 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMVKRYDEHHQ DLTLLKALVRQQLPEKYKEIFFDQSKNGYAGYIDGGASQEEFYKFIKPILEKMDGTEELLVKLNRE DLLRKQRTFDNGIIPHQIHLGELHAILRRQGDFYPFLKDNREKIEKILTFRIPYYVGPLARGNSRFAW MTRKSEEITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKQL VETROITKHVAQILDSRMNTKDENDKLIREVKVITLKSKLVSDFRKDFQFYKVREINNYHHAHD AYLNAVVGTALIKKYPKLESEFVYGDYKVDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKGNSDK LIARKKDWDPKKYGGFNSPTAAYSVLVVAKVEKGKSKKLKSVKELLGITIMERSSFEKNPIGFLEA KGYKEVKKDLIIKLPKYSLFELENGRKRMLASAGVLHKGNELALPSKYVNFLYLASHYEKLKGSP EDNEQKQLFVEQHKHYLDEIIEQISEFSKRVILADANLDKVLSAYNKHRDKPIREQAENIIHLFTLT NLGVPAARKYFDTTIDKKRYTSTKEVLDATLIHQSITGLYETRIDLSQLGGD | N863A |
| SpyCas9-3var-NRTH | Streptococcus pyogenes | 3286 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMVKRYDEHHQ DLTLLKALVRQQLPEKYKEIFFDQSKNGYAGYIDGGASQEEFYKFIKPILEKMDGTEELLVKLNRE DLLRKQRTFDNGIIPHQIHLGELHAILRRQGDFYPFLKDNREKIEKILTFRIPYYVGPLARGNSRFAW MTRKSEEITPWNFEEVVDKGASAQSFIERMTNFDKNLPNEKVLPKHSLLYEYFTVYNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL | N863A |

TABLE 11-continued

| Variant | Parental Host | SEQ ID NO: | Protein Sequence | Nickase Mutation |
|---|---|---|---|---|
| | | | TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKGNSDK LIARKKDWDPKKYGGFNSPTVAYSVLVVAKVEKGKSKKLKSVKELLGITIMERSSFEKNPIGFLEA KGYKEVKKDLIIKLPKYSLFELENGRKRMLASASVLHKGNELALPSKYVNFLYLASHYEKLLKGSS EDNKQKQLFVEQHKHYLDEIIEQISEFSKRVILADANLDKVLSAYNKHRDKPIREQAENIIHLFTLT NLGASAAPKYFDTTIGRKLYTSTKEVLDATLIHQSITGLYETRIDLSQLGGD | |
| SpyCas9-3var-NRCH | Streptococcus pyogenes | 3287 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDLDLNLLAQIGDQYADLFLAAKNLSDAILLSDILRVNTEITKAPLSASMIKRYDEHHQ DLTLLKALVRQQLPEKYKEIFFDQSKNGYAGYIDGGASQEEFYKFIKPILEKMDGTEELLVKLNRE DLLRKQRTFDNGSIPHQIHLGELHAILRRQGDPYPFLKDNREKIEKILTFRIPYYVGPLARGNSRFAW MTRKSEETITPWNFEEVVDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRLRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGGHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKGNSDK LIARKKDWDPKKYGGFNSPTVAYSVLVVAKVEKGKSKKLKSVKELLGITIMERSSFEKNPIDFLEA KGYKEVKKDLIIKLPKYSLFELENGRKRMLASAGVLQKGNELALPSKYVNFLYLASHYEKLLKGSP EDNEQKQLFVEQHKHYLDEIIEQISEFSKRVILADANLDKVLSAYNKHRDKPIREQAENIIHLFTLT NLGAPAAFKYFDTTINRKQYNTTKEVLDATLIRQSITGLYETRIDLSQLGGD | N863A |
| SpyCas9-HF1 | Streptococcus pyogenes | 3269 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDLDLNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL | N863A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | ANGEIRKRPLIETNGETGEIVWDKGRDFATVRKVLSMPQVNIVKKTEVQTGGFSKESILPKRNSDK LIARKKDWDPKKYGGFDSPTVAYSVLLVAKVEKGKSKKLKSVKELLGITIMERSSFKENPIDFLEA KGYKEVKKDLIIKLPKYSLFELENGRKRMLASAGELQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKRYTSTKEVLDATLIHQSITGLYETRIDLSQLGGD | |
| SpyCas9-QQR1 | Streptococcus pyogenes | 3288 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVDELVKVMGRHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFDSPTVAYSVLLVAKVEKGKSKKLKSVKELLGITIMERSSFKENPIDFLEA KGYKEVKKDLIIKLPKYSLFELENGRKRMLASARELQKGNELALPSKYVNFLYLASHYEKLKGSP EDNEQKQLFVEQHKHYLDEIIEQISEFSKRVILADAQLDKVLSAYNKHRDKPIREQAENIIHLFTLT NLGAPAAFKYFDTTFKQYRSTKEVLDATLIHQSITGLYETRIDLSQLGGD | N863A |
| SpyCas9-SpG | Streptococcus pyogenes | 3289 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDDLDNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVVDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVDELVKVMGRHKPENIVIEMARENQTTQKGQKNSRERMKRIEEGIKELG SQILKEHPVENTQLQNEKLYLYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETRQITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFLWPTVAYSVLLVAKVEKGKSKKLKSVKELLGITIMERSSFKENPIDFLE AKGYKEVKKDLIIKLPKYSLFELENGRKRMLASAKQLQKGNELALPSKYVNFLYLASHYEKLKGS | N863A |

TABLE 11-continued

| Variant | Parental Host | SEQ ID NO: | Protein Sequence | Nickase Mutation |
|---|---|---|---|---|
| | | | PEDNEQKQLFVEQHKHYLDEIIEQISEFSKRVILADANLDKVLSAYNKHRDKPIREQAENIIHLFTLT NLGAPAAFKYFDTTIDRKQYRSTKEVLDATLIHQSITGLYETRIDLSQLGGD | |
| SpyCas9-VQR | Streptococcus pyogenes | 3290 | MDKKYSIGLDIGTNSVGWAVITDEYKVPSKKFKVLGNTDRHSIKKNLIGALLFDSGETAEAATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDLDLNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFVSPTVAYSVLVVAKVEKGKSKKLKSVKELLGITIMERSSFEKNPIDFLEA KGYKEVKKDLIIKLPKYSLFELENGRKRMLASAGELQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKQYRSTKEVLDATLIHQSITGLYETRIDLSQLGGD | N863A |
| SpyCas9-VRER | Streptococcus pyogenes | 3291 | MDKKYSIGLDIGTNSVGWAVITDEYKVPSKKFKVLGNTDRHSIKKNLIGALLFDSGETAEAATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFDLAEDAKLQ LSKDTYDDLDLNLLAQIGDQYADLFLAAKNLSDAILLSDILRVNTEITKAPLSASMIKRYDEHHQD LTLLKALVRQQLPEKYKEIFFDQSKNGYAGYIDGGASQEEFYKFIKPILEKMDGTEELLVKLNRED LLRKQRTFDNGSIPHQIHLGELHAILRRQEDFYPFLKDNREKIEKILTFRIPYYVGPLARGNSRFAW MTRKSEETITPWNFEEVDKGASAQSFIERMTNFDKNLPNEKVLPKHSLLYEYFTVNELTKVKY VTEGMRKPAFLSGEQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFMQLIHDDSLTFKEDIQKAQVSGQGDSLHEHIANL AGSPAIKKGILQTVKVVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKYDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVWDKGRDFATVRKVLSMPQVNIVKKTEVQTGGFSKESILPKRNSDK LIARKKDWDPKKYGGFVSPTVAYSVLVVAKVEKGKSKKLKSVKELLGITIMERSSFEKNPIDFLEA KGYKEVKKDLIIKLPKYSLFELENGRKRMLASAREELQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKEYRSTKEVLDATLIHQSITGLYETRIDLSQLGGD | N863A |

TABLE 11-continued

CRISPR/Cas Proteins, Species, and Mutations

| Variant | Parental Host | SEQ ID NO: | Protein Sequence | Nickase Mutation |
|---|---|---|---|---|
| SpyCas9-xCas | Streptococcus pyogenes | 3292 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFPDLAEDTKLQ LSKDTYDDDLDNLLAQIGDQYADLFLAAKNLSDAILLSDILRVNTEITKAPLSASMIKLYDEHHQD LTLLKALVRQQLPEKYKEIFFDQSKNGYAGYIDGGASQEEFYKFIKPILEKMDGTEELLVKLNRED LLRKQRTFDNGIIPHQIHLGELHAILRRQEDFYPFLKDNREKIEKILTFRIPYYVGPLARGNSRFAW MTRKSEEITPWNFEKVDKGASAQSFIERMTNFDKNLPNEKVLPKHSLLYEYFTVYNELTKVKY VTEGMRKPAFLSGDQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFIQLIHDDSLTFKEDIQKAQVSGQGDSLHEHIANL AGSPAIKKGILQTVKVDELVKVMGRHKPENIVIEMARENQTTQKGQKNSRERMKRIEEGIKELG SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVMDKGRDFATVRKVLSMPQVNIVKKTEVQTGGFSKESILPKRNSDK LIARKKDWDPKKYGGFDSPTVAYSVLVVAKVEKGKSKKLKSVKELLGITIMERSSFEKNPIDFLEA KGYKEVKKDLIIKLPKYSLFELENGRKRMLASAGVLQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKRYTSTKEVLDATLIHQSITGLYETRIDLSQLGD | N863A |
| SpyCas9-xCas-NG | Streptococcus pyogenes | 3293 | MDKKYSIGLDIGTNSVGWAVITDEYKVPSKKFKVLGNTDRHSIKKNLIGALLFDSGETAEATRLKR TARRRYTRRKNRICYLQEIFSNEMAKVDDSFFHRLEESFLVEEDKKHERHPIFGNIVDEVAYHEKY PTIYHLRKKLVDSTDKADLRLIYLALAHMIKFRGHFLIEGDLNPDNSDVDKLFIQLVQTYNQLFEE NPINASGVDAKAILSARLSKSRRLENLIAQLPGEKKNGLFGNLIALSLGLTPNFKSNFPDLAEDTKLQ LSKDTYDDDLDNLLAQIGDQYADLFLAAKNLSDAILLSDILRVNTEITKAPLSASMIKLYDEHHQD LTLLKALVRQQLPEKYKEIFFDQSKNGYAGYIDGGASQEEFYKFIKPILEKMDGTEELLVKLNRED LLRKQRTFDNGIIPHQIHLGELHAILRRQEDFYPFLKDNREKIEKILTFRIPYYVGPLARGNSRFAW MTRKSEEITPWNFEKVDKGASAQSFIERMTNFDKNLPNEKVLPKHSLLYEYFTVYNELTKVKY VTEGMRKPAFLSGDQKKAIVDLLFKTNRKVTVKQLKEDYFKKIECFDSVEISGVEDRFNASLGTY HDLLKIIKDKDFLDNEENEDILEDIVLTLTLFEDREMIEERLKTYAHLFDDKVMKQLKRRRYTGWG RLSRKLINGIRDKQSGKTILDFLKSDGFANRNFIQLIHDDSLTFKEDIQKAQVSGQGDSLHEHIANL SQILKEHPVENTQLQNEKLYLYYLQNGRDMYVDQELDINRLSDYDVDHIVPQSFLKDDSIDNKVL TRSDKNRGKSDNVPSEEVVKKMKNYWRQLLNAKLITQRKFDNLTKAERGGLSELDKAGFIKRQL VETROITKHVAQILDSRMNTKDENDKLIREVKVITLKSKLVSDFRKDFQFYKVREINNYHHAHD AYLNAVVGTALIKKYPKLESEFVYGDYKVYDVRKMIAKSEQEIGKATAKYFFYSNIMNFFKTEITL ANGEIRKRPLIETNGETGEIVMDKGRDFATVRKVLSMPQVNIVKKTEVQTGGFSKESIRPKRNSDK LIARKKDWDPKKYGGFDSPTVAYSVLVVAKVEKGKSARFLQKGNELALPSKYVNFLYLASHYEKLKGSP EDNEQKQLFVEQHKHYLDEIIEQISEFSKRVILADANLDKVLSAYNKHRDKPIREQAENIIHLFTLT NLGAPAAFKYFDTTIDRKRYVRSTKEVLDATLIHQSITGLYETRIDLSQLGD | N863A |
| St1Cas9-CNRZ1066 | Streptococcus thermophilus | 3294 | MSDLVLGLDIGIGSVGVGILNKVTGEIIHKNSRIFPAAQAENNLVRRTNRQGRRLARRKKHRRVRL NRLFEESGLITDFTKISINLNPYQLRVKGLTDELSNEELFIALKNMVKHRGISYLDDASDDGNSSVG DYAQIVKENSKQLETKTPGQILERYQTYGQLRGDFTVEKDGKKHRLINVFPTSAYRSEALRILQT QQEFNPQLTDEFINRYLEILTGKRKYYHGPGNEKSRTDYGRYRTSGETLDNIFGILIGKCTFYPDEFR | N622A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTILTRLGKQKTTSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLWHQQGERCLYTGKTISIHDLINNSNQF EVDHILPLSITFDDSLANKVLVATANQEKGQRTPYQALDSMDDAWSFRELKAFVRESKTLSNKK KEYLLTEEDISKPDVRKKFIERNLVDTRYASRVVLNALQEHFRAHKIDTKVSVVRGQFTSQLRRH WGIEKTRDTYHHAVDALIIAASSQLNLMKKQKNTLVSYSEEQLLDIETGELISDDEYKESVFKAP YQHFVDTLKSKEFEDSILFSYQVDSKFNRKISDATIYATROAKVGDKKDETVLGKIDIYTQDG YDAFMKIYKKDKSKFLMYRHDPQTFEKVIEPILENYPNKQMNEKGKEVPCNPPLKYKEHGYIRK YSKKGNGPEIKSLKYDSKLLGNPIDITPENSKNKVVLQSLKPWRTDVYFNKATGKYEILGLKYA DLQPEKGTGTYKISQEKYNDIKKKEGVDSDSEFKFTLYKNDLLLLVKDTETKEQQLFRPLSRTLPKQ KHVVELKPYDKQKFEGGEALIKVLGNVANGGQCIKGLAKSNISIYKVRTDVLGNQHIIKNEGDKP KLDF | |
| St1Cas9- LMG1831 | Streptococcus thermophilus | 3295 | MSDLVLGLDIGIGSVGVGILNKVTGEIIHKNSRIFPAAQAENNLVRRTNRQGRRLARRKKHRVRL NRLFEESGLITDPTKISINLNPYQLRVKGLTDELSNEELFIALKNMVKHRGISYLDDASDDGNSSVG DYAQIVKENSKQLETKTPGQIQLERYQTYGQLRGDFTVEKDGKKHRLINVFPTSAYRSEALRILQT QQEFNPQITDEFINRYLEILTGKRKYYHGPGNEKSRTDYGRYRTSGETLDNIFGILIGKCTFYPDEFR AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTILTRLGKQKTTSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLWHQQGERCLYTGKTISIHDLINNSNQF EVDHILPLSITFDDSLANKVLVATANQEKGQRTPYQALDSMDDAWSFRELKAFVRESKTLSNKK KEYLLTEEDISKPDVRKKFIERNLVDTRYASRVVLNALQEHFRAHKIDTKVSVVRGQFTSQLRRH WGIEKTRDTYHHAVDALIIAASSQLNLMKKQKNTLVSYSEEQLLDIETGELISDDEYKESVFKAP YQHFVDTLKSKEFEDSILFSYQVDSKFNRKISDATIYATROAKVGDKKDETVLGKIDIYTQDG YDAFMKIYKKDKSKFLMYRHDPQTFEKVIEPILENYPNKQMNEKGKEVPCNPPLKYKEHGYIRK YSKKGNGPEIKSLKYDSKLLGNPIDITPENSKNKVVLQSLKPWRTDVYFNKNTGKYEILGLKYA DLQPEKKTGTYKISQEKYNGIMKEEGVDSDSEFKFTLYKNDLLLLVKDTETKEQQLFRPLSRTMPN VKYYVELKPYSKDKFEKNESLIBILGSADKSGRCIKGLGKSNISIYKVRTDVLGNQHIIKNEGDKPK LDF | N622A |
| St1Cas9- MTH17C L396 | Streptococcus thermophilus | 3296 | MSDLVLGLDIGIGSVGVGILNKVTGEIIHKNSRIFPAAQAENNLVRRTNRQGRRLARRKKHRVRL NRLFEESGLITDPTKISINLNPYQLRVKGLTDELSNEELFIALKNMVKHRGISYLDDASDDGNSSVG DYAQIVKENSKQLETKTPGQIQLERYQTYGQLRGDFTVEKDGKKHRLINVFPTSAYRSEALRILQT QQEFNPQITDEFINRYLEILTGKRKYYHGPGNEKSRTDYGRYRTSGETLDNIFGILIGKCTFYPDEFR AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTILTRLGKQKTTSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLWHQQGERCLYTGKTISIHDLINNSNQF EVDHILPLSITFDDSLANKVLVATANQEKGQRTPYQALDSMDDAWSFRELKAFVRESKTLSNKK KEYLLTEEDISKPDVRKKFIERNLVDTRYASRVVLNALQEHFRAHKIDTKVSVVRGQFTSQLRRH WGIEKTRDTYHHAVDALIIAASSQLNLMKKQKNTLVSYSEDQLLDIETGELISDDEYKESVFKAP YQHFVDTLKSKEFEDSILFSYQVDSKFNRKISDATIYATRQAKVGKDKADETVLGKIDIYTQDG | N622A |

TABLE 11-continued

CRISPR/Cas Proteins, Species, and Mutations

| Variant | Parental Host | SEQ ID NO: | Protein Sequence | Nickase Mutation |
|---|---|---|---|---|
| | | | YDAFMKIYKKDKSKFLMYRHDPQTFEKVIEPILENYPNKQINEKGKEVPCNPFLKYKEEHGYIRKY SKKGNGPEIKSLKYYDSKLGNHIDITPKDSNNKVVLQSLKPWRTDVYFNKNTGKYEILGLKYSDM QFEKGTGKYSISKEQYENIKVREGVDENSEFKFTLYKNDLLLKDSENGEQILLRFTSRNDTSKHY VELKPYNRQKFEGSEYLIKSLGTVAKGGQCIKGLGKSNISIYKVRTDVLGNQHIIKNEGDKPKLDF | |
| St1Cas9-TH1477 | Streptococcus thermophilus | 3297 | MSDLVLGLDIGIGSVGVGILNKVTGEIIHKNSRIFPAAQAENNLVRRTNRQGRRLARRKKHRRVRL NRLFEESGLITDFTKISINLNPYQLRVKGLTDELSNEELFIALKNMVKHRGISYLDDASDDGNSSVG DYAQIVKENSKQLETKTPGQIQLERYQTYGQLRGDFTVEKDGKKHRLINVFPTSAYRSEALRILQT QQEFNPQITDEFINRYLEILTGKRKYYHGPGNEKSRTDYGRYRTSGETLDNIFGILIGKCTFYPDEFR AAKASYTAQEFNLLNDLNNLTVPTETKKLSKEQKNQIINYVKNEKAMGPAKLFKYIAKLLSCDVA DIKGYRIDKSGKAEIHTFEAYRKMKTLETLDIEQMDRETLDKLAYVLTLNTEREGIQEALEHEFAD GSFSQKQVDELVQFRKANSSIFGKGWHNFSVKLMMELIPELYETSEEQMTILTRLGKQKTTSSSNK TKYIDEKLLTEEIYNPVVAKSVRQAIKIVNAAIKEYGDFDNIVIEMARETNEDDEKKAIQKIQKANK DEKDAAMLKAANQYNGKAELPHSVFHGHKQLATKIRLWHQQGERCLYTGKTISIHDLINNSNQF EVDHILPLSITFDDSLANKVLVYATANQEKGQRTPYQALDSMDDAWSFRELKAFVRESKTLSNKK KEYILLTEEDISKFDVRKKFIERNLVDTRYASRVVLNALQEHFRAHKIDTKVSVVRGQFTSQLRRH WGIEKTRDTYHHAVDALIIAASSQLNLWKKQKNTLVSYSEDQLLDIETGELISDDEYKESVFKAP YQHFVDTLKSKEFEDSILFSYQVDSKFNRKISDATIYATROAKVGKDKADETVLGKIKDIYTQDG YDAFMKIYKKDKSKFLMYRHDPQTFEKVIEPILENYPNKQINEKGKEVPCNPFLKYKEEHGYIRKY SKKGNGPEIKSLKYYDSKLGNHIDITPKDSNNKVVLQSLKPWRTDVYFNKNTGKYEILGLKYSDM QFEKGTGKYSISKEQYENIKVREGVDENSEFKFTLYKNDLLLKDSENGEQILLRFTSRNDTSKHY VELKPYNRQKFEGSEYLIKSLGTVVKGGRCIKGLGKSNISIYKVRTDVLGNQHIIKNEGDKPKLDF | N622A |

In some embodiments, the endonuclease domain or DNA binding domain comprises a Cas domain, e.g., a Cas9 domain. In embodiments, the endonuclease domain or DNA binding domain comprises a nuclease-active Cas domain, a Cas nickase (nCas) domain, or a nuclease-inactive Cas (dCas) domain. In embodiments, the endonuclease domain or DNA binding domain comprises a nuclease-active Cas9 domain, a Cas9 nickase (nCas9) domain, or a nuclease-inactive Cas9 (dCas9) domain. In some embodiments, the endonuclease domain or DNA binding domain comprises a Cas9 domain of Cas9 (e.g., dCas9 and nCas9), Cas12a/Cpf1, Cas12b/C2ca, Cas12c/C2c3, Cas12d/CasY, Cas12e/CasX, Cas12g, Cas12h, or Cas12i. In some embodiments, the endonuclease domain or DNA binding domain comprises a Cas9 (e.g., dCas9 and nCas9), Cas12a/Cpf1, Cas12b/C2c1, Cas12c/C2c3, Cas12d/CasY, Cas12e/CasX, Cas12g, Cas12h, or Cas12i. In some embodiments, the endonuclease domain or DNA binding domain comprises an *S. pyogenes* or an *S. thermophilus* Cas9, or a functional fragment thereof. In some embodiments, the endonuclease domain or DNA binding domain comprises a Cas9 sequence, e.g., as described in Chylinski, Rhun, and Charpentier (2013) RNA Biology 10:5, 726-737; incorporated herein by reference. In some embodiments, the endonuclease domain or DNA binding domain comprises the HNH nuclease subdomain and/or the RuvC1 subdomain of a Cas, e.g., Cas9, e.g., as described herein, or a variant thereof. In some embodiments, the endonuclease domain or DNA binding domain comprises Cas12a/Cpf1, Cas12b/C2c1, Cas12c/C2c3, Cas12d/CasY, Cas12c/CasX, Cas12g, Cas12h, or Cas12i. In some embodiments, the endonuclease domain or DNA binding domain comprises a Cas polypeptide (e.g., enzyme), or a functional fragment thereof. In embodiments, the Cas polypeptide (e.g., enzyme) is selected from Cas1, Cas1B, Cas2, Cas3, Cas4, Cas5, Cas5d, Cas5t, Cas5h, Cas5a, Cas6, Cas7, Cas8, Cas8a, Cas8b, Cas8c, Cas9 (e.g., Csn1 or Csx12), Cas10, Cas10d, Cas12a/Cpf1, Cas12b/C2c1, Cas12c/C2c3, Cas12d/CasY, Cas12c/CasX, Cas12g, Cas12h, Cas12i, Csy1, Csy2, Csy3, Csy4, Cse1, Cse2, Cse3, Cse4, Cse5e, Csc1, Csc2, Csa5, Csn1, Csn2, Csm1, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx1S, Csx11, Csf1, Csf2, CsO, Csf4, Csd1, Csd2, Cst1, Cst2, Csh1, Csh2, Csa1, Csa2, Csa3, Csa4, Csa5, Type II Cas effector proteins, Type V Cas effector proteins, Type VI Cas effector proteins, CARF, DinG, Cpf1, Cas12b/C2c1, Cas12c/C2c3, Cas12b/C2c1, Cas12c/C2c3, SpCas9 (K855A), cSpCas9 (1.1), SpCas9-HF1, hyper accurate Cas9 variant (HypaCas9), homologues thereof, modified or engineered versions thereof, and/or functional fragments thereof. In embodiments, the Cas9 comprises one or more substitutions, e.g., selected from H840A, D10A, P475A, W476A, N477A, D1125A, W1126A, and D1127A. In embodiments, the Cas9 comprises one or more mutations at positions selected from: D10, G12, G17, E762, H840, N854, N863, H982, H983, A984, D986, and/or A987, e.g., one or more substitutions selected from D10A, G12A, G17A, E762A, H840A, N854A, N863A, H982A, H983A, A984A, and/or D986A. In some embodiments, the endonuclease domain or DNA binding domain comprises a Cas (e.g., Cas9) sequence from *Corynebacterium ulcerans, Corynebacterium diphtheria, Spiroplasma syrphidicola, Prevotella intermedia, Spiroplasma taiwanense, Streptococcus iniae, Belliella baltica, Psychroflexus torquis, Streptococcus thermophilus, Listeria innocua, Campylobacter jejuni, Neisseria meningitidis, Streptococcus pyogenes,* or *Staphylococcus aureus,* or a fragment or variant thereof.

In some embodiments, the endonuclease domain or DNA binding domain comprises a Cpf1 domain, e.g., comprising one or more substitutions, e.g., at position D917, E1006A, D1255 or any combination thereof, e.g., selected from D917A, E1006A, D1255A, D917A/E1006A, D917A/D1255A, E1006A/D1255A, and D917A/E1006A/D1255A.

In some embodiments, the endonuclease domain or DNA binding domain comprises spCas9, spCas9-VRQR, spCas9-VRER, xCas9 (sp), saCas9, saCas9-KKH, spCas9-MQKSER, spCas9-LRKIQK, or spCas9-LRVSQL.

In some embodiments, the endonuclease domain or DNA-binding domain comprises an amino acid sequence as listed in Table 12 below, or an amino acid sequence having at least 80%, 85%, 90%, 95%, 96%, 97%, 98%, or 99% sequence identity thereto. In some embodiments, the endonuclease domain or DNA-binding domain comprises an amino acid sequence that has no more than 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 differences (e.g., mutations) relative to any of the amino acid sequences described herein.

TABLE 12

Each of the Reference Sequences are incorporated by reference in their entirety.

| Name | Amino Acid Sequence or Reference Sequence |
|---|---|
| *Streptococcus pyogenes* Cas9 | |
| Exemplary Linker | SGSETPGTSESATPES (SEQ ID NO: 1023) |
| Exemplary Linker Motif | $(SGGS)_n$ (SEQ ID NO: 1583) |
| Exemplary Linker Motif | $(GGGS)_n$ (SEQ ID NO: 1584) |
| Exemplary Linker Motif | $(GGGGS)_n$ (SEQ ID NO: 1535) |
| Exemplary Linker Motif | $(G)_n$ |
| Exemplary Linker Motif | $(EAAAK)_n$ (SEQ ID NO: 1534) |
| Exemplary Linker Motif | $(GGS)_n$ |
| Exemplary Linker Motif | $(XP)_n$ |

TABLE 12-continued

Each of the Reference Sequences are incorporated by reference in their entirety.

| Name | Amino Acid Sequence or Reference Sequence |
|---|---|
| Cas9 from *Streptococcus pyogenes* | NCBI Reference Sequence: NC_002737.2 and Uniprot Reference Sequence: Q99ZW2 |
| Cas9 from *Corynebacterium ulcerans* | NCBI Refs: NC_015683.1, NC_017317.1 |
| Cas9 from *Corynebacterium diphtheria* | NCBI Refs: NC_016782.1, NC_016786.1 |
| Cas9 from *Spiroplasma syrphidicola* | NCBI Ref: NC_021284.1 |
| Cas9 from *Prevotella intermedia* | NCBI Ref: NC_017861.1 |
| Cas9 from *Spiroplasma taiwanense* | NCBI Ref: NC_021846.1 |
| Cas9 from *Streptococcus iniae* | NCBI Ref: NC_021314.1 |
| Cas9 from *Belliella baltica* | NCBI Ref: NC_018010.1 |
| Cas9 from *Psychroflexus torquisI* | NCBI Ref: NC_018721.1 |
| Cas9 from *Streptococcus thermophilus* | NCBI Ref: YP_820832.1 |
| Cas9 from *Listeria innocua* | NCBI Ref: NP_472073.1 |
| Cas9 from *Campylobacter jejuni* | NCBI Ref: YP_002344900.1 |
| Cas9 from *Neisseria meningitidis* | NCBI Ref: YP_002342100.1 |
| dCas9 (D10A and H840A) | |
| Catalytically inactive Cas9 (dCas9) | |
| Cas9 nickase (nCas9) | |
| Catalytically active Cas9 | |
| CasY | ((ncbi.nlm.nih.gov/protein/APG80656.1)<br>>APG80656.1 CRISPR-associated protein CasY [uncultured Parcubacteria group bacterium]) |
| CasX | uniprot.org/uniprot/F0NN87; uniprot.org/uniprot/F0NH53 |
| CasX | >tr\|F0NH53\|F0NH53_SULIR CRISPR associated protein, Casx OS = *Sulfolobus islandicus* (strain REY15A) GN = SiRe_0771 PE = 4 SV = 1 |
| Deltaproteobacteria CasX | |
| Cas12b/C2c1 | ((uniprot.org/uniprot/T0D7A2#2) sp\|T0D7A2\|C2C1_ALIAG CRISPR- associated endonuclease C2c1 OS = *Alicyclobacillus acido-terrestris* (strain ATCC 49025/DSM 3922/CIP 106132/ NCIMB 13137/GD3B) GN = c2c1 PE = 1 SV = 1) |
| BhCas12b ((*Bacillus hisashii*) | NCBI Reference Sequence: WP_095142515 |
| BvCas12b (*Bacillus sp.* V3-13) | NCBI Reference Sequence: WP_101661451.1 |
| Wild-type *Francisella novicida* Cpf1 | |
| *Francisella novicida* Cpf1 D917A | |

TABLE 12-continued

Each of the Reference Sequences are incorporated by reference in their entirety.

| Name | Amino Acid Sequence or Reference Sequence |
|---|---|
| *Francisella novicida* Cpf1 E1006A | |
| *Francisella novicida* Cpf1 D1255A | |
| *Francisella novicida* Cpf1 D917A/E1006A | |
| *Francisella novicida* Cpf1 D917A/D1255A | |
| *Francisella novicida* Cpf1 E1006A/D1255A | |
| *Francisella novicida* Cpf1 D917A/E1006A | |
| SaCas9 | |
| SaCas9n | |
| PAM-binding SpCas9 | |
| PAM-binding SpCas9n | |
| PAM-binding SpEQR Cas9 | |
| PAM-binding SpVQR Cas9 | |
| PAM-binding SpVRER Cas9 | |
| PAM-binding SpVRQR Cas9 | |
| SpyMacCas9 | |

In some embodiments, a GENE WRITING™ polypeptide has an endonuclease domain comprising a Cas9 nickase, e.g., Cas9 H840A. In embodiments, the Cas9 H840A has the following amino acid sequence:

Cas9 nickase (H840A):
(SEQ ID NO: 1585)
DKKYSIGLDIGTNSVGWAVITDEYKVPSKKFKVLGNTDRHSIKKNLIGA

LLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDK

ADLRLIYLALAHMIKFRGHFLIEGDLNPDNSDVDKLFIQLVQTYNQLFE

ENPINASGVDAKAILSARLSKSRRLENLIAQLPGEKKNGLFGNLIALSL

GLTPNFKSNFDLAEDAKLQLSKDTYDDDLDNLLAQIGDQYADLFLAAKN

LSDAILLSDILRVNTEITKAPLSASMIKRYDEHHQDLTLLKALVRQQLP

EKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEK

ILTFRIPYYVGPLARGNSRFAWMTRKSEETITPWNFEEVVDKGASAQSF

IERMTNFDKNLPNEKVLPKHSLLYEYFTVYNELTKVKYVTEGMRKPAFL

SGEQKKAIVDLLFKTNRKVTVKQLKEDYFKKIECFDSVEISGVEDRFNA

SLGTYHDLLKIIKDKDFLDNEENEDILEDIVLTLTLFEDREMIEERLKT

YAHLFDDKVMKQLKRRRYTGWGRLSRKLINGIRDKQSGKTILDFLKSDG

FANRNFMQLIHDDSLTFKEDIQKAQVSGQGDSLHEHIANLAGSPAIKKG

ILQTVKVVDELVKVMGRHKPENIVIEMARENQTTQKGQKNSRERMKRIE

EGIKELGSQILKEHPVENTQLQNEKLYLYYLQNGRDMYVDQELDINRLS

DYDVDAIVPQSFLKDDSIDNKVLTRSDKNRGKSDNVPSEEVVKKMKNYW

RQLLNAKLITQRKFDNLTKAERGGLSELDKAGFIKRQLVETRQITKHVA

QILDSRMNTKYDENDKLIREVKVITLKSKLVSDFRKDFQFYKVREINNY

HHAHDAYLNAVVGTALIKKYPKLESEFVYGDYKVYDVRKMIAKSEQEIG

KATAKYFFYSNIMNFFKTEITLANGEIRKRPLIETNGETGEIVWDKGRD

FATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKN

PIDFLEAKGYKEVKKFTLTNLGAPAAFKYFDTTIDRKRYTSTKEVLDAT

LIHQSITGLYETRIDLSQLGGD

In some embodiments, a GENE WRITING™ polypeptide comprises the RT domain from a retroviral reverse transcriptase, e.g., a wild-type M-MLV RT, e.g., comprising the following sequence:

M-MLV (WT):

(SEQ ID NO: 1586)
TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFD

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKTGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGLLTSEGKEIKNKDEILALLKALFLPKRLSIIHCPGHQKGHSAEARGNR

MADQAARKAAITETPDTSTLLI

In some embodiments, a GENE WRITING™ polypeptide comprises the RT domain from a retroviral reverse transcriptase, e.g., an M-MLV RT, e.g., comprising the following sequence:

(SEQ ID NO: 1548)
TLNIEDEHRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFD

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKTGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

ALPAGTSAQRAELIALTQALKMAEGKKLNVYTDSRYAFATAHIHGEIYRR

RGLLTSEGKEIKNKDEILALLKALFLPKRLSIIHCPGHQKGHSAEARGNR

MADQAARKAAITETPDTSTLL

In some embodiments, a GENE WRITING™ polypeptide comprises the RT domain from a retroviral reverse transcriptase comprising the sequence of amino acids 659-1329 of NP_057933. In embodiments, the GENE WRITING™ polypeptide further comprises one additional amino acid at the N-terminus of the sequence of amino acids 659-1329 of NP_057933, e.g., as shown below:

(SEQ ID NO: 1587)
TLNIEDEHRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFD

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGTAGFCRLWIPGFAEMAAPLYPLTKTGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADH<u>TWYTDGSSLLQEGQRKAGAAVTTETEVIWAK

ALPAGTSAQRAELIALTQALKMAEGKKLNVYTDSRYAFATAHIHGEIYRR

RGLLTSEGKEIKNKDEILALLKALFLPKRLSIIHCPGHQKGHSAEARGNR</u>

MADQAARKAA

Core RT (bold), annotated per above

RNAseH (underlined), annotated per above

In embodiments, the GENE WRITING™ polypeptide further comprises one additional amino acid at the C-terminus of the sequence of amino acids 659-1329 of NP_057933. In embodiments, the GENE WRITING™ polypeptide comprises an RNAseH1 domain (e.g., amino acids 1178-1318 of NP_057933).

In some embodiments, a retroviral reverse transcriptase domain, e.g., M-MLV RT, may comprise one or more mutations from a wild-type sequence that may improve features of the RT, e.g., thermostability, processivity, and/or template binding. In some embodiments, an M-MLV RT domain comprises, relative to the M-MLV (WT) sequence above, one or more mutations, e.g., selected from D200N, L603W, T330P, T306K, W313F, D524G, E562Q, D583N, P51L, S67R, E67K, T197A, H204R, E302K, F309N, L435G, N454K, H594Q, D653N, R110S, K103L, e.g., a combination of mutations, such as D200N, L603W, and T330P, optionally further including T306K and W313F. In some embodiments, an M-MLV RT used herein comprises the mutations D200N, L603W, T330P, T306K and W313F. In embodiments, the mutant M-MLV RT comprises the following amino acid sequence:

M-MLV (PE2):

(SEQ ID NO: 1588)
TLNIEDEYRLHETSKEPDVSLGSTWLSDFPQAWAETGGMGLAVRQAPLII

PLKATSTPVSIKQYPMSQEARLGIKPHIQRLLDQGILVPCQSPWNTPLLP

VKKPGTNDYRPVQDLREVNKRVEDIHPTVPNPYNLLSGLPPSHQWYTVLD

LKDAFFCLRLHPTSQPLFAFEWRDPEMGISGQLTWTRLPQGFKNSPTLFN

EALHRDLADFRIQHPDLILLQYVDDLLLAATSELDCQQGTRALLQTLGNL

GYRASAKKAQICQKQVKYLGYLLKEGQRWLTEARKETVMGQPTPKTPRQL

REFLGKAGFCRLFIPGFAEMAAPLYPLTKPGTLFNWGPDQQKAYQEIKQA

LLTAPALGLPDLTKPFELFVDEKQGYAKGVLTQKLGPWRRPVAYLSKKLD

PVAAGWPPCLRMVAAIAVLTKDAGKLTMGQPLVILAPHAVEALVKQPPDR

WLSNARMTHYQALLLDTDRVQFGPVVALNPATLLPLPEEGLQHNCLDILA

EAHGTRPDLTDQPLPDADHTWYTDGSSLLQEGQRKAGAAVTTETEVIWAK

-continued

ALPAGTSAQRAELIALTQALKMAEGKKLNVYTDSRYAFATAHIHGEIYRR
RGWLTSEGKEIKNKDEILALLKALFLPKRLSIIHCPGHQKGHSAEARGNR
MADQAARKAAITETPDTSTLLI

In some embodiments, a GENE WRITER™ polypeptide may comprise a linker, e.g., a peptide linker, e.g., a linker as described in Table 13. In some embodiments, a GENE WRITER™ polypeptide comprises a flexible linker between the endonuclease and the RT domain, e.g., a linker comprising the amino acid sequence SGGSSGGSSGSETPGTSESATPESSGGSSGGSS (SEQ ID NO: 1589). In some embodiments, an RT domain of a GENE WRITER™ polypeptide may be located C-terminal to the endonuclease domain. In some embodiments, an RT domain of a GENE WRITER™ polypeptide may be located N-terminal to the endonuclease domain.

TABLE 13

Exemplary linker sequences

| Amino Acid Sequence | SEQ ID NO: |
|---|---|
| GGS | |
| GGSGGS | 3298 |
| GGSGGSGGS | 3299 |
| GGSGGSGGSGGS | 3300 |
| GGSGGSGGSGGSGGS | 3301 |
| GGSGGSGGSGGSGGSGGS | 3302 |
| GGGGS | 1535 |
| GGGGSGGGGS | 3303 |
| GGGGSGGGGSGGGGS | 3304 |
| GGGGSGGGGSGGGGSGGGGS | 3305 |
| GGGGSGGGGSGGGGSGGGGSGGGGS | 3306 |
| GGGGSGGGGSGGGGSGGGGSGGGGSGGGGS | 3307 |
| GGG | |
| GGGG | 3308 |
| GGGGG | 3309 |
| GGGGGG | 3310 |
| GGGGGGG | 3311 |
| GGGGGGGG | 3312 |
| GSS | |
| GSSGSS | 1736 |
| GSSGSSGSS | 3313 |
| GSSGSSGSSGSS | 3314 |
| GSSGSSGSSGSSGSS | 3315 |
| GSSGSSGSSGSSGSSGSS | 3316 |
| EAAAK | 1534 |

TABLE 13-continued

Exemplary linker sequences

| Amino Acid Sequence | SEQ ID NO: |
|---|---|
| EAAAKEAAAK | 3317 |
| EAAAKEAAAKEAAAK | 3318 |
| EAAAKEAAAKEAAAKEAAAK | 3319 |
| EAAAKEAAAKEAAAKEAAAKEAAAK | 3320 |
| EAAAKEAAAKEAAAKEAAAKEAAAKEAAAK | 3321 |
| PAP | |
| PAPAP | 3322 |
| PAPAPAP | 3323 |
| PAPAPAPAP | 3324 |
| PAPAPAPAPAP | 3325 |
| PAPAPAPAPAPAP | 3326 |
| GGSGGG | 3327 |
| GGGGGS | 3328 |
| GGSGSS | 3329 |
| GSSGGS | 3330 |
| GGSEAAAK | 3331 |
| EAAAKGGS | 3332 |
| GGSPAP | 3333 |
| PAPGGS | 3334 |
| GGGGSS | 3335 |
| GSSGGG | 3336 |
| GGGEAAAK | 3337 |
| EAAAKGGG | 3338 |
| GGGPAP | 3339 |
| PAPGGG | 3340 |
| GSSEAAAK | 3341 |
| EAAAKGSS | 3342 |
| GSSPAP | 3343 |
| PAPGSS | 3344 |
| EAAAKPAP | 3345 |
| PAPEAAAK | 3346 |
| GGSGGGGSS | 3347 |
| GGSGSSGGG | 3348 |
| GGGGSGSS | 3349 |
| GGGGSSGGS | 3350 |
| GSSGGSGGG | 3351 |
| GSSGGGGGS | 3352 |

TABLE 13-continued

Exemplary linker sequences

| Amino Acid Sequence | SEQ ID NO: |
|---|---|
| GGSGGGEAAAK | 3353 |
| GGSEAAAKGGG | 3354 |
| GGGGGSEAAAK | 3355 |
| GGGEAAAKGGS | 3356 |
| EAAAKGGSGGG | 3357 |
| EAAAKGGGGGS | 3358 |
| GGSGGGPAP | 3359 |
| GGSPAPGGG | 3360 |
| GGGGGSPAP | 3361 |
| GGGPAPGGS | 3362 |
| PAPGGSGGG | 3363 |
| PAPGGGGGS | 3364 |
| GGSGSSEAAAK | 3365 |
| GGSEAAAKGSS | 3366 |
| GSSGGSEAAAK | 3367 |
| GSSEAAAKGGS | 3368 |
| EAAAKGGSGSS | 3369 |
| EAAAKGSSGGS | 3370 |
| GGSGSSPAP | 3371 |
| GGSPAPGSS | 3372 |
| GSSGGSPAP | 3373 |
| GSSPAPGGS | 3374 |
| PAPGGSGSS | 3375 |
| PAPGSSGGS | 3376 |
| GGSEAAAKPAP | 3377 |
| GGSPAPEAAAK | 3378 |
| EAAAKGGSPAP | 3379 |
| EAAAKPAPGGS | 3380 |
| PAPGGSEAAAK | 3381 |
| PAPEAAAKGGS | 3382 |
| GGGGSSEAAAK | 3383 |
| GGGEAAAKGSS | 3384 |
| GSSGGGEAAAK | 3385 |
| GSSEAAAKGGG | 3386 |
| EAAAKGGGGSS | 3387 |
| EAAAKGSSGGG | 3388 |
| GGGGSSPAP | 3389 |

TABLE 13-continued

Exemplary linker sequences

| Amino Acid Sequence | SEQ ID NO: |
|---|---|
| GGGPAPGSS | 3390 |
| GSSGGGPAP | 3391 |
| GSSPAPGGG | 3392 |
| PAPGGGGSS | 3393 |
| PAPGSSGGG | 3394 |
| GGGEAAAKPAP | 3395 |
| GGGPAPEAAAK | 3396 |
| EAAAKGGGPAP | 3397 |
| EAAAKPAPGGG | 3398 |
| PAPGGGEAAAK | 3399 |
| PAPEAAAKGGG | 3400 |
| GSSEAAAKPAP | 3401 |
| GSSPAPEAAAK | 3402 |
| EAAAKGSSPAP | 3403 |
| EAAAKPAPGSS | 3404 |
| PAPGSSEAAAK | 3405 |
| PAPEAAAKGSS | 3406 |
| AEAAAKEAAAKEAAAKEAAAKALEAEAAAKEAAAKEAAAKEAAAKA | 3407 |
| GGGGSEAAAKGGGGS | 3408 |
| EAAAKGGGGSEAAAK | 3409 |
| SGSETPGTSESATPES | 1023 |
| GSAGSAAGSGEF | 3410 |
| SGGSSGGSSGSETPGTSESATPESSGGSSGGSS | 1589 |

In some embodiments, a GENE WRITER™ polypeptide comprises a dCas9 sequence comprising a D10A and/or H840A mutation, e.g., the following sequence:

(SEQ ID NO: 1590)
SMDKKYSIGLAIGTNSVGWAVITDDYKVPSKKFKVLGNTDRHSIKKNLIG

ALLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEEN

PINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDA

ILLSDILRVNTEITKAPLSASMIKRYDEHHQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTNFD

```
-continued
KNLPNEKVLPKHSLLYEYFTVYNELTKVKYVTEGMRKPAFLSGEQKKAIV

DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGRLSRKLINGIRDKQSGKTILDFLKSDGFANRNFMQLIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLQNGRDMYVDQELDINRLSDYDVDAIVPQSFLKD

DSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD
```

In some embodiments, a template RNA molecule for use in the system comprises, from 5' to 3' (1) a gRNA spacer; (2) a gRNA scaffold; (3) heterologous object sequence (4) 3' homology domain. In some embodiments:
  (1) Is a Cas9 spacer of ~18-22 nt, e.g., is 20 nt
  (2) Is a gRNA scaffold comprising one or more hairpin loops, e.g., 1, 2, of 3 loopd for associating the template with a nickase Cas9 domain. In some embodiments, the gRNA scaffold carries the sequence, from 5' to 3',

```
                                        (SEQ ID NO: 1591)
GTTTTAGAGCTAGAAATAGCAAGTTAAAATAAGGCTAGTCCGTTATCAAC

TTGAAAAAGTGGGACCGAGTCGGTCC.
```

(3) In some embodiments, the heterologous object sequence is, e.g., 7-74, e.g., 10-20, 20-30, 30-40, 40-50, 50-60, 60-70, or 70-80 nt or, 80-90 nt in length. In some embodiments, the first (most 5') base of the sequence is not C.
  (4) In some embodiments, the 3' homology domain that binds the target priming sequence after nicking occurs is e.g., 3-20 nt, e.g., 7-15 nt, e.g., 12-14 nt. In some embodiments, the 3' homology domain has 40-60% GC content.

A second gRNA associated with the system may help drive complete integration. In some embodiments, the second gRNA may target a location that is 0-200 nt away from the first-strand nick, e.g., 0-50, 50-100, 100-200 nt away from the first-strand nick. In some embodiments, the second gRNA can only bind its target sequence after the edit is made, e.g., the gRNA binds a sequence present in the heterologous object sequence, but not in the initial target sequence.

In some embodiments, a GENE WRITING™ system described herein is used to make an edit in HEK293, K562, U2OS, or HeLa cells. In some embodiment, a GENE WRIT-ING™ system is used to make an edit in primary cells, e.g., primary cortical neurons from E18.5 mice.

In some embodiments, a reverse transcriptase or RT domain (e.g., as described herein) comprises a MoMLV RT sequence or variant thereof. In embodiments, the MoMLV RT sequence comprises one or more mutations selected from D200N, L603W, T330P, T306K, W313F, D524G, E562Q, D583N, P51L, S67R, E67K, T197A, H204R, E302K, F309N, L435G, N454K, H594Q, D653N, R110S, and K103L. In embodiments, the MoMLV RT sequence comprises a combination of mutations, such as D200N, L603W, and T330P, optionally further including T306K and/or W313F.

In some embodiments, an endonuclease domain (e.g., as described herein) comprises nCAS9, e.g., comprising the H840A mutation.

In some embodiments, the heterologous object sequence (e.g., of a system as described herein) is about 1-50, 50-100, 100-200, 200-300, 300-400, 400-500, 500-600, 600-700, 700-800, 800-900, 900-1000, or more, nucleotides in length.

In some embodiments, the RT and endonuclease domains are joined by a flexible linker, e.g., comprising the amino acid sequence SGGSSGGSSGSETPGTSESAT-PESSGGSSGGSS (SEQ ID NO: 1589).

In some embodiments, the endonuclease domain is N-terminal relative to the RT domain. In some embodiments, the endonuclease domain is C-terminal relative to the RT domain.

In some embodiments, the system incorporates a heterologous object sequence into a target site by TPRT, e.g., as described herein.

In some embodiments, a system or method described herein involves a CRISPR DNA targeting enzyme or system described in US Pat. App. Pub. No. 20200063126, 20190002889, or 20190002875 (each of which is incorporated by reference herein in its entirety) or a functional fragment or variant thereof. For instance, in some embodiments, a GeneWriter polypeptide or Cas endonuclease described herein comprises a polypeptide sequence of any of the applications mentioned in this paragraph, and in some embodiments a template RNA or guide RNA comprises a nucleic acid sequence of any of the applications mentioned in this paragraph.

In some embodiments, an endonuclease domain or DNA-binding domain comprises a TAL effector molecule. A TAL effector molecule, e.g., a TAL effector molecule that specifically binds a DNA sequence, typically comprises a plurality of TAL effector domains or fragments thereof, and optionally one or more additional portions of naturally occurring TAL effectors (e.g., N- and/or C-terminal of the plurality of TAL effector domains). Many TAL effectors are known to those of skill in the art and are commercially available, e.g., from Thermo Fisher Scientific.

Naturally occurring TALEs are natural effector proteins secreted by numerous species of bacterial pathogens including the plant pathogen *Xanthomonas* which modulates gene expression in host plants and facilitates bacterial colonization and survival. The specific binding of TAL effectors is based on a central repeat domain of tandemly arranged nearly identical repeats of typically 33 or 34 amino acids (the repeat-variable di-residues, RVD domain).

Members of the TAL effectors family differ mainly in the number and order of their repeats. The number of repeats typically ranges from 1.5 to 33.5 repeats and the C-terminal repeat is usually shorter in length (e.g., about 20 amino acids) and is generally referred to as a "half-repeat". Each repeat of the TAL effector generally features a one-repeatto-one-base-pair correlation with different repeat types exhibiting different base-pair specificity (one repeat recognizes one base-pair on the target gene sequence). Generally, the smaller the number of repeats, the weaker the protein-DNA interactions. A number of 6.5 repeats has been shown to be sufficient to activate transcription of a reporter gene (Scholze et al., 2010).

Repeat to repeat variations occur predominantly at amino acid positions 12 and 13, which have therefore been termed "hypervariable" and which are responsible for the specificity of the interaction with the target DNA promoter sequence, as shown in Table 14 listing exemplary repeat variable diresidues (RVD) and their correspondence to nucleic acid base targets.

TABLE 14

RVDs and Nucleic Acid Base Specificity

| Target | Possible RVD Amino Acid Combinations |
|---|---|
| A | NI NN CI HI KI |
| G | NN GN SN VN LN DN QN EN HN RH NK AN FN |
| C | HD RD KD ND AD |
| T | NG HG VG IG EG MG YG AA EP VA QG KG RG |

Accordingly, it is possible to modify the repeats of a TAL effector to target specific DNA sequences. Further studies have shown that the RVD NK can target G. Target sites of TAL effectors also tend to include a T flanking the 5' base targeted by the first repeat, but the exact mechanism of this recognition is not known. More than 113 TAL effector sequences are known to date. Non-limiting examples of TAL effectors from *Xanthomonas* include, Hax2, Hax3, Hax4, AvrXa7, AvrXa10 and AvrBs3.

Accordingly, the TAL effector domain of a TAL effector molecule described herein may be derived from a TAL effector from any bacterial species (e.g., *Xanthomonas* species such as the African strain of *Xanthomonas oryzae* pv. *Oryzae* (Yu et al. 2011), *Xanthomonas campestris* pv. *raphani* strain 756C and *Xanthomonas oryzae* pv. *oryzicola* strain BLS256 (Bogdanove et al. 2011). In some embodiments, the TAL effector domain comprises an RVD domain as well as flanking sequence(s) (sequences on the N-terminal and/or C-terminal side of the RVD domain) also from the naturally occurring TAL effector. It may comprise more or fewer repeats than the RVD of the naturally occurring TAL effector. The TAL effector molecule can be designed to target a given DNA sequence based on the above code and others known in the art. The number of TAL effector domains (e.g., repeats (monomers or modules)) and their specific sequence can be selected based on the desired DNA target sequence. For example, TAL effector domains, e.g., repeats, may be removed or added in order to suit a specific target sequence. In an embodiment, the TAL effector molecule of the present invention comprises between 6.5 and 33.5 TAL effector domains, e.g., repeats. In an embodiment, TAL effector molecule of the present invention comprises between 8 and 33.5 TAL effector domains, e.g., repeats, e.g., between 10 and 25 TAL effector domains, e.g., repeats, e.g., between 10 and 14 TAL effector domains, e.g., repeats.

In some embodiments, the TAL effector molecule comprises TAL effector domains that correspond to a perfect match to the DNA target sequence. In some embodiments, a mismatch between a repeat and a target base-pair on the DNA target sequence is permitted as along as it allows for the function of the polypeptide comprising the TAL effector molecule. In general, TALE binding is inversely correlated with the number of mismatches. In some embodiments, the TAL effector molecule of a polypeptide of the present invention comprises no more than 7 mismatches, 6 mismatches, 5 mismatches, 4 mismatches, 3 mismatches, 2 mismatches, or 1 mismatch, and optionally no mismatch, with the target DNA sequence. Without wishing to be bound by theory, in general the smaller the number of TAL effector domains in the TAL effector molecule, the smaller the number of mismatches will be tolerated and still allow for the function of the polypeptide comprising the TAL effector molecule. The binding affinity is thought to depend on the sum of matching repeat-DNA combinations. For example, TAL effector molecules having 25 TAL effector domains or more may be able to tolerate up to 7 mismatches.

In addition to the TAL effector domains, the TAL effector molecule of the present invention may comprise additional sequences derived from a naturally occurring TAL effector. The length of the C-terminal and/or N-terminal sequence(s) included on each side of the TAL effector domain portion of the TAL effector molecule can vary and be selected by one skilled in the art, for example based on the studies of Zhang et al. (2011). Zhang et al., have characterized a number of C-terminal and N-terminal truncation mutants in Hax3 derived TAL-effector based proteins and have identified key elements, which contribute to optimal binding to the target sequence and thus activation of transcription. Generally, it was found that transcriptional activity is inversely correlated with the length of N-terminus. Regarding the C-terminus, an important element for DNA binding residues within the first 68 amino acids of the Hax 3 sequence was identified. Accordingly, in some embodiments, the first 68 amino acids on the C-terminal side of the TAL effector domains of the naturally occurring TAL effector is included in the TAL effector molecule. Accordingly, in an embodiment, a TAL effector molecule comprises 1) one or more TAL effector domains derived from a naturally occurring TAL effector; 2) at least 70, 80, 90, 100, 110, 120, 130, 140, 150, 170, 180, 190, 200, 220, 230, 240, 250, 260, 270, 280 or more amino acids from the naturally occurring TAL effector on the N-terminal side of the TAL effector domains; and/or 3) at least 68, 80, 90, 100, 110, 120, 130, 140, 150, 170, 180, 190, 200, 220, 230, 240, 250, 260 or more amino acids from the naturally occurring TAL effector on the C-terminal side of the TAL effector domains.

In some embodiments, an endonuclease domain or DNA-binding domain is or comprises a Zn finger molecule. A Zn finger molecule comprises a Zn finger protein, e.g., a naturally occurring Zn finger protein or engineered Zn finger protein, or fragment thereof. Many Zn finger proteins are known to those of skill in the art and are commercially available, e.g., from Sigma-Aldrich.

In some embodiments, a Zn finger molecule comprises a non-naturally occurring Zn finger protein that is engineered to bind to a target DNA sequence of choice. See, for example, Beerli, et al. (2002) Nature Biotechnol. 20:135-141; Pabo, et al. (2001) Ann. Rev. Biochem. 70:313-340; Isalan, et al. (2001) Nature Biotechnol. 19:656-660; Segal, et al. (2001) Curr. Opin. Biotechnol. 12:632-637; Choo, et al. (2000) Curr. Opin. Struct. Biol. 10:411-416; U.S. Pat. Nos. 6,453,242; 6,534,261; 6,599,692; 6,503,717; 6,689,558; 7,030,215; 6,794,136; 7,067,317; 7,262,054; 7,070,934; 7,361,635; 7,253,273; and U.S. Patent Publication Nos. 2005/0064474; 2007/0218528; 2005/0267061, all incorporated herein by reference in their entireties.

An engineered Zn finger protein may have a novel binding specificity, compared to a naturally-occurring Zn finger protein. Engineering methods include, but are not limited to, rational design and various types of selection. Rational design includes, for example, using databases comprising triplet (or quadruplet) nucleotide sequences and individual Zn finger amino acid sequences, in which each triplet or quadruplet nucleotide sequence is associated with one or more amino acid sequences of zinc fingers which bind the particular triplet or quadruplet sequence. See, for example, U.S. Pat. Nos. 6,453,242 and 6,534,261, incorporated by reference herein in their entireties.

Exemplary selection methods, including phage display and two-hybrid systems, are disclosed in U.S. Pat. Nos. 5,789,538; 5,925,523; 6,007,988; 6,013,453; 6,410,248; 6,140,466; 6,200,759; and 6,242,568; as well as International Patent Publication Nos. WO 98/37186; WO 98/53057; WO 00/27878; and WO 01/88197 and GB 2,338,237. In addition, enhancement of binding specificity for zinc finger proteins has been described, for example, in International Patent Publication No. WO 02/077227.

In addition, as disclosed in these and other references, zinc finger domains and/or multi-fingered zinc finger proteins may be linked together using any suitable linker sequences, including for example, linkers of 5 or more amino acids in length. Sec, also, U.S. Pat. Nos. 6,479,626; 6,903,185; and 7,153,949 for exemplary linker sequences 6 or more amino acids in length. The proteins described herein may include any combination of suitable linkers between the individual zinc fingers of the protein. In addition, enhancement of binding specificity for zinc finger binding domains has been described, for example, in co-owned International Patent Publication No. WO 02/077227.

Zn finger proteins and methods for design and construction of fusion proteins (and polynucleotides encoding same) are known to those of skill in the art and described in detail in U.S. Pat. Nos. 6,140,0815; 789,538; 6,453,242; 6,534, 261; 5,925,523; 6,007,988; 6,013,453; and 6,200,759; International Patent Publication Nos. WO 95/19431; WO 96/06166; WO 98/53057; WO 98/54311; WO 00/27878; WO 01/60970; WO 01/88197; WO 02/099084; WO 98/53058; WO 98/53059; WO 98/53060; WO 02/016536; and WO 03/016496.

In addition, as disclosed in these and other references, Zn finger proteins and/or multi-fingered Zn finger proteins may be linked together, e.g., as a fusion protein, using any suitable linker sequences, including for example, linkers of 5 or more amino acids in length. See, also, U.S. Pat. Nos. 6,479,626; 6,903,185; and 7,153,949 for exemplary linker sequences 6 or more amino acids in length. The Zn finger molecules described herein may include any combination of suitable linkers between the individual zinc finger proteins and/or multi-fingered Zn finger proteins of the Zn finger molecule.

In certain embodiments, the DNA-binding domain or endonuclease domain comprises a Zn finger molecule comprising an engineered zinc finger protein that binds (in a sequence-specific manner) to a target DNA sequence. In some embodiments, the Zn finger molecule comprises one Zn finger protein or fragment thereof. In other embodiments, the Zn finger molecule comprises a plurality of Zn finger proteins (or fragments thereof), e.g., 2, 3, 4, 5, 6 or more Zn finger proteins (and optionally no more than 12, 11, 10, 9, 8, 7, 6, 5, 4, 3, or 2 Zn finger proteins). In some embodiments, the Zn finger molecule comprises at least three Zn finger proteins. In some embodiments, the Zn finger molecule comprises four, five or six fingers. In some embodiments, the Zn finger molecule comprises 8, 9, 10, 11 or 12 fingers. In some embodiments, a Zn finger molecule comprising three Zn finger proteins recognizes a target DNA sequence comprising 9 or 10 nucleotides. In some embodiments, a Zn finger molecule comprising four Zn finger proteins recognizes a target DNA sequence comprising 12 to 14 nucleotides. In some embodiments, a Zn finger molecule comprising six Zn finger proteins recognizes a target DNA sequence comprising 18 to 21 nucleotides.

In some embodiments, a Zn finger molecule comprises a two-handed Zn finger protein. Two handed zinc finger proteins are those proteins in which two clusters of zinc finger proteins are separated by intervening amino acids so that the two zinc finger domains bind to two discontinuous target DNA sequences. An example of a two handed type of zinc finger binding protein is SIP1, where a cluster of four zinc finger proteins is located at the amino terminus of the protein and a cluster of three Zn finger proteins is located at the carboxyl terminus (see Remade, et al. (1999) EMBO Journal 18 (18): 5073-5084). Each cluster of zinc fingers in these proteins is able to bind to a unique target sequence and the spacing between the two target sequences can comprise many nucleotides.

DNA Binding Domain:

In certain aspects, the DNA-binding domain of a GENE WRITER™ polypeptide described herein is selected, designed, or constructed for binding to a desired host DNA target sequence.

In some embodiments, a GENE WRITER™ polypeptide comprises a modification to a DNA-binding domain, e.g., relative to the wild-type polypeptide. In some embodiments, the DNA-binding domain comprises an addition, deletion, replacement, or modification to the amino acid sequence of the original DNA-binding domain. In some embodiments, the DNA-binding domain is modified to include a heterologous functional domain that binds specifically to a target nucleic acid (e.g., DNA) sequence of interest. In some embodiments, the functional domain replaces at least a portion (e.g., the entirety of) the prior DNA-binding domain of the polypeptide. In some embodiments, the functional domain comprises a zinc finger (e.g., a zinc finger that specifically binds to the target nucleic acid (e.g., DNA) sequence of interest. In some embodiments, the functional domain comprises a Cas domain (e.g., a Cas domain that specifically binds to the target nucleic acid (e.g., DNA) sequence of interest. In embodiments, the Cas domain comprises a Cas9 or a mutant or variant thereof (e.g., as described herein). In embodiments, the Cas domain is associated with a guide RNA (gRNA), e.g., as described herein. In embodiments, the Cas domain is directed to a target nucleic acid (e.g., DNA) sequence of interest by the gRNA. In embodiments, the Cas domain is encoded in the same nucleic acid (e.g., RNA) molecule as the gRNA. In embodiments, the Cas domain is encoded in a different nucleic acid (e.g., RNA) molecule from the gRNA.

In certain embodiments, the DNA-binding domain of the polypeptide is a heterologous DNA-binding protein or domain relative to a native retrotransposon sequence. In some embodiments the heterologous DNA binding element is a zinc-finger element or a TAL effector element, e.g., a zinc-finger or TAL polypeptide or functional fragment thereof. In some embodiments the heterologous DNA binding element is a sequence-guided DNA binding element, such as Cas9, Cpf1, or other CRISPR-related protein that has been altered to have no endonuclease activity. In some embodiments the heterologous DNA binding element retains endonuclease activity. In some embodiments, the heterologous DNA binding element retains partial endonuclease activity to cleave ssDNA, e.g., possesses nickase activity. In some embodiments the heterologous DNA binding element replaces the endonuclease element of the polypeptide. In specific embodiments, the heterologous DNA-binding domain can be any one or more of Cas9, TAL domain, ZF domain, Myb domain, combinations thereof, or multiples thereof. In certain embodiments, the heterologous DNA-binding domain is a DNA binding domain of a retrotransposon or virus described in Table 2 or Table 4. A person having ordinary skill in the art is capable of identifying DNA binding domains based upon homology to other known DNA binding domains using tools as Basic Local Alignment Search Tool (BLAST). In still other embodiments, DNA-binding domains are modified, for example by site-specific mutation, increasing or decreasing DNA-binding elements (for example, number and/or specificity of zinc fingers), etc., to alter DNA-binding specificity and affinity. In some embodiments the DNA binding domain is altered from its natural sequence to have altered codon usage, e.g. improved for human cells In some embodiments, the DNA binding domain comprises a meganuclease domain (e.g., as described herein, e.g., in the endonuclease domain section), or a functional fragment thereof. In some embodiments, the meganuclease domain possesses endonuclease activity, e.g., double-strand cleavage and/or nickase activity. In other embodiments, the meganuclease domain has reduced activity, e.g., lacks endonuclease activity, e.g., the meganuclease is catalytically inactive. In some embodiments, a catalytically inactive meganuclease is used as a DNA binding domain, e.g., as described in Fonfara et al. Nucleic Acids Res 40 (2): 847-860 (2012), incorporated herein by reference in its entirety. In embodiments, the DNA binding domain comprises one or more modifications relative to a wild-type DNA binding domain, e.g., a modification via directed evolution, e.g., phage-assisted continuous evolution (PACE).

In certain aspects of the present invention, the host DNA-binding site integrated into by the GENE WRITER™ system can be in a gene, in an intron, in an exon, an ORF, outside of a coding region of any gene, in a regulatory region of a gene, or outside of a regulatory region of a gene. In other aspects, the polypeptide may bind to one or more than one host DNA sequence.

In some embodiments, a GENE WRITING™ system is used to edit a target locus in multiple alleles. In some embodiments, a GENE WRITING™ system is designed to edit a specific allele. For example, a GENE WRITING™ polypeptide may be directed to a specific sequence that is only present on one allele, e.g., comprises a template RNA with homology to a target allele, e.g., a gRNA or annealing domain, but not to a second cognate allele. In some embodiments, a GENE WRITING™ system can alter a haplotype-specific allele. In some embodiments, a GENE WRITING™ system that targets a specific allele preferentially targets that allele, e.g., has at least a 2, 4, 6, 8, or 10-fold preference for a target allele.

In certain embodiments, a GENE WRITER™ gene editor system RNA further comprises an intracellular localization sequence, e.g., a nuclear localization sequence. The nuclear localization sequence may be an RNA sequence that promotes the import of the RNA into the nucleus. In certain embodiments the nuclear localization signal is located on the template RNA. In certain embodiments, the retrotransposase polypeptide is encoded on a first RNA, and the template RNA is a second, separate, RNA, and the nuclear localization signal is located on the template RNA and not on an RNA encoding the retrotransposase polypeptide. While not wishing to be bound by theory, in some embodiments, the RNA encoding the retrotransposase is targeted primarily to the cytoplasm to promote its translation, while the template RNA is targeted primarily to the nucleus to promote its retrotransposition into the genome. In some embodiments the nuclear localization signal is at the 3' end, 5' end, or in an internal region of the template RNA. In some embodiments the nuclear localization signal is 3' of the heterologous sequence (e.g., is directly 3' of the heterologous sequence) or is 5' of the heterologous sequence (e.g., is directly 5' of the heterologous sequence). In some embodiments the nuclear localization signal is placed outside of the 5' UTR or outside of the 3' UTR of the template RNA. In some embodiments the nuclear localization signal is placed between the 5' UTR and the 3' UTR, wherein optionally the nuclear localization signal is not transcribed with the transgene (e.g., the nuclear localization signal is an anti-sense orientation or is downstream of a transcriptional termination signal or polyadenylation signal). In some embodiments the nuclear localization sequence is situated inside of an intron. In some embodiments a plurality of the same or different nuclear localization signals are in the RNA, e.g., in the template RNA. In some embodiments the nuclear localization signal is less than 5, 10, 25, 50, 75, 100, 150, 200, 250, 300, 350, 400, 450, 500, 600, 700, 800, 900 or 1000 bp in legnth. Various RNA nuclear localization sequences can be used. For example, Lubelsky and Ulitsky, Nature 555 (107-111), 2018 describe RNA sequences which drive RNA localization into the nucleus. In some embodiments, the nuclear localization signal is a SINE-derived nuclear RNA localization (SIRLOIN) signal. In some embodiments the nuclear localization signal binds a nuclear-enriched protein. In some embodiments the nuclear localization signal binds the HNRNPK protein. In some embodiments the nuclear localization signal is rich in pyrimidines, e.g., is a C/T rich, C/U rich, C rich, T rich, or U rich region. In some embodiments the nuclear localization signal is derived from a long non-coding RNA. In some embodiments the nuclear localization signal is derived from MALAT1 long non-coding RNA or is the 600 nucleotide M region of MALAT1 (described in Miyagawa et al., RNA 18, (738-751), 2012). In some embodiments the nuclear localization signal is derived from BORG long non-coding RNA or is a AGCCC motif (described in Zhang et al., *Molecular and Cellular Biology* 34, 2318-2329 (2014). In some embodiments the nuclear localization sequence is described in Shukla et al., The EMBO Journal e98452 (2018). In some embodiments the nuclear localization signal is derived from a non-LTR retrotransposon, an LTR retrotransposon, retrovirus, or an endogenous retrovirus.

In some embodiments, a polypeptide described herein herein comprises one or more (e.g., 2, 3, 4, 5) nuclear targeting sequences, for example a nuclear localization sequence (NLS). In some embodiments, the NLS is a bipartite NLS. In some embodiments, an NLS facilitates the import of a protein comprising an NLS into the cell nucleus. In some embodiments, the NLS is fused to the N-terminus of a GENE WRITER™ described herein. In some embodiments, the NLS is fused to the C-terminus of the GENE WRITER™. In some embodiments, the NLS is fused to the N-terminus or the C-terminus of a Cas domain. In some embodiments, a linker sequence is disposed between the NLS and the neighboring domain of the GENE WRITER™.

In some embodiments, an NLS comprises the amino acid sequence MDSLLMNRRKFLYQFKNVRWAKGRRE-TYLC (SEQ ID NO: 1592), PKKRKVEGADKR-TADGSEFESPKKKRKV (SEQ ID NO: 1593), RKSGKI-AAIWKRPRKPKKKRKV (SEQ ID NO: 1594), KRTADGSEFESPKKKRKV (SEQ ID NO: 1595), KKTELQTTNAENKTKKL (SEQ ID NO: 1596), or KRGINDRNFWRGENGRKTR (SEQ ID NO: 1597), KRPAATKKAGQAKKKK (SEQ ID NO: 1598), or a functional fragment or variant thereof. Exemplary NLS sequences are also described in PCT/EP2000/011690, the contents of which are incorporated herein by reference for their disclosure of exemplary nuclear localization sequences. In some embodiments, an NLS comprises an amino acid sequence as disclosed in Table 15. An NLS of this table may be utilized with one or more copies in a polypeptide in one or more locations in a polypeptide, e.g., 1, 2, 3 or more copies of an NLS in an N-terminal domain, between peptide domains, in a C-terminal domain, or in a combination of locations, in order to improve subcellular localization to the nucleus. Multiple unique sequences may be used within a single polypeptide. Sequences may be naturally monopartite or bipartite, e.g., having one or two stretches of basic amino acids, or may be used as chimeric bipartite sequences. Sequence references correspond to UniProt accession numbers, except where indicated as SeqNLS for sequences mined using a subcellular localization prediction algorithm (Lin et al BMC Bioinformat 13:157 (2012), incorporated herein by reference in its entirety).

TABLE 15

Exemplary nuclear localization signals for use in Gene Writing ™ systems

| Sequence | SEQ ID NO: | Sequence References |
|---|---|---|
| AHFKISGEKRPSTDPGKKAK NPKKKKKKDP | 3411 | Q76IQ7 |
| AHRAKKMSKTHA | 3412 | P21827 |
| ASPEYVNLPINGNG | 3413 | SeqNLS |
| CTKRPRW | 3414 | O88622, Q86W56, Q9QYM2, O02776 |
| DKAKRVSRNKSEKKRR | 3415 | O15516, Q5RAK8, Q91YB2, Q91YB0, Q8QGQ6, O08785, Q9WVS9, Q6YGZ4 |
| EELRLKEELLKGIYA | 3416 | Q9QY16, Q9UHL0, Q2TBP1, Q9QY15 |
| EEQLRRRKNSRLNNTG | 3417 | G5EFF5 |
| EVLKVIRTGKRKKKAWKR MVTKVC | 3418 | SeqNLS |
| HHHHHHHHHHHHQPH | 3419 | Q63934, G3V7L5, Q12837 |
| HKKKHPDASVNFSEFSK | 3420 | P10103, Q4R844, P12682, B0CM99, A9RA84, Q6YKA4, P09429, P63159, Q08IE6, P63158, Q9YH06, B1MTB0 |
| HKRTKK | 3421 | Q2R2D5 |
| IINGRKLKLKKSRRRSSQTS NNSFTSRRS | 3422 | SeqNLS |
| KAEQERRK | 3423 | Q8LH59 |
| KEKRKRREELFIEQKKRK | 3424 | SeqNLS |
| KKGKDEWFSRGKKP | 3425 | P30999 |
| KKGPSVQKRKKT | 3426 | Q6ZN17 |
| KKKTVINDLLHYKKEK | 3427 | SeqNLS, P32354 |
| KKNGGKGKNKPSAKIKK | 3428 | SeqNLS |
| KKPKWDDFKKKKK | 3429 | Q15397, Q8BKS9, Q562C7 |
| KKRKKD | 3430 | SeqNLS, Q91Z62, Q1A730, Q969P5, Q2KHT6, Q9CPU7 |
| KKRRKRRRK | 3431 | SeqNLS |
| KKRRRRARK | 3432 | Q9UMS6, D4A702, Q91YE8 |
| KKSKRGR | 3433 | Q9UBS0 |
| KKSRKRGS | 3434 | B4FG96 |
| KKSTALSRELGKIMRRR | 3435 | SeqNLS, P32354 |
| KKSYQDPEIIAHSRPRK | 3436 | Q9U7C9 |

TABLE 15-continued

Exemplary nuclear localization signals for use in Gene Writing ™ systems

| Sequence | SEQ ID NO: | Sequence References |
|---|---|---|
| KKTGKNRKLKSKRVKTR | 3437 | Q9Z301, O54943, Q8K3T2 |
| KKVSIAGQSGKLWRWKR | 3438 | Q6YUL8 |
| KKYENVVIKRSPRKRGRPRK | 3439 | SeqNLS |
| KNKKRK | 3440 | SeqNLS |
| KPKKKR | 3441 | SeqNLS |
| KRAMKDDSHGNSTSPKRRK | 3442 | Q0E671 |
| KRANSNLVAAYEKAKKK | 3443 | P23508 |
| KRASEDTTSGSPPKKSSAGPKR | 3444 | Q9BZZ5, Q5R644 |
| KRFKRRWMVRKMKTKK | 3445 | SeqNLS |
| KRGLNSSFETSPKKVK | 3446 | Q8IV63 |
| KRGNSSIGPNDLSKRKQRKK | 3447 | SeqNLS |
| KRIHSVSLSQSQIDPSKKVKRAK | 3448 | SeqNLS |
| KRKGKLKNKGSKRKK | 3449 | O15381 |
| KRRRRRRREKRKR | 3450 | Q96GM8 |
| KRSNDRTYSPEEEKQRRA | 3451 | Q91ZF2 |
| KRTVATNGDASGAHRAKKMSK | 3452 | SeqNLS |
| KRVYNKGEDEQEHLPKGKKR | 3453 | SeqNLS |
| KSGKAPRRRAVSMDNSNK | 3454 | Q9WVH4, O43524 |
| KVNFLDMSLDDIIIYKELE | 3455 | Q9P127 |
| KVQHRIAKKTTRRRR | 3456 | Q9DXE6 |
| LSPSLSPL | 3457 | Q9Y261, P32182, P35583 |
| MDSLLMNRRKFLYQFKNVRWAKGRRETYLC | 1735 | Q9GZX7 |
| MPQNEYIELHRKRYGYRLDYHEKKRKKESREAHERSKKAKKMIGLKAKLYHK | 3458 | SeqNLS |
| MVQLRPRASR | 3459 | SeqNLS |
| NNKLLAKRRKGGASPKDDPMDDIK | 3460 | Q965G5 |
| NYKRPMDGTYGPPAKRHEGE | 3461 | O14497, A2BH40 |
| PDTKRAKLDSSETTMVKKK | 3462 | SeqNLS |
| PEKRTKI | 3463 | SeqNLS |
| PGGRGKKK | 3464 | Q719N1, Q9UBP0, A2VDN5 |
| PGKMDKGEHRQERRDRPY | 3465 | Q01844, Q61545 |
| PKKGDKYDKTD | 3466 | Q45FA5 |
| PKKKSRK | 3467 | O35914, Q01954 |
| PKKNKPE | 3468 | Q22663 |
| PKKRAKV | 3469 | P04295, P89438 |

TABLE 15-continued

Exemplary nuclear localization signals for use in Gene Writing ™ systems

| Sequence | SEQ ID NO: | Sequence References |
|---|---|---|
| PKPKKLKVE | 3470 | P55263, P55262, P55264, Q64640 |
| PKRGRGR | 3471 | Q9FYS5, Q43386 |
| PKRRLVDDA | 3472 | P0C797 |
| PKRRRTY | 3473 | SeqNLS |
| PLFKRR | 3474 | A8X6H4, Q9TXJ0 |
| PLRKAKR | 3475 | Q86WB0, Q5R8V9 |
| PPAKRKCIF | 3476 | Q6AZ28, O75928, Q8C5D8 |
| PPARRRL | 3477 | Q8NAG6 |
| PPKKKRKV | 3478 | Q3L6L5, P03070, P14999, P03071 |
| PPNKRMKVKH | 3479 | Q8BN78 |
| PPRIYPQLPSAPT | 3480 | P0C799 |
| PQRSPFPKSSVKR | 3481 | SeqNLS |
| PRPRKVPR | 3482 | P0C799 |
| PRRRVQRKR | 3483 | SeqNLS, Q5R448, Q5TAQ9 |
| PRRVRLK | 3484 | Q58DJ0, P56477, Q13568 |
| PSRKRPR | 3485 | Q62315, Q5F363, Q92833 |
| PSSKKRKV | 3486 | SeqNLS |
| PTKKRVK | 3487 | P07664 |
| QRPGPYDRP | 3488 | SeqNLS |
| RGKGGKGLGKGGAKRHRK | 3489 | SeqNLS |
| RKAGKGGGHKTTKKRSAKDEKVP | 3490 | B4FG96 |
| RKIKLKRAK | 3491 | A1L3G9 |
| RKIKRKRAK | 3492 | B9X187 |
| RKKEAPGPREELRSRGR | 3493 | O35126, P54258, Q5IS70, P54259 |
| RKKRKGK | 3494 | SeqNLS, Q29243, Q62165, Q28685, O18738, Q9TSZ6, Q14118 |
| RKKRRQRRR | 3495 | P04326, P69697, P69698, P05907, P20879, P04613, P19553, P0C1J9, P20893, P12506, P04612, Q73370, P0C1K0, P05906, P35965, P04609, P04610, P04614, P04608, P05905 |
| RKKSIPLSIKNLKRKHKRKKNKITR | 3496 | Q9C0C9 |
| RKLVKPKNTKMKTKLRTNPY | 3497 | Q14190 |
| RKRLILSDKGQLDWKK | 3498 | SeqNLS, Q91Z62, Q1A730, Q2KHT6, Q9CPU7 |
| RKRLKSK | 3499 | Q13309 |

TABLE 15-continued

Exemplary nuclear localization signals for use in Gene Writing ™ systems

| Sequence | SEQ ID NO: | Sequence References |
|---|---|---|
| RKRRVRDNM | 3500 | Q8QPH4, Q809M7, A8C8X1, Q2VNC5, Q38SQ0, O89749, Q6DNQ9, Q809L9, Q0A429, Q20NV3, P16509, P16505, Q6DNQ5, P16506, Q6XT06, P26118, Q2ICQ2, Q2RCG8, Q0A2D0, Q0A2H9, Q9IQ46, Q809M3, Q6J847, Q6J856, B4URE4, A4GCM7, Q0A440, P26120, P16511, |
| RKRSPKDKKEKDLDGAGKRRKT | 3501 | Q7RTP6 |
| RKRTPRVDGQTGENDMNKRRRK | 3502 | O94851 |
| RLPVRRRRR | 3503 | P04499, P12541, P03269, P48313, P03270 |
| RLRFRKPKSK | 3504 | P69469 |
| RQQRKR | 3505 | Q14980 |
| RRDLNSSFETSPKKVK | 3506 | Q8K3G5 |
| RRDRAKLR | 3507 | Q9SLB8 |
| RRGDGRRR | 3508 | Q80WE1, Q5R9B4, Q06787, P35922 |
| RRGRKRKAEKQ | 3509 | Q812D1, Q5XXA9, Q99JF8, Q8MJG1, Q66T72, O75475 |
| RRKKRR | 3510 | Q0VD86, Q58DS6, Q5R6G2, Q9ERI5, Q6AYK2, Q6NYC1 |
| RRKRSKSEDMDSVESKRRR | 3511 | Q7TT18 |
| RRKRSR | 3512 | Q99PU7, D3ZHS6, Q92560, A2VDM8 |
| RRPKGKTLQKRKPK | 3513 | Q6ZN17 |
| RRRGFERFGPDNMGRKRK | 3514 | Q63014, Q9DBR0 |
| RRRGKNKVAAQNCRK | 3515 | SeqNLS |
| RRRKRR | 3516 | Q5FVH8, Q6MZT1, Q08DH5, Q8BQP9 |
| RRRQKQKGGASRRR | 3517 | SeqNLS |
| RRRREGPRARRRR | 3518 | P08313, P10231 |
| RRTIRLKLVYDKCDRSCKIQKKNRNKCQYCRFHKCLSVGMSHNAIRFGRMPRSEKAKLKAE | 3519 | SeqNLS |
| RRVPQRKEVSRCRKCRK | 3520 | Q5RJN4, Q32L09, Q8CAK3, Q9NUL5 |
| RVGGRRQAVECIEDLLNEPGQPLDLSCKRPRP | 3521 | P03255 |
| RVVKLRIAP | 3522 | P52639, Q8JMN0 |
| RVVRRR | 3523 | P70278 |
| SKRKTKISRKTR | 3524 | Q5RAY1, O00443 |
| SYVKTVPNRTRTYIKL | 3525 | P21935 |
| TGKNEAKKRKIA | 3526 | P52739, Q8K3J5, Q5RAU9 |
| TLSPASSPSSVSCPVIPASTDESPGSALNI | 3527 | SeqNLS |
| VSKKQRTGKKIH | 3528 | P52739, Q8K3J5, Q5RAU9 |

TABLE 15-continued

Exemplary nuclear localization signals for use in Gene Writing ™ systems

| Sequence | SEQ ID NO: | Sequence References |
|---|---|---|
| SPKKKRKVE | 3529 | |
| KRTAD GSEFE SPKKKRKVE | 3530 | |
| PAAKRVKLD | 3531 | |
| PKKKRKV | 3532 | |
| MDSLLMNRRKFLYQFKNVR WAKGRRETYLC | 1735 | |
| SPKKKRKVEAS | 3533 | |
| MAPKKKRKVGIHRGVP | 3534 | |

In some embodiments, the NLS is a bipartite NLS. A bipartite NLS typically comprises two basic amino acid clusters separated by a spacer sequence (which may be, e.g., about 10 amino acids in length). A monopartite NLS typically lacks a spacer. An example of a bipartite NLS is the nucleoplasmin NLS, having the sequence KR[PAATKK-AGQA]KKKK (SEQ ID NO: 1598), wherein the spacer is bracketed. Another exemplary bipartite NLS has the sequence PKKKRKVEGADKRTADGSEFESPKKKRKV (SEQ ID NO: 1600). Exemplary NLSs are described in International Application WO2020051561, which is herein incorporated by reference in its entirety, including for its disclosures regarding nuclear localization sequences.

In certain embodiments, a GENE WRITER™ gene editor system polypeptide further comprises an intracellular localization sequence, e.g., a nuclear localization sequence and/or a nucleolar localization sequence. The nuclear localization sequence and/or nucleolar localization sequence may be amino acid sequences that promote the import of the protein into the nucleus and/or nucleolus, where it can promote integration of heterologous sequence into the genome. In certain embodiments, a GENE WRITER™ gene editor system polypeptide (e.g., a retrotransposase, e.g., a polypeptide according to any of Tables 2 or 4 herein) further comprises a nucleolar localization sequence. In certain embodiments, the retrotransposase polypeptide is encoded on a first RNA, and the template RNA is a second, separate, RNA, and the nucleolar localization signal is encoded on the RNA encoding the retrotransposase polypeptide and not on the template RNA. In some embodiments, the nucleolar localization signal is located at the N-terminus, C-terminus, or in an internal region of the polypeptide. In some embodiments, a plurality of the same or different nucleolar localization signals are used. In some embodiments, the nuclear localization signal is less than 5, 10, 25, 50, 75, or 100 amino acids in length. Various polypeptide nucleolar localization signals can be used. For example, Yang et al., Journal of Biomedical Science 22, 33 (2015), describe a nuclear localization signal that also functions as a nucleolar localization signal. In some embodiments, the nucleolar localization signal may also be a nuclear localization signal. In some embodiments, the nucleolar localization signal may overlap with a nuclear localization signal. In some embodiments, the nucleolar localization signal may comprise a stretch of basic residues. In some embodiments, the nucleolar localization signal may be rich in arginine and lysine residues. In some embodiments, the nucleolar localization signal may be derived from a protein that is enriched in the nucleolus. In some embodiments, the nucleolar localization signal may be derived from a protein enriched at ribosomal RNA loci. In some embodiments, the nucleolar localization signal may be derived from a protein that binds rRNA. In some embodiments, the nucleolar localization signal may be derived from MSP58. In some embodiments, the nucleolar localization signal may be a monopartite motif. In some embodiments, the nucleolar localization signal may be a bipartite motif. In some embodiments, the nucleolar localization signal may consist of a multiple monopartite or bipartite motifs. In some embodiments, the nucleolar localization signal may consist of a mix of monopartite and bipartite motifs. In some embodiments, the nucleolar localization signal may be a dual bipartite motif. In some embodiments, the nucleolar localization motif may be a KRASSQALG-TIPKRRSSSRFIKRKK (SEQ ID NO: 1530). In some embodiments, the nucleolar localization signal may be derived from nuclear factor-ΚB-inducing kinase. In some embodiments, the nucleolar localization signal may be an RKKRKKK motif (SEQ ID NO: 1531) (described in Birbach et al., Journal of Cell Science, 117 (3615-3624), 2004).

In some embodiments, a nucleic acid described herein (e.g., an RNA encoding a GENE WRITER™ polypeptide, or a DNA encoding the RNA) comprises a microRNA binding site. In some embodiments, the microRNA binding site is used to increase the target-cell specificity of a GENE WRITER™ system. For instance, the microRNA binding site can be chosen on the basis that is is recognized by a miRNA that is present in a non-target cell type, but that is not present (or is present at a reduced level relative to the non-target cell) in a target cell type. Thus, when the RNA encoding the GENE WRITER™ polypeptide is present in a non-target cell, it would be bound by the miRNA, and when the RNA encoding the GENE WRITER™ polypeptide is present in a target cell, it would not be bound by the miRNA (or bound but at reduced levels relative to the non-target cell). While not wishing to be bound by theory, binding of the miRNA to the RNA encoding the Gene Writer™ polypeptide may reduce production of the GENE WRITER™ polypeptide, e.g., by degrading the mRNA encoding the polypeptide or by interfering with translation. Accordingly, in such embodiments the GENE WRITER™ would add to/edit the genome of target cells more efficiently than it edits the genome of non-target cells, e.g., the heterologous object sequence would be inserted into the genome of target cells more efficiently than into the genome of non-target cells, or an insertion or deletion is produced more efficiently in target cells than in non-target cells. A system having a microRNA binding site in the RNA encoding the GENE WRITER™ polypeptide (or encoded in the DNA encoding the RNA) may also be used in combination with a template RNA that is regulated by a second microRNA binding site, e.g., as described herein in the section entitled "Template RNA component of GENE WRITER™ gene editor system." In some embodiments, e.g., for liver indications, a miRNA is selected from Table 4 of WO2020014209, incorporated herein by reference.

In some embodiments, the DNA encoding a GENE WRITER™ polypeptide comprises a promoter sequence, e.g., a tissue specific promoter sequence. In some embodiments, the tissue-specific promoter is used to increase the target-cell specificity of a GENE WRITER™ system. For instance, the promoter can be chosen on the basis that it is active in a target cell type but not active in (or active at a lower level in) a non-target cell type. A system having a tissue-specific promoter sequence in the DNA of the polypeptide may also be used in combination with a microRNA binding site, e.g., in the template RNA or a nucleic acid encoding a GENE WRITER™ protein, e.g., as described herein. A system having a tissue-specific promoter sequence in the DNA encoding the GENE WRITER™ polypeptide may also be used in combination with a DNA encoding the RNA template driven by a tissue-specific promoter, e.g., to achieve higher levels of RNA template in target cells than in non-target cells. In some embodiments, e.g., for liver indications, a tissue-specific promoter is selected from Table 3 of WO2020014209, incorporated herein by reference.

A skilled artisan can, based on the Accession numbers and/or sequences provided in Tables 2 and 4, determine the nucleic acid and corresponding polypeptide sequences of each retrotransposon or virus, and domains thereof, e.g., by using routine sequence analysis tools as Basic Local Alignment Search Tool (BLAST) or CD-Search for conserved domain analysis. Other sequence analysis tools are known and can be found, e.g., at molbiol-tools.ca, for example, at molbiol-tools.ca/Motifs.htm.

Tables 2 and 4 herein provide the sequences of exemplary transposons or viruses, including the amino acid sequence(s) of the retrotransposase, reverse transcriptase, DNA-binding domain, and/or endonuclease domain; sequences of 5' and 3' untranslated regions to allow a polypeptide, e.g., the retrotransposase to bind the template RNA; and/or the full transposon nucleic acid sequence. In some embodiments, a 5' UTR contained in or referenced by Tables 2 and 4 allows a polypeptide, e.g., the retrotransposase, to bind the template RNA. In some embodiments, a 3' UTR contained in or referenced by Tables 2 and 4 allows a polypeptide, e.g., the retrotransposase, to bind the template RNA. Thus, in some embodiments, a polypeptide for use in any of the systems described herein can be a polypeptide of any of Tables 2 and 4 herein, or a sequence having at least 70%, 75%, 80%, 85%, 90%, 95%, 96%, 97%, 98%, or 99% identity thereto. In some embodiments, the system further comprises one or both of a 5' or 3' untranslated region contained in or referenced by Tables 2 and 4 (or a sequence having at least 70%, 75%, 80%, 85%, 90%, 95%, 96%, 97%, 98%, or 99% identity thereto), e.g., from the same transposon as the polypeptide referred to in the preceding sentence, as indicated in the same row of the same table. In some embodiments, the system comprises one or both of a 5' or 3' untranslated region contained in or referenced by Tables 2 and 4, e.g., a segment of the full transposon sequence that encodes an RNA that is capable of binding a retrotransposase, and/or the sub-sequence provided in the column entitled Predicted 5' UTR or Predicted 3' UTR.

In some embodiments, a system or method described herein involves a 3' UTR, 5' UTR, or both from a retrotransposon of Table 4. In some embodiments, the 3' UTR, 5' UTR, or both, has a sequence comprising a portion of the full retrotransposon DNA sequence shown in column 5 of Table 3 of International Application PCT/US2019/048607, which is incorporated by reference herein in its entirety, including Table 3. In some embodiments, the nucleic acid sequence or amino acid sequence has at least 70%, 75%, 80%, 85%, 90%, 95%, 96%, 97%, 98%, or 99% identity to the sequence in Table 3 of PCT/US2019/048607.

In some embodiments, a system or method described herein involves a nucleic acid sequence or amino acid sequence of a retrotransposon described in Table 1 or Table 2 of International Application PCT/US2019/048607, which is incorporated by reference herein in its entirety, including Tables 1 and 2. In some embodiments, the nucleic acid sequence or amino acid sequence has at least 70%, 75%, 80%, 85%, 90%, 95%, 96%, 97%, 98%, or 99% identity to 10 the sequence of a retrotransposon described in said Table 1 or Table 2 of PCT/US2019/048607.

In some embodiments, a polypeptide for use in any of the systems described herein can be a molecular reconstruction or ancestral reconstruction based upon the aligned polypeptide sequence of multiple retrotransposons. In some embodiments, a 5' or 3' untranslated region for use in any of the systems described herein can be a molecular reconstruction based upon the aligned 5' or 3' untranslated region of multiple retrotransposons. A skilled artisan can, based on the Accession numbers provided herein, align polypeptides or nucleic acid sequences, e.g., by using routine sequence analysis tools as Basic Local Alignment Search Tool (BLAST) or CD-Search for conserved domain analysis. Molecular reconstructions can be created based upon sequence consensus, e.g. using approaches described in Ivics et al., *Cell* 1997, 501-510; Wagstaff et al., *Molecular Biology and Evolution* 2013, 88-99. In some embodiments, the retrotransposon from which the 5' or 3' untranslated region or polypeptide is derived is a young or a recently active mobile element, as assessed via phylogenetic methods such as those described in Boissinot et al., *Molecular Biology and Evolution* 2000, 915-928.

Thermostable GENE WRITER™ Systems

While not wishing to be bound by theory, in some embodiments, retrotransposases that evolved in cold environments may not function as well at human body temperature. This application provides a number of thermostable GENE WRITER™ systems, including proteins derived from avian retrotransposases. Exemplary avian transposase sequences in Table 4 include those of *Taeniopygia guttata* (zebra finch; transposon name R2-1_TG), *Geospiza fortis* (medium ground finch; transposon name R2-1_Gfo), *Zonotrichia albicollis* (white-throated sparrow; transposon name R2-1_ZA), and *Tinamus guttatus* (white-throated tinamou; transposon name R2-1_TGut).

Thermostability may be measured, e.g., by testing the ability of a GENE WRITER™ to polymerize DNA in vitro at a high temperature (e.g., 37° C.) and a low temperature (e.g., 25° C.). Suitable conditions for assaying in vitro DNA polymerization activity (e.g., processivity) are described, e.g., in Bibillo and Eickbush, "High Processivity of the Reverse Transcriptase from a Non-long Terminal Repeat Retrotransposon" (2002) JBC 277, 34836-34845. In some embodiments, the thermostable GENE WRITER™ polypeptide has an activity, e.g., a DNA polymerization activity, at 37° C. that is no less than 70%, 75%, 80%, 85%, 90%, or 95% of its activity at 25° C. under otherwise similar conditions.

In some embodiments, a GENE WRITER™ polypeptide (e.g., a sequence of Table 2 or 4 or a sequence having at least 70%, 75%, 80%, 85%, 90%, 95%, 96%, 97%, 98%, or 99% identity thereto) is stable in a subject chosen from a mammal (e.g., human) or a bird. In some embodiments, a GENE WRITER™ polypeptide described herein is functional at 37° C. In some embodiments, a GENE WRITER™ polypeptide described herein has greater activity at 37° C. than it does at a lower temperature, e.g., at 30° C., 25° C., or 20° C. In some embodiments, a Gene Writer™ polypeptide described herein has greater activity in a human cell than in a zebrafish cell.

In some embodiments, a GENE WRITER™ polypeptide is active in a human cell cultured at 37° C., e.g., using an assay of Example 6 or Example 7 of PCT/US2019/048607 which are hereby incorporated by reference.

In some embodiments, the assay comprises steps of: (1) introducing HEK293T cells into one or more wells of 6.4 mm diameter, at 10,000 cells/well, (2) incubating the cells at 37° C. for 24 hr, (3) providing a transfection mixture comprising 0.5 µl if FuGENE® HD transfection reagent and 80 ng DNA (wherein the DNA is a plasmid comprising, in order, (a) CMV promoter, (b) 100 bp of sequence homologous to the 100 bp upstream of the target site, (c) sequence encoding a 5' untranslated region that binds the GENE WRITER™ protein, (d) sequence encoding the GENE WRITER™ protein, (e) sequence encoding a 3' untranslated region that binds the GENE WRITER™ protein (f) 100 bp of sequence homologous to the 100 bp downstream of the target site, and (g) BGH polyadenylation sequence) and 10 µl Opti-MEM and incubating for 15 min at room temperature, (4) adding the transfection mixture to the cells, (5) incubating the cells for 3 days, and (6) assaying integration of the exogenous sequence into a target locus (e.g., rDNA) in the cell genome, e.g., wherein one or more of the preceding steps are performed as described in Example 6 of PCT/US2019/048607 which is hereby incorporated by reference.

In some embodiments, the GENE WRITER™ polypeptide results in insertion of the heterologous object sequence (e.g., the GFP gene) into the target locus (e.g., rDNA) at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome. In some embodiments, a cell described herein (e.g., a cell comprising a heterologous sequence at a target insertion site) comprises the heterologous object sequence at an average copy number of at least 0.01, 0.025, 0.05, 0.075, 0.1, 0.15, 0.2, 0.25, 0.3, 0.4, 0.5, 0.75, 1, 1.25, 1.5, 1.75, 2, 2.5, 3, 4, or 5 copies per genome.

In some embodiments, a GENE WRITER™ causes integration of a sequence in a target RNA with relatively few truncation events at the terminus. For instance, in some embodiments, a GENE WRITER™ protein (e.g., of SEQ ID NO: 1016) results in about 25-100%, 50-100%, 60-100%, 70-100%, 75-95%, 80%-90%, or 86.17% of integrants into the target site being non-truncated, as measured by an assay described herein, e.g., an assay of Example 6 and FIG. 8 of PCT/US2019/048607 which are hereby incorporated by reference. In some embodiments, a Gene Writer™ protein (e.g., of SEQ ID NO: 1016) results in at least about 30%, 40%, 50%, 60%, 70%, 80%, or 90% of integrants into the target site being non-truncated, as measured by an assay described herein. In some embodiments, an integrant is classified as truncated versus non-truncated using an assay comprising amplification with a forward primer situated 565 bp from the end of the element (e.g., a wild-type transposon sequence, e.g., of Taeniopygia guttata) and a reverse primer situated in the genomic DNA of the target insertion site, e.g., rDNA. In some embodiments, the number of full-length integrants in the target insertion site is greater than the number of integrants truncated by 300-565 nucleotides in the target insertion site, e.g., the number of full-length integrants is at least 1.1×, 1.2×, 1.5×, 2×, 3×, 4×, 5×, 6×, 7×, 8×, 9×, or 10× the number of the truncated integrants, or the number of full-length integrants is at least 1.1×-10×, 2×-10×, 3×-10×, or 5×-10× the number of the truncated integrants.

In some embodiments, a system or method described herein results in insertion of the heterologous object sequence only at one target site in the genome of the target cell. Insertion can be measured, e.g., using a threshold of above 1%, 1.5%, 2%, 2.5%, 3%, 3.5%, 4%, 4.5%, 5%, e.g., as described in Example 8 of PCT/US2019/048607 which is hereby incorporated by reference. In some embodiments, a system or method described herein results in insertion of the heterologous object sequence wherein less than 1%, 1.5%, 2%, 2.5%, 3%, 3.5%, 4%, 4.5%, 5%, 10%, 20%, 30%, 40%, or 50% of insertions are at a site other than the target site, e.g., using an assay described herein, e.g., an assay of Example 8 of PCT/US2019/048607.

In some embodiments, a system or method described herein results in "scarless" insertion of the heterologous object sequence, while in some embodiments, the target site can show deletions or duplications of endogenous DNA as a result of insertion of the heterologous sequence. The mechanisms of different retrotransposons could result in different patterns of duplications or deletions in the host genome occurring during retrotransposition at the target site. In some embodiments, the system results in a scarless insertion, with no duplications or deletions in the surrounding genomic DNA. In some embodiments, the system results in a deletion of less than 1, 2, 3, 4, 5, 10, 50, or 100 bp of genomic DNA upstream of the insertion. In some embodiments, the system results in a deletion of less than 1, 2, 3, 4, 5, 10, 50, or 100 bp of genomic DNA downstream of the insertion. In some embodiments, the system results in a duplication of less than 1, 2, 3, 4, 5, 10, 50, or 100 bp of genomic DNA upstream of the insertion. In some embodiments, the system results in a duplication of less than 1, 2, 3, 4, 5, 10, 50, or 100 bp of genomic DNA downstream of the insertion.

In some embodiments, a GENE WRITER™ described herein, or a DNA-binding domain thereof, binds to its target site specifically, e.g., as measured using an assay of Example 21 of PCT/US2019/048607 which is hereby incorporated by reference. In some embodiments, the GENE WRITER™ or DNA-binding domain thereof binds to its target site more strongly than to any other binding site in the human genome. For example, in some embodiments, in an assay of Example 21 of PCT/US2019/048607, the target site represents more than 50%, 60%, 70%, 80%, 90%, or 95% of binding events of the GENE WRITER™ or DNA-binding domain thereof to human genomic DNA.

Genetically Engineered, e.g., Dimerized GENE WRITER™ Systems

Some non-LTR retrotransposons utilize two subunits to complete retrotransposition (Christensen et al PNAS 2006). In some embodiments, a retrotransposase described herein comprises two connected subunits as a single polypeptide. For instance, two wild-type retrotransposases could be joined with a linker to form a covalently "dimerized" protein. In some embodiments, the nucleic acid coding for the retrotransposase codes for two retrotransposase subunits to be expressed as a single polypeptide. In some embodiments, the subunits are connected by a peptide linker, such as has been described herein in the section entitled "Linker" and, e.g., in Chen et al Adv Drug Deliv Rev 2013. In some embodiments, the two subunits in the polypeptide are connected by a rigid linker. In some embodiments, the rigid linker consists of the motif (EAAAK)$_n$ (SEQ ID NO: 1534). In other embodiments, the two subunits in the polypeptide are connected by a flexible linker. In some embodiments, the flexible linker consists of the motif (Gly)$_n$. In some embodiments, the flexible linker consists of the motif (GGGGS)$_n$ (SEQ ID NO: 1535). In some embodiments, the rigid or flexible linker consists of 1, 2, 3, 4, 5, 10, 15, or more amino acids in length to enable retrotransposition. In some embodiments, the linker consists of a combination of rigid and flexible linker motifs.

Based on mechanism, not all functions are required from both retrotransposase subunits. In some embodiments, the fusion protein may consist of a fully functional subunit and a second subunit lacking one or more functional domains. In some embodiments, one subunit may lack reverse transcriptase functionality. In some embodiments, one subunit may lack the reverse transcriptase domain. In some embodiments, one subunit may possess only endonuclease activity. In some embodiments, one subunit may possess only an endonuclease domain. In some embodiments, the two subunits comprising the single polypeptide may provide complimentary functions.

In some embodiments, one subunit may lack endonuclease functionality. In some embodiments, one subunit may lack the endonuclease domain. In some embodiments, one subunit may possess only reverse transcriptase activity. In some embodiments, one subunit may possess only a reverse transcriptase domain. In some embodiments, one subunit may possess only DNA-dependent DNA synthesis functionality.

Linkers

In some embodiments, domains of the compositions and systems described herein (e.g., the endonuclease and reverse transcriptase domains of a polypeptide or the DNA binding domain and reverse transcriptase domains of a polypeptide) may be joined by a linker. A composition described herein comprising a linker element has the general form S1-L-S2, wherein S1 and S2 may be the same or different and represent two domain moieties (e.g., each a polypeptide or nucleic acid domain) associated with one another by the linker. In some embodiments, a linker may connect two polypeptides. In some embodiments, a linker may connect two nucleic acid molecules. In some embodiments, a linker may connect a polypeptide and a nucleic acid molecule. A linker may be a chemical bond, e.g., one or more covalent bonds or non-covalent bonds. A linker may be flexible, rigid, and/or cleavable. In some embodiments, the linker is a peptide linker. Generally, a peptide linker is at least 2, 3, 4, 5, 6, 7, 8, 9, 10 or more amino acids in length, e.g., 2-50 amino acids in length, 2-30 amino acids in length.

The most commonly used flexible linkers have sequences consisting primarily of stretches of Gly and Ser residues ("GS" linker). Flexible linkers may be useful for joining domains that require a certain degree of movement or interaction and may include small, non-polar (e.g. Gly) or polar (e.g. Ser or Thr) amino acids. Incorporation of Ser or Thr can also maintain the stability of the linker in aqueous solutions by forming hydrogen bonds with the water molecules, and therefore reduce unfavorable interactions between the linker and the other moieties. Examples of such linkers include those having the structure [GGS]$^{≥1}$ or [GGGS]$^{≥1}$ (SEQ ID NO: 1536). Rigid linkers are useful to keep a fixed distance between domains and to maintain their independent functions. Rigid linkers may also be useful when a spatial separation of the domains is critical to preserve the stability or bioactivity of one or more components in the agent. Rigid linkers may have an alpha helix-structure or Pro-rich sequence, (XP) n, with X designating any amino acid, preferably Ala, Lys, or Glu. Cleavable linkers may release free functional domains in vivo. In some embodiments, linkers may be cleaved under specific conditions, such as the presence of reducing reagents or proteases. In vivo cleavable linkers may utilize the reversible nature of a disulfide bond. One example includes a thrombin-sensitive sequence (e.g., PRS) between the two Cys residues. In vitro thrombin treatment of CPRSC (SEQ ID NO: 1537) results in the cleavage of the thrombin-sensitive sequence, while the reversible disulfide linkage remains intact. Such linkers are known and described, e.g., in Chen et al. 2013. Fusion Protein Linkers: Property, Design and Functionality. *Adv Drug Deliv Rev.* 65 (10): 1357-1369. In vivo cleavage of linkers in compositions described herein may also be carried out by proteases that are expressed in vivo under pathological conditions (e.g. cancer or inflammation), in specific cells or tissues, or constrained within certain cellular compartments. The specificity of many proteases offers slower cleavage of the linker in constrained compartments.

In some embodiments the amino acid linkers are (or are homologous to) the endogenous amino acids that exist between such domains in a native polypeptide. In some embodiments the endogenous amino acids that exist between such domains are substituted but the length is unchanged from the natural length. In some embodiments, additional amino acid residues are added to the naturally existing amino acid residues between domains.

In some embodiments, the amino acid linkers are designed computationally or screened to maximize protein function (Anad et al., FEBS Letters, 587:19, 2013).

Additional Domains:

The GENE WRITER™ polypeptide comprises the functions necessary to bind a target DNA sequence and template nucleic acid (e.g., template RNA), nick the target site, and write (e.g., reverse transcribe) the template into DNA, resulting in a modification of the target site. In some embodiments, additional domains may be added to the polypeptide to enhance the efficiency of the process. In some embodiments, the GENE WRITER™ polypeptide may contain an additional DNA ligation domain to join reverse transcribed DNA to the DNA of the target site. In some embodiments, the polypeptide may comprise a heterologous RNA-binding domain. In some embodiments, the polypeptide may comprise a domain having 5' to 3' exonuclease activity (e.g., wherein the 5' to 3' exonuclease activity increases repair of the alteration of the target site, e.g., in favor of alteration over the original genomic sequence). In some embodiments, the polypeptide may comprise a domain having 3' to 5' exonuclease activity, e.g., proof-reading activity. In some embodiments, the writing domain, e.g., RT domain, has 3' to 5' exonuclease activity, e.g., proof-reading activity.

In some embodiments, the polypeptide does not comprise an RNase H domain. In some embodiments, the polypeptide comprises an RNaseH domain endogenous to one of the other domains. In some embodiments, the polypeptide comprises an RNase H domain that is heterologous to the other domains. In some embodiments, the polypeptide comprises an inactivated endogenous RNaseH domain.

In some embodiments, a GENE WRITER™ as described herein comprises a polypeptide associated with a guide RNA (gRNA). In certain embodiments, the gRNA is comprised in the template nucleic acid molecule. In other embodiments, the gRNA is separate from the template nucleic acid molecule. In some embodiments wherein the gRNA is comprised in the template nucleic acid molecule, the template nucleic acid molecule further comprises a gRNA spacer sequence (e.g., at or within 1, 2, 3, 4, 5, 10, 15, 20, 25, 30, 40, 50, 60, 70, 80, 90, or 100 nucleotides of its 5' end). In embodiments, the gRNA spacer comprises a sequence having at least 85%, 90%, 95%, 96%, 97%, 98%, 99%, or 100% sequence identity to a nucleic acid sequence comprised in the target nucleic acid molecule. In embodiments, the gRNA spacer directs Cas domain (e.g., Cas9) activity at the nucleic acid sequence comprised in the target nucleic acid molecule. In some embodiments wherein the gRNA is comprised in the template nucleic acid molecule, the template nucleic acid molecule further comprises a primer binding site (e.g., at or within 1, 2, 3, 4, 5, 10, 15, 20, 25, 30, 40, 50, 60, 70, 80, 90, or 100 nucleotides of its 3' end). In embodiments, the primer binding site comprises a nucleic acid sequence comprising at least 85%, 90%, 95%, 96%, 97%, 98%, 99%, or 100% sequence identity to a nucleic acid sequence positioned at the 5' end (e.g., within 1, 2, 3, 4, 5, 6, 7, 8, 9, 10, 15, 20, 25, 30, 40, or 50 nucleotides) of a nick site on the target nucleic acid molecule. In embodiments, binding of the primer binding site to the target nucleic acid molecule operates to prime TPRT.

Template Nucleic Acid Component of GENE WRITER™ Gene Editor System

The GENE WRITER™ systems described herein can modify a host target DNA site using a template nucleic acid sequence. In some embodiments, the GENE WRITER™ systems described herein transcribe an RNA sequence template into host target DNA sites by target-primed reverse transcription (TPRT). By writing DNA sequence(s) via reverse transcription of the RNA sequence template directly into the host genome, the GENE WRITER™ system can insert an object sequence into a target genome without the need for exogenous DNA sequences to be introduced into the host cell (unlike, for example, CRISPR systems), as well as eliminate an exogenous DNA insertion step. The GENE WRITER™ system can also delete a sequence from the target genome or introduce a substitution using an object sequence. Therefore, the Gene Writer™ system provides a platform for the use of customized RNA sequence templates containing object sequences, e.g., sequences comprising heterologous gene coding and/or function information.

In some embodiments, a GENE WRITER™ system comprises a template nucleic acid (e.g., RNA or DNA) molecule. In some embodiments, the template nucleic acid molecule comprises a 5' homology region and/or a 3' homology region. In some embodiments, the 5' homology region comprises a nucleic acid sequence having at least 85%, 90%, 95%, 96%, 97%, 98%, 99%, or 100% sequence similarity with a nucleic acid sequence comprised in a target nucleic acid molecule. In embodiments, the nucleic acid sequence in the target nucleic acid molecule is within about 1, 2, 3, 4, 5, 6, 7, 8, 9, 10, 15, 20, 25, 30, 35, 40, 45, 50, 60, 70, 80, 90, or 100 nucleotides of (e.g., 5' relative to) a target insertion site, e.g., for a heterologous object sequence, e.g., comprised in the template nucleic acid molecule.

In some embodiments, the 3' homology region comprises a nucleic acid sequence having at least 85%, 90%, 95%, 96%, 97%, 98%, 99%, or 100% sequence identity with a nucleic acid sequence comprised in a target nucleic acid molecule. In embodiments, the nucleic acid sequence in the target nucleic acid molecule is within about 1, 2, 3, 4, 5, 6, 7, 8, 9, 10, 15, 20, 25, 30, 35, 40, 45, 50, 60, 70, 80, 90, or 100 nucleotides of (e.g., 3' relative to) a target insertion site, e.g., for a heterologous object sequence, e.g., comprised in the template nucleic acid molecule. In some embodiments, the 5' homology region is heterologous to the remainder of the template nucleic acid molecule. In some embodiments, the 3' homology region is heterologous to the remainder of the template nucleic acid molecule.

In some embodiments, a template nucleic acid (e.g., template RNA) comprises a 3' target homology domain. In some embodiments, a 3' target homology domain is disposed 3' of the heterologous object sequence and is complementary to a sequence adjacent to a site to be modified by a system described herein, or comprises no more than 1, 2, 3, 4, or 5 mismatches to a sequence complementary to the sequence adjacent to a site to be modified by the system/GENE WRITER™. In some embodiments, the 3' homology region binds within 1, 2, 3, 4, 5, 6, 7, 8, 9, or 10 nucleotides of a nick site in the target nucleic acid molecule. In some embodiments, binding of the 3' homology region to the target nucleic acid molecule permits initiation of target-primed reverse transcription (TPRT), e.g., with the 3' homology region acting as a primer for TPRT. In some embodiments, the 3' target homology domain anneals to the target site, which provides a binding site and the 3' hydroxyl for the initiation of TPRT by a GENE WRITER™ polypeptide. In some embodiments, the 3' target homology domain is 3-5, 5-10, 10-30, 10-25, 10-20, 10-19, 10-18, 10-17, 10-16, 10-15, 10-14, 10-13, 10-12, 10-11, 11-30, 11-25, 11-20, 11-19, 11-18, 11-17, 11-16, 11-15, 11-14, 11-13, 11-12, 12-30, 12-25, 12-20, 12-19, 12-18, 12-17, 12-16, 12-15, 12-14, 12-13, 13-30, 13-25, 13-20, 13-19, 13-18, 13-17, 13-16, 13-15, 13-14, 14-30, 14-25, 14-20, 14-19, 14-18, 14-17, 14-16, 14-15, 15-30, 15-25, 15-20, 15-19, 15-18, 15-17, 15-16, 16-30, 16-25, 16-20, 16-19, 16-18, 16-17, 17-30, 17-25, 17-20, 17-19, 17-18, 18-30, 18-25, 18-20, 18-19, 19-30, 19-25, 19-20, 20-30, 20-25, or 25-30 nt in length, e.g., 10-17, 12-16, or 12-14 nt in length.

In some embodiments, a template nucleic acid (e.g., template RNA) comprises a heterologous object sequence. In some embodiments, the heterologous object sequence may be transcribed by the RT domain of a GENE WRITER™ polypeptide, e.g., thereby introducing an alteration into a target site in genomic DNA. In some embodiments, the heterologous object sequence is at least 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, or 1,000 nucleotides (nts) in length, or at least 1, 1.5, 2, 2.5, 3, 3.5, 4, 4.5, 5, 5.5, 6, 6.5, 7, 7.5, 8, 8.5, 9, 9.5, or 10 kilobases in length. In some embodiments, the heterologous object sequence is no more than 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 120, 140, 160, 180, 200, 500, 1,000, or 2000 nucleotides (nts) in length, or no more than 20, 15, 10, 9, 8, 7, 6, 5, 4, or 3 kilobases in length. In some embodiments, the heterologous object sequence is 30-1000, 40-1000, 50-1000, 60-1000, 70-1000, 74-1000, 75-1000, 76-1000, 77-1000, 78-1000, 79-1000, 80-1000, 85-1000, 90-1000, 100-1000, 120-1000, 140-1000, 160-1000, 180-1000, 200-1000, 500-1000, 30-500, 40-500, 50-500, 60-500, 70-500, 74-500, 75-500, 76-500, 77-500, 78-500, 79-500, 80-500, 85-500, 90-500, 100-500, 120-500, 140-500, 160-500, 180-500, 200-500, 30-200, 40-200, 50-200, 60-200, 70-200, 74-200, 75-200, 76-200, 77-200, 78-200, 79-200, 80-200, 85-200, 90-200, 100-200, 120-200, 140-200, 160-200, 180-200, 30-100, 40-100, 50-100, 60-100, 70-100, 74-100, 75-100, 76-100, 77-100, 78-100, 79-100, 80-100, 85-100, or 90-100 nucleotides (nts) in length, or 1-20, 1-15, 1-10, 1-9, 1-8, 1-7, 1-6, 1-5, 1-4, 1-3, 1-2, 2-20, 2-15, 2-10, 2-9, 2-8, 2-7, 2-6, 2-5, 2-4, 2-3, 3-20, 3-15, 3-10, 3-9, 3-8, 3-7, 3-6, 3-5, 3-4, 4-20, 4-15, 4-10, 4-9, 4-8, 4-7, 4-6, 4-5, 5-20, 5-15, 5-10, 5-9, 5-8, 5-7, 5-6, 6-20, 6-15, 6-10, 6-9, 6-8, 6-7, 7-20, 7-15, 7-10, 7-9, 7-8, 8-20, 8-15, 8-10, 8-9, 9-20, 9-15, 9-10, 10-15, 10-20, or 15-20 kilobases in length. In some embodiments, the heterologous object sequence is 10-100, 10-90, 10-80, 10-70, 10-60, 10-50, 10-40, 10-30, or 10-20 nt in length, e.g., 10-80, 10-50, or 10-20 nt in length, e.g., about 10-20 nt in length. In some embodiments, a template RNA comprises a sequence as listed in Table 57, or a sequence with at lest 70%, 75%, 80%, 85%, 90%, 95%, 96%, 97%, 98%, or 99% identity thereto.

In certain embodiments, the template nucleic acid comprises a customized RNA sequence template which can be identified, designed, engineered and constructed to contain sequences altering or specifying host genome function, for example by introducing a heterologous coding region into a genome; affecting or causing exon structure/alternative splicing; causing disruption of an endogenous gene; causing transcriptional activation of an endogenous gene; causing epigenetic regulation of an endogenous DNA; causing up- or down-regulation of operably liked genes, etc. In certain embodiments, a customized RNA sequence template can be engineered to contain sequences coding for exons and/or transgenes, provide for binding sites to transcription factor activators, repressors, enhancers, etc., and combinations of thereof. In other embodiments, the coding sequence can be further customized with splice acceptor sites, poly-A tails. In certain embodiments the RNA sequence can contain sequences coding for an RNA sequence template homologous to the RLE retrotransposase, be engineered to contain heterologous coding sequences, or combinations thereof.

The template nucleic acid (e.g., template RNA) may have some homology to the target DNA. In some embodiments, the template nucleic acid (e.g., template RNA) 3' target homology domain may serve as an annealing region to the target DNA, such that the target DNA is positioned to prime the reverse transcription of the template nucleic acid (e.g., template RNA). In some embodiments the template nucleic acid (e.g., template RNA) has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 175, 200 or more bases of exact homology to the target DNA at the 3' end of the RNA. In some embodiments the template nucleic acid (e.g., template RNA) has at least 2, 3, 4, 5, 6, 7, 8, 9, 10, 11, 12, 13, 14, 15, 20, 25, 30, 35, 40, 45, 50, 60, 70, 80, 90, 100, 110, 120, 130, 140, 150, 160, 175, 180, or 200 or more bases of at least 50%, 60%, 70%, 80%, 85%, 90%, 95%, 97%, 98%, 99% or 100% homology to the target DNA, e.g., at the 5' end of the template nucleic acid (e.g., template RNA). In some embodiments the template nucleic acid (e.g., template RNA) has a 3' region of at least 10, 15, 20, 25, 30, 40, 50, 60, 80, 100, 120, 140, 160, 180, 200 or more bases of at least 50%, 60%, 70%, 80%, 85%, 90%, 95%, 97%, 98%, 99% or 100% homology to the 3' sequence of a non-LTR retrotransposon, e.g., a non-LTR retrotransposon described herein, e.g. a non-LTR retrotransposon in Table 2 or 4.

The template nucleic acid (e.g., template RNA) component of a GENE WRITER™ genome editing system described herein typically is able to bind the Gene Writer™ genome editing protein of the system. In some embodiments the template nucleic acid (e.g., template RNA) has a 3' region that is capable of binding a GENE WRITER™ genome editing protein. The binding region, e.g., 3' region, may be a structured RNA region, e.g., having at least 1, 2 or 3 hairpin loops, capable of binding the GENE WRITER™ genome editing protein of the system. The binding region may associate the template nucleic acid (e.g., template RNA) with any of the polypeptide modules. In some embodiments, the binding region of the template nucleic acid (e.g., template RNA) may associate with an RNA-binding domain in the polypeptide. In some embodiments, the binding region of the template nucleic acid (e.g., template RNA) may associate with the reverse transcription domain of the polypeptide (e.g., specifically bind to the RT domain). For example, where the reverse transcription domain is derived from a non-LTR retrotransposon, the template nucleic acid (e.g., template RNA) may contain a binding region derived from a non-LTR retrotransposon, e.g., a 3' UTR from a non-LTR retrotransposon. In some embodiments, the template nucleic acid (e.g., template RNA) may associate with the DNA binding domain of the polypeptide, e.g., a gRNA associating with a Cas9-derived DNA binding domain. In some embodiments, the binding region may also provide DNA target recognition, e.g., a gRNA hybridizing to the target DNA sequence and binding the polypeptide, e.g., a Cas9 domain. In some embodiments, the template nucleic acid (e.g., template RNA) may associate with multiple components of the polypeptide, e.g., DNA binding domain and reverse transcription domain. For example, the template nucleic acid (e.g., template RNA) may comprise a gRNA region that associates with a Cas9-derived DNA binding domain and a 3' UTR from a non-LTR retrotransposon that associated with a non-LTR retrotransposon-derived reverse transcription domain.

In some embodiments the template RNA has a poly-A tail at the 3' end. In some embodiments the template RNA does not have a poly-A tail at the 3' end. In some embodiments the template nucleic acid (e.g., template RNA) has a 5' region of at least 10, 15, 20, 25, 30, 40, 50, 60, 80, 100, 120, 140, 160, 180, 200 or more bases of at least 40%, 50%, 60%, 70%, 80%, 90%, 95% or greater homology to the 5' sequence of a non-LTR retrotransposon, e.g., a non-LTR retrotransposon described herein.

The template nucleic acid (e.g., template RNA) of the system typically comprises an object sequence (e.g., a heterologous object sequence) for insertion into a target DNA. The object sequence may be coding or non-coding.

In some embodiments a system or method described herein comprises a single template nucleic acid (e.g., template RNA). In some embodiments a system or method described herein comprises a plurality of template nucleic acids (e.g., template RNAs). For example, a system described herein comprises a first RNA comprising (e.g., from 5' to 3') a sequence that binds the GENE WRITER™ polypeptide (e.g., the DNA-binding domain and/or the endonuclease domain, e.g., a gRNA) and a sequence that binds a target site (e.g., a second strand of a site in a target genome), and a second RNA (e.g., a template RNA) comprising (e.g., from 5' to 3') optionally a sequence that binds the GENE WRITER™ polypeptide (e.g., that specifically binds the RT domain), a heterologous object sequence, and a 3' target homology domain. In some embodiments, when the system comprises a plurality of nucleic acids, each nucleic acid comprises a conjugating domain. In some embodiments, a conjugating domain enables association of nucleic acid molecules, e.g., by hybridization of complementary sequences. For example, in some embodiments a first RNA comprises a first conjugating domain and a second RNA comprises a second conjugating domain, and the first and second conjugating domains are capable of hybridizing to one another, e.g., under stringent conditions. In some embodiments, the stringent conditions for hybridization include hybridization in 4× sodium chloride/sodium citrate (SSC), at about 65° C., followed by a wash in 1×SSC, at about 65° C.

In some embodiments, the object sequence may contain an open reading frame. In some embodiments the template nucleic acid (e.g., template RNA) has a Kozak sequence. In some embodiments the template RNA has an internal ribosome entry site. In some embodiments the template RNA has a self-cleaving peptide such as a T2A or P2A site. In some embodiments the template RNA has a start codon. In some embodiments the template RNA has a splice acceptor site. In some embodiments the template RNA has a splice donor site. Exemplary splice acceptor and splice donor sites are described in WO2016044416, incorporated herein by reference in its entirety. Exemplary splice acceptor site sequences are known to those of skill in the art and include, by way of example only, CTGACCCTTCTCTCTCTCCCCCAGAG (SEQ ID NO: 1601) (from human HBB gene) and TTTCTCTCCCACAAG (SEQ ID NO: 1602) (from human immunoglobulin-gamma gene). In some embodiments the template RNA has a microRNA binding site downstream of the stop codon. In some embodiments the template RNA has a polyA tail downstream of the stop codon of an open reading frame. In some embodiments the template RNA comprises one or more exons. In some embodiments the template RNA comprises one or more introns. In some embodiments the template RNA comprises a eukaryotic transcriptional terminator. In some embodiments the template RNA comprises an enhanced translation element or a translation enhancing element. In some embodiments the RNA comprises the human T-cell leukemia virus (HTLV-1) R region. In some embodiments the RNA comprises a posttranscriptional regulatory element that enhances nuclear export, such as that of Hepatitis B Virus (HPRE) or Woodchuck Hepatitis Virus (WPRE).

In some embodiments, a nucleic acid described herein (e.g., a template RNA or a DNA encoding a template RNA) comprises a microRNA binding site. In some embodiments, the microRNA binding site is used to increase the target-cell specificity of a GENE WRITER™ system. For instance, the microRNA binding site can be chosen on the basis that is is recognized by a miRNA that is present in a non-target cell type, but that is not present (or is present at a reduced level relative to the non-target cell) in a target cell type. Thus, when the template RNA is present in a non-target cell, it would be bound by the miRNA, and when the template RNA is present in a target cell, it would not be bound by the miRNA (or bound but at reduced levels relative to the non-target cell). While not wishing to be bound by theory, binding of the miRNA to the template RNA may interfere with its activity, e.g., may interfere with insertion of the heterologous object sequence into the genome. Accordingly, the system would edit the genome of target cells more efficiently than it edits the genome of non-target cells, e.g., the heterologous object sequence would be inserted into the genome of target cells more efficiently than into the genome of non-target cells, or an insertion or deletion is produced more efficiently in target cells than in non-target cells. A system having a microRNA binding site in the template RNA (or DNA encoding it) may also be used in combination with a nucleic acid encoding a GENE WRITER™ polypeptide, wherein expression of the GENE WRITER™ polypeptide is regulated by a second microRNA binding site, e.g., as described herein, e.g., in the section entitled "Polypeptide component of GENE WRITER™ gene editor system". In some embodiments, e.g., for liver indications, a miRNA is selected from Table 4 of WO2020014209, incorporated herein by reference.

In some embodiments, the object sequence may contain a non-coding sequence. For example, the template nucleic acid (e.g., template RNA) may comprise a regulatory element, e.g., a promoter or enhancer sequence or miRNA binding site. In some embodiments, integration of the object sequence at a target site will result in upregulation of an endogenous gene. In some embodiments, integration of the object sequence at a target site will result in downregulation of an endogenous gene. In some embodiments the template nucleic acid (e.g., template RNA) comprises a tissue specific promoter or enhancer, each of which may be unidirectional or bidirectional. In some embodiments the promoter is an RNA polymerase I promoter, RNA polymerase II promoter, or RNA polymerase III promoter. In some embodiments the promoter comprises a TATA element. In some embodiments the promoter comprises a B recognition element. In some embodiments the promoter has one or more binding sites for transcription factors.

In some embodiments, a nucleic acid described herein (e.g., a template RNA or a DNA encoding a template RNA) comprises a promoter sequence, e.g., a tissue specific promoter sequence. In some embodiments, the tissue-specific promoter is used to increase the target-cell specificity of a GENE WRITER™ system. For instance, the promoter can be chosen on the basis that it is active in a target cell type but not active in (or active at a lower level in) a non-target cell type. Thus, even if the promoter integrated into the genome of a non-target cell, it would not drive expression (or only drive low level expression) of an integrated gene. A system having a tissue-specific promoter sequence in the template RNA may also be used in combination with a microRNA binding site, e.g., in the template RNA or a nucleic acid encoding a GENE WRITER™ protein, e.g., as described herein. A system having a tissue-specific promoter sequence in the template RNA may also be used in combination with a DNA encoding a GENE WRITER™ polypeptide, driven by a tissue-specific promoter, e.g., to achieve higher levels of GENE WRITER™ protein in target cells than in non-target cells. In some embodiments, e.g., for liver indications, a tissue-specific promoter is selected from Table 3 of WO2020014209, incorporated herein by reference.

In some embodiments, a GENE WRITER™ system, e.g., DNA encoding a GENE WRITER™ polypeptide, DNA encoding a template RNA, or DNA or RNA encoding a heterologous object sequence, is designed such that one or more elements is operably linked to a tissue-specific promoter, e.g., a promoter that is active in T-cells. In further embodiments, the T-cell active promoter is inactive in other cell types, e.g., B-cells, NK cells. In some embodiments, the T-cell active promoter is derived from a promoter for a gene encoding a component of the T-cell receptor, e.g., TRAC, TRBC, TRGC, TRDC. In some embodiments, the T-cell active promoter is derived from a promoter for a gene encoding a component of a T-cell-specific cluster of differentiation protein, e.g., CD3, e.g., CD3D, CD3E, CD3G, CD3Z. In some embodiments, T-cell-specific promoters in GENE WRITER™ systems are discovered by comparing publicly available gene expression data across cell types and selecting promoters from the genes with enhanced expression in T-cells. In some embodiments, promoters may be selecting depending on the desired expression breadth, e.g., promoters that are active in T-cells only, promoters that are active in NK cells only, promoters that are active in both T-cells and NK cells.

In some embodiments the template RNA comprises a microRNA sequence, a siRNA sequence, a guide RNA sequence, a piwi RNA sequence.

In some embodiments the template nucleic acid (e.g., template RNA) comprises a site that coordinates epigenetic modification. In some embodiments the template nucleic acid (e.g., template RNA) comprises a chromatin insulator. For example, the template nucleic acid (e.g., template RNA) comprises a CTCF site or a site targeted for DNA methylation.

In some embodiments the template nucleic acid (e.g., template RNA) comprises a gene expression unit composed of at least one regulatory region operably linked to an effector sequence. The effector sequence may be a sequence that is transcribed into RNA (e.g., a coding sequence or a non-coding sequence such as a sequence encoding a micro RNA).

In some embodiments the object sequence of the template nucleic acid (e.g., template RNA) is inserted into a target genome in an endogenous intron. In some embodiments the object sequence of the template nucleic acid (e.g., template RNA) is inserted into a target genome and thereby acts as a new exon. In some embodiments the insertion of the object sequence into the target genome results in replacement of a natural exon or the skipping of a natural exon.

In some embodiments, the object sequence of the template nucleic acid (e.g., template RNA) is inserted into the target genome in a genomic safe harbor site, such as AAVS1, CCR5, ROSA26, or albumin locus. In some embodiments, a GENE WRITER™ is used to integrate a CAR into the T-cell receptor α constant (TRAC) locus (Eyquem et al Nature 543, 113-117 (2017)). In some embodiments, a GENE WRITER™ is used to integrate a CAR into a T-cell receptor β constant (TRBC) locus. Many other safe harbors have been identified by computational approaches (Pellenz et al Hum Gen Ther 30, 814-828 (2019)) and could be used for GENE WRITER™-mediated integration. In some embodiments, the object sequence of the template nucleic acid (e.g., template RNA) is added to the genome in an intergenic or intragenic region. In some embodiments, the object sequence of the template nucleic acid (e.g., template RNA) is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous active gene. In some embodiments, the object sequence of the template nucleic acid (e.g., template RNA) is added to the genome 5' or 3' within 0.1 kb, 0.25 kb, 0.5 kb, 0.75, kb, 1 kb, 2 kb, 3 kb, 4 kb, 5 kb, 7.5 kb, 10 kb, 15 kb, 20 kb, 25 kb, 50, 75 kb, or 100 kb of an endogenous promoter or enhancer. In some embodiments, the object sequence of the template nucleic acid (e.g., template RNA) can be, e.g., 50-50,000 base pairs (e.g., between 50-40,000 bp, between 500-30,000 bp between 500-20,000 bp, between 100-15,000 bp, between 500-10,000 bp, between 50-10,000 bp, between 50-5,000 bp.

The template nucleic acid (e.g., template RNA) can be designed to result in insertions, mutations, or deletions at the target DNA locus. In some embodiments, the template nucleic acid (e.g., template RNA) may be designed to cause an insertion in the target DNA. For example, the template nucleic acid (e.g., template RNA) may contain a heterologous sequence, wherein the reverse transcription will result in insertion of the heterologous sequence into the target DNA. In other embodiments, the RNA template may be designed to write a deletion into the target DNA. For example, the template nucleic acid (e.g., template RNA) may match the target DNA upstream and downstream of the desired deletion, wherein the reverse transcription will result in the copying of the upstream and downstream sequences from the template nucleic acid (e.g., template RNA) without the intervening sequence, e.g., causing deletion of the intervening sequence. In other embodiments, the template nucleic acid (e.g., template RNA) may be designed to write an edit into the target DNA. For example, the template RNA may match the target DNA sequence with the exception of one or more nucleotides, wherein the reverse transcription will result in the copying of these edits into the target DNA, e.g., resulting in mutations, e.g., transition or transversion mutations.

In some embodiments, the template possesses one or more sequences aiding in association of the template with the GENE WRITER™ polypeptide. In some embodiments, these sequences may be derived from retrotransposon UTRs. In some embodiments, the UTRs may be located flanking the desired insertion sequence. In some embodiments, a sequence with target site homology may be located outside of one or both UTRs. In some embodiments, the sequence with target site homology can anneal to the target sequence to prime reverse transcription. In some embodiments, the 5' and/or 3' UTR may be located terminal to the target site homology sequence, e.g., such that target primed reverse transcription excludes reverse transcription of the 5' and/or 3' UTR. In some embodiments, the GENE WRITER™ system may result in the insertion of a desired payload without any additional sequence (e.g. gene expression unit without UTRs used to bind the GENE WRITER™ protein).

Alternative orientations of the template RNA motifs can be employed, e.g., to limit target site integration to the desired genetic payload. In some embodiments, the polypeptide association domains may be located 5' of the desired template sequence. For example, the heterologous object sequence may be located downstream of the 5' UTR and 3' UTR, giving the 5'-3' orientation 5'UTR-3'UTR-(heterologous object sequence). In other embodiments, only the 3' UTR is added upstream of the heterologous object sequence. For example, giving the 5'-3' orientation 3'UTR-(heterologous object sequence). In certain embodiments, the polypeptide coding region and the heterologous object sequence may be encoded on the same molecule, but where the 5' UTR (e.g., 5' UTR from R2 retrotransposon) occurs between the two regions, e.g., giving the 5'-3' orientation (polypeptide coding sequence)-5'UTR-(heterologous object sequence).

In some embodiments, the template nucleic acid, e.g., template RNA, may comprise a gRNA (e.g., pegRNA). In some embodiments, the template nucleic acid, e.g., template RNA, may bind to the GENE WRITER™ polypeptide by interaction of a gRNA portion of the template nucleic acid with a template nucleic acid binding domain, e.g., a RNA binding domain (e.g., a heterologous RNA binding domain). In some embodiments, the heterologous RNA binding domain is a CRISPR/Cas protein, e.g., Cas9.

In some embodiments, the region of the template nucleic acid, e.g., template RNA, comprising the gRNA adopts an underwound ribbon-like structure of gRNA bound to target DNA (e.g., as described in Mulepati et al. Science 19 Sep. 2014: Vol. 345, Issue 6203, pp. 1479-1484). Without wishing to be bound by theory, this non-canonical structure is thought to be facilitated by rotation of every sixth nucleotide out of the RNA-DNA hybrid. Thus, in some embodiments, the region of the template nucleic acid, e.g., template RNA, comprising the gRNA may tolerate increased mismatching with the target site at some interval, e.g., every sixth base. In some embodiments, the region of the template nucleic acid, e.g., template RNA, comprising the gRNA comprising homology to the target site may possess wobble positions at a regular interval, e.g., every sixth base, that do not need to base pair with the target site.

gRNAs with Inducible Activity

In some embodiments, a template nucleic acid, e.g., template RNA, comprises a gRNA with inducible activity. Inducible activity may be achieved by the template nucleic acid, e.g., template RNA, further comprising (in addition to the gRNA) a blocking domain, wherein the sequence of a portion of or all of the blocking domain is at least partially complementary to a portion or all of the gRNA. The blocking domain is thus capable of hybridizing or substantially hybridizing to a portion of or all of the gRNA. In some embodiments, the blocking domain and inducibly active gRNA are disposed on the template nucleic acid, e.g., template RNA, such that the gRNA can adopt a first conformation where the blocking domain is hybridized or substantially hybridized to the gRNA, and a second conformation where the blocking domain is not hybridized or or not substantially hybridized to the gRNA. In some embodiments, in the first conformation the gRNA is unable to bind to the GENE WRITER™ polypeptide (e.g., the template nucleic acid binding domain, DNA binding domain, or endonuclease domain (e.g., a CRISPR/Cas protein)) or binds with substantially decreased affinity compared to an otherwise similar template RNA lacking the blocking domain. In some embodiments, in the second conformation the gRNA is able to bind to the GENE WRITER™ polypeptide (e.g., the template nucleic acid binding domain, DNA binding domain, or endonuclease domain (e.g., a CRISPR/Cas protein)). In some embodiments, whether the gRNA is in the first or second conformation can influence whether the DNA binding or endonuclease activities of the GENE WRITER™ polypeptide (e.g., of the CRISPR/Cas protein the GENE WRITER™ polypeptide comprises) are active. In some embodiments, hybridization of the gRNA to the blocking domain can be disrupted using an opener molecule. In some embodiments, an opener molecule comprises an agent that binds to a portion or all of the gRNA or blocking domain and inhibits hybridization of the gRNA to the blocking domain. In some embodiments, the opener molecule comprises a nucleic acid, e.g., comprising a sequence that is partially or wholly complementary to the gRNA, blocking domain, or both. By choosing or designing an appropriate opener molecule, providing the opener molecule can promote a change in the conformation of the gRNA such that it can associate with a CRISPR/Cas protein and provide the associated functions of the CRISPR/Cas protein (e.g., DNA binding and/or endonuclease activity). Without wishing to be bound by theory, providing the opener molecule at a selected time and/or location may allow for spatial and temporal control of the activity of the gRNA, CRISPR/Cas protein, or GENE WRITER™ system comprising the same. In some embodiments, a GENE WRITER™ may comprise a Cas protein as listed in Table 16 or Table 12 or a functional fragment thereof, or a sequence having at least 70%, 75%, 80%, 85%, 90%, 95%, 96%, 97%, 98%, 99% identity thereto.

TABLE 16

CRISPR/Cas Proteins, Species, and Mutations

| Variant | Parental Host | SEQ ID NO: | Protein Sequence | Nickase Mutation |
|---|---|---|---|---|
| Nme2Cas9 | Neisseria meningitidis | 3262 | MAAFKPNPINYILGLDIGIASVGWAMVEIDEEENPIRLID LGVRVFERAEVPKTGDSLAMARRLARSVRRLTRRRAHRLL RARRLLKREGVLQAADFDENGLIKSLPNTPWQLRAAALDR KLTPLEWSAVLGDYSHTFSRKDLQAELILLFEKQKEFGNP HVSGGLKEGIETLLMTQRPALSGDAVQKMLGHCTFEPAEP KAAKNTYTAERFIWLTKLNNLRILEQGSERPLTDTERATL MDEPYRKSKLTYAQARKLLGLEDTAFFKGLRYGKDNAEAS TLMEMKAYHAISRALEKEGLKDKKSPLNLSSELQDEIGTA FSLFKTDEDITGRLKDRVQPEILEALLKHISFDKFVQISL KALRRIVPLMEQGKRYDEACAEIYGDHYGKKNTEEKIYLP PIPADEIRNPVVLRALSQARKVINGVVRRYGSPARIHIET AREVGKSFKDRKEIEKRQEENRKDREKAAAKFREYFPNFV GEPKSKDILKLRLYEQQHGKCLYSGKEINLVRLNEKGYVE IDHALPFSRTWDDSFNNKVLVLGSENQNKGNQTPYEYFNG KDNSREWQEFKARVETSRFPRSKKQRILLQKFDEDGFKEC NLNDTRYVNRFLCQFVADHILLTGKGKRRVFASNGQITNL LRGFWGLRKVRAENDRHHALDAVVVACSTVAMQQKITRFV RYKEMNAFDGKTIDKETGKVLHQKTHFPQPWEFFAQEVMI RVFGKPDGKPEFEEADTPEKLRTLLAEKLSSRPEAVHEYV TPLFVSRAPNRKMSGAHKDTLRSAKRFVKHNEKISVKRVW LTEIKLADLENMVNYKNGREIELYEALKARLEAYGGNAKQ AFDPKDNPFYKKGGQLVKAVRVEKTQESGVLLNKKNAYTI ADNGDMVRVDVFCKVDKKGKNQYFIVPIYAWQVAENILPD IDCKGYRIDDSYTFCFSLHKYDLIAFQKDEKSKVEFAYYI NCDSSNGRFYLAWHDKGSKEQQFRISTQNLVLIQKYQVNE LGKEIRPCRLKKRPPVR | N611A |
| PpnCas9 | Pasteurella pneumotropica | 3263 | MQNNPLNYILGLDLGIASIGWAVVEIDEESSPIRLIDVGV RTFERAEVAKTGESLALSRRLARSSRRLIKRRAERLKKAK RLLKAEKILHSIDEKLPINVWQLRVKGLKEKLERQEWAAV LLHLSKHRGYLSQRKNEGKSDNKELGALLSGIASNHQMLQ | N605A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | SSEYRTPAEIAVKKFQVEEGHIRNQRGSYTHTFSRLDLLA<br>EMELLFQRQAELGNSYTSTTLLENLTALLMWQKPALAGDA<br>ILKMLGKCTFEPSEYKAAKNSYSAERFVWLTKLNNLRILE<br>NGTERALNDNERFALLEQPYEKSKLTYAQVRAMLALSDNA<br>IFKGVRYLGEDKKTVESKTTLIEMKFYHQIRKTLGSAELK<br>KEWNELKGNSDLLDEIGTAFSLYKTDDDICRYLEGKLPER<br>VLNALLENLNFDKFIQLSLKALHQILPLMLQGQRYDEAVS<br>AIYGDHYGKKSTETTRLLPTIPADEIRNPVVLRTLTQARK<br>VINAVVRLYGSPARIHIETAREVGKSYQDRKKLEKQQEDN<br>RKQRESAVKKFKEMFPHFVGEPKGKDILKMRLYELQQAKC<br>LYSGKSLELHRLLEKGYVEVDHALPFSRTWDDSFNNKVLV<br>LANENQNKGNLTPYEWLDGKNNSERWQHFVVRVQTSGFSY<br>AKKQRILNHKLDEKGFIERNLNDTRYVARFLCNFIADNML<br>LVGKGKRNVFASNGQITALLRHRWGLQKVREQNDRHHALD<br>AVVVACSTVAMQQKITRFVRYNEGNVFSGERIDRETGEII<br>PLHFPSPWAFFKENVEIRIFSENPKLELENRLPDYPQYNH<br>EWVQPLFVSRMPTRKMTGQGHMETVKSAKRLNEGLSVLKV<br>PLTQLKLSDLERMVNRDREIALYESLKARLEQFGNDPAKA<br>FAEPFYKKGGALVKAVRLEQTQKSGVLVRDGNGVADNASM<br>VRVDVFTKGGKYFLVPIYTWQVAKGILPNRAATQGKDEND<br>WDIMDEMATFQFSLCQNDLIKLVTKKKTIFGYFNGLNRAT<br>SNINIKEHDLDKSKGKLGIYLEVGVKLAISLEKYQVDELG<br>KNIRPCRPTKRQHVR | |
| SauCas9 | *Staphylococcus aureus* | 3264 | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN<br>VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNDLNNLVITRDENEKLEYYEK<br>FQUIENVFKQKKKPTLKQIAKEILVNEEDIKGYRVTSTGK<br>PEFTNLKVYHDIKDITARKEIIENAELLDQIAKILTIYQS<br>SEDIQEELTNLNSELTQEEIEQISNLKGYTGTHNLSLKAI<br>NLILDELWHTNDNQIAIFNRLKLVPKKVDLSQQKEIPTTL<br>VDDFILSPVVKRSFIQSIKVINAIIKKYGLPNDIIIELAR<br>EKNSKDAQKMINEMQKRNRQTNERIEEIIRTTGKENAKYL<br>IEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGGF<br>TSFLRRKWKFKKERNKGYKHHAEDALIIANADFIFKEWKK<br>LDKAKKVMENQMFEEKQAESMPEIETEQEYKEIFITPHQI<br>KHIKDFKDYKYSHRVDKKPNRELINDTLYSTRKDDKGNTL<br>IVNNLNGLYDKDNDKLKKLINKSPEKLLMYHHDPQTYQKL<br>KLIMEQYGDEKNPLYKYYEETGNYLTKYSKKDNGPVIKKI<br>KYYGNKLNAHLDITDDYPNSRNKVVKLSLKPYRFDVYLDN<br>GVYKFVTVKNLDVIKKENYYEVNSKCYEEAKKLKKISNQA<br>EFIASFYNNDLIKINGELYRVIGVNNDLLNRIEVNMIDIT<br>YREYLENMNDKRPPRIIKTIASKTQSIKKYSTDILGNLYE<br>VKSKKHPQIIKKG | N580A |
| SauCas9-KKH | *Staphylococcus aureus* | 3265 | MKRNYILGLDIGITSVGYGIIDYETRDVIDAGVRLFKEAN<br>VENNEGRRSKRGARRLKRRRRHRIQRVKKLLFDYNLLTDH<br>SELSGINPYEARVKGLSQKLSEEEFSAALLHLAKRRGVHN<br>VNEVEEDTGNELSTKEQISRNSKALEEKYVAELQLERLKK<br>DGEVRGSINRFKTSDYVKEAKQLLKVQKAYHQLDQSFIDT<br>YIDLLETRRTYYEGPGEGSPFGWKDIKEWYEMLMGHCTYF<br>PEELRSVKYAYNADLYNALNVYHDIKDITARKEIIENAEL<br>LDQIAKILTIYQSSEDIQEELTNLNSELTQEEIEQISNLK<br>GYTGTHNLSLKAINLILDELWHTNDNQIAIFNRLKLVPKK<br>VDLSQQKEIPTTLVDDFILSPVVKRSFIQSIKVINAIIKK<br>YGLPNDIIIELAREKNSKDAQKMINEMQKRNRQTNERIEE<br>IIRTTGKENAKYLIEKIKLHDMQEGKCLYSLEAIPLEDLL<br>NNPFNYEVDHIIPRSVSFDNSFNNKVLVKQEENSKKGNRT<br>PFQYLSSSDSKISYETFKKHILNLAKGKGRISKTKKEYLL<br>EERDINRFSVQKDFINRNLVDTRYATRGLMNLLRSYFRVN<br>NLDVKVKSINGGFTSFLRRKWKFKKERNKGYKHHAEDALI<br>IANADFIFKEWKKLDKAKKVMENQMFEEKQAESMPEIETE<br>QEYKEIFITPHQIKHIKDFKDYKYSHRVDKKPNRKLINDT<br>LYSTRKDDKGNTLIVNNLNGLYDKDNDKLKKLINKSPEKL<br>LMYHHDPQTYQKLKLIMEQYGDEKNPLYKYYEETGNYLTK<br>YSKKDNGPVIKKIKYYGNKLNAHLDITDDYPNSRNKVVKL<br>SLKPYRFDVYLDNGVYKFVTVKNLDVIKKENYYEVNSKCY | N580A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | EEAKKLKKISNQAEFIASFYKNDLIKINGELYRVIGVNND LLNRIEVNMIDITYREYLENMNDKRPPHIIKTIASKTQSI KKYSTDILGNLYEVKSKKHPQIIKKG | |
| SauriCas9 | Staphylococcus auricularis | 3266 | MQENQQKQNYILGLDIGITSVGYGLIDSKTREVIDAGVRL FPEADSENNSNRRSKRGARRLKRRRIHRLNRVKDLLADYQ MIDLNNVPKSTDPYTIRVKGLREPLTKEEFAIALLHIAKR RGLHNISVSMGDEEQDNELSTKQQLQKNAQQLQDKYVCEL QLERLTNINKVRGEKNRFKTEDFVKEVKQLCETQRQYHNI DDQFIQQYIDLVSTRREYFEGPGNGSPYGWDGDLLKWYEK LMGRCTYFPEELRSVKYAYSADLFNALNDLNNLVVTRDDN PKLEYYEKYHIIENVFKQKKNPTLKQIAKEIGVQDYDIRG YRITKSGKPQFTSFKLYHDLKNIFEQAKYLEDVEMLDEIA KILTIYQDEISIKKALDQLPELLTESEKSQIAQLTGYTGT HRLSLKCIHIVIDELWESPENQMEIFTRLNLKPKKVEMSE IDSIPTTLVDEFILSPVVKRAFIQSIKVINAVINRFGLPE DIIIELAREKNSKDRRKFINKLQKQNEATRKKIEQLLAKY GNTNAKYMIEKIKLHDMQEGKCLYSLEAIPLEDLLSNPTH YEVDHIIPRSVSFDNSLNNKVLVKQSENSKKGNRTPYQYL SSNESKISYNQFKQHILNLSKAKDRISKKKRDMLLEERDI NKFEVQKEFINRNLVDTRYATRELSNLLKTYFSTHDYAVK VKTINGGFTNHLRKVWDFKKHRNHGYKHHAEDALVIANAD FLFKTHKALRRTDKILEQPGLEVNDTTVKVDTEEKYQELF ETPKQVKNIKQFRDFKYSHRVDKKPNRQLINDTLYSTREI DGETYVVQTLKDLYAKDNEKVKKLFTERPQKILMYQHDPK TFEKLMTILNQYAEAKNPLAAYYEDKGEYVTKYAKKGNGP AIHKIKYIDKKLGSYLDVSNKYPETQNKLVKLSLKSFRFD IYKCEQGYKMVSIGYLDVLKKDNYYIPKDKYEAEKQKKK IKESDLFVGSFYYNDLIMYEDELFRVIGVNSDINNLVELN MVDITYKDFCEVNNVTGEKRIKKTIGKRVVLIEKYTTDIL GNLYKTPLPKKPQLIFKRGEL | N588A |
| SauriCas9-KKH | Staphylococcus auricularis | 3267 | MQENQQKQNYILGLDIGITSVGYGLIDSKTREVIDAGVRL FPEADSENNSNRRSKRGARRLKRRRIHRLNRVKDLLADYQ MIDLNNVPKSTDPYTIRVKGLREPLTKEEFAIALLHIAKR RGLHNISVSMGDEEQDNELSTKQQLQKNAQQLQDKYVCEL QLERLTNINKVRGEKNRFKTEDFVKEVKQLCETQRQYHNI DDQFIQQYIDLVSTRREYFEGPGNGSPYGWDGDLLKWYEK LMGRCTYFPEELRSVKYAYSADLFNALNDLNNLVVTRDDN PKLEYYEKYHIIENVFKQKKNPTLKQIAKEIGVQDYDIRG YRITKSGKPQFTSFKLYHDLKNIFEQAKYLEDVEMLDEIA KILTIYQDEISIKKALDQLPELLTESEKSQIAQLTGYTGT HRLSLKCIHIVIDELWESPENQMEIFTRLNLKPKKVEMSE IDSIPTTLVDEFILSPVVKRAFIQSIKVINAVINRFGLPE DIIIELAREKNSKDRRKFINKLQKQNEATRKKIEQLLAKY GNTNAKYMIEKIKLHDMQEGKCLYSLEAIPLEDLLSNPTH YEVDHIIPRSVSFDNSLNNKVLVKQSENSKKGNRTPYQYL SSNESKISYNQFKQHILNLSKAKDRISKKKRDMLLEERDI NKFEVQKEFINRNLVDTRYATRELSNLLKTYFSTHDYAVK VKTINGGFTNHLRKVWDFKKHRNHGYKHHAEDALVIANAD FLFKTHKALRRTDKILEQPGLEVNDTTVKVDTEEKYQELF ETPKQVKNIKQFRDFKYSHRVDKKPNRKLINDTLYSTREI DGETYVVQTLKDLYAKDNEKVKKLFTERPQKILMYQHDPK TFEKLMTILNQYAEAKNPLAAYYEDKGEYVTKYAKKGNGP AIHKIKYIDKKLGSYLDVSNKYPETQNKLVKLSLKSFRFD IYKCEQGYKMVSIGYLDVLKKDNYYIPKDKYEAEKQKKK IKESDLFVGSFYKNDLIMYEDELFRVIGVNSDINNLVELN MVDITYKDFCEVNNVTGEKHIKKTIGKRVVLIEKYTTDIL GNLYKTPLPKKPQLIFKRGEL | N588A |
| ScaCas9-Sc++ | Streptococcus canis | 3268 | MEKKYSIGLDIGTNSVGWAVITDDYKVPSKKFKVLGNTNR KSIKKNLMGALLFDSGETAEATRLKRTARRRYTRRKNRIR YLQEIFANEMAKLDDSFFQRLEESFLVEEDKKNERHPIFG NLADEVAYHRNYPTIYHLRKKLADSPEKADLRLIYLALAH IIKFRGHFLIEGKLNAENSDVAKLFYQLIQTYNQLFEESP LDEIEVDAKGILSARLSKSRRLEKLIAVFPNEKKNGLFGN IIALALGLTPNFKSNFDLTEDAKLQLSKDTYDDDLDELLG QIGDQYADLFSAAKNLSDAILLSDILRSNSEVTKAPLSAS MVKRYDEHHQDLALLKTLVRQQFPEKYAEIFKDDTKNGYA GYVGADKKLRKRSGKLATEEEFYKFIKPILEKMDGAEELL AKLNRDDLLRKQRTFDNGSIPHQIHLKELHAILRRQEEFY PFLKENREKIEKILTFRIPYYVGPLARGNSRFAWLTRKSE EAITPWNFEEVVDKGASAQSFIERMTNFDEQLPNKKVLPK HSLLYEYFTVYNELTKVKYVTERMRKPEFLSGEQKKAIVD |  N872A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | LLFKTNRKVTVKQLKEDYFKKIECFDSVEIIGVEDRFNAS LGTYHDLLKIIKDKDFLDNEENEDILEDIVLTLTLFEDRE MIEERLKTYAHLFDDKVMKQLKRRHYTGWGRLSRKMINGI RDKQSGKTILDFLKSDGFSNRNFMQLIHDDSLTFKEEIEK AQVSGQGDSLHEQIADLAGSPAIKKGILQTVKIVDELVKV MGHKPENIVIEMARENQTTTKGLQQSRERKKRIEEGIKEL ESQILKENPVENTQLQNEKLYLYYLQNGRDMYVDQELDIN RLSDYDVDHIVPQSFIKDDSIDNKVLTRSVENRGKSDNVP SEEVVKKMKNYWRQLLNAKLITQRKFDNLTKAERGGLSEA DKAGFIKRQLVETRQITKHVARILDSRMNTKRDKNDKPIR EVKVITLKSKLVSDFRKDFQLYKVRDINNYHHAHDAYLNA VVGTALIKKYPKLESEFVYGDYKVYDVRKMIAKSEQEIGK ATAKRFFYSNIMNFFKTEVKLANGEIRKRPLIETNGETGE VVWNKEKDFATVRKVLAMPQVNIVKKTEVQTGGFSKESIL SKRESAKLIPRKKGWDTRKYGGFGSPTVAYSILVVAKVEK GKAKKLKSVKVLVGITIMEKGSYEKDPIGFLEAKGYKDIK KELIFKLPKYSLFELENGRRRMLASAKELQKANELVLPQH LVRLLYYTQNISATTGSNNLGYIEQHREEFKEIFEKIIDF SEKYILKNKVNSNLKSSFDEQFAVSDSILLSNSFVSLLKY TSFGASGGFTFLDLDVKQGRLRYQTVTEVLDATLIYQSIT GLYETRTDLSQLGGD | |
| SpyCas9 | Streptococcus pyogenes | 3269 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLNREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKRNSDKLI ARKKDWDPKKYGGFDSPTVAYSVLVVAKVEKGKSKKLKSV KELLGITIMERSSFEKNPIDFLEAKGYKEVKKDLIIKLPK YSLFELENGRKRMLASAGELQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PAAFKYFDTTIDRKRYTSTKEVLDATLIHQSITGLYETRI DLSQLGGD | N863A |
| SpyCas9-NG | Streptococcus pyogenes | 3270 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLNREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA | N863A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESIRPKRNSDKLI ARKKDWDPKKYGGFVSPTVAYSVLVVAKVEKGKSKKLKSV KELLGITIMERSSFEKNPIDFLEAKGYKEVKKDLIIKLPK YSLFELENGRKRMLASARFLQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PRAFKYFDTTIDRKVYRSTKEVLDATLIHQSITGLYETRI DLSQLGGD | |
| SpyCas9-SpRY | Streptococcus pyogenes | 3271 | MDKKYSIGLDIGTNSVGWAVITDEYKVPSKKFKVLGNTDR HSIKKNLIGALLFDSGETAERTRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLNREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESIRPKRNSDKLI ARKKDWDPKKYGGFLWPTVAYSVLVVAKVEKGKSKKLKSV KELLGITIMERSSFEKNPIDFLEAKGYKEVKKDLIIKLPK YSLFELENGRKRMLASAKQLQKGNELALPSKYVNFLYLAS HYEKLKGSPEDNEQKQLFVEQHKHYLDEIIEQISEFSKRV ILADANLDKVLSAYNKHRDKPIREQAENIIHLFTLTRLGA PRAFKYFDTTIDPKQYRSTKEVLDATLIHQSITGLYETRI DLSQLGGD | N863A |
| St1Cas9 | Streptococcus thermophilus | 3272 | MSDLVLGLDIGIGSVGVGILNKVTGEIIHKNSRIFPAAQA ENNLVRRTNRQGRRLARRKKHRRVRLNRLFEESGLITDFT KISINLNPYQLRVKGLTDELSNEELFIALKNMVKHRGISY LDDASDDGNSSVGDYAQIVKENSKQLETKTPGQIQLERYQ TYGQLRGDFTVEKDGKKHRLINVFPTSAYRSEALRILQTQ QEFNPQITDEFINRYLEILTGKRKYYHGPGNEKSRTDYGR YRTSGETLDNIFGILIGKCTFYPDEFRAAKASYTAQEFNL LNDLNNLTVPTETKKLSKEQKNQIINYVKNEKAMGPAKLF KYIAKLLSCDVADIKGYRIDKSGKAEIHTFEAYRKMKTLE TLDIEQMDRETLDKLAYVLTLNTEREGIQEALEHEFADGS FSQKQVDELVQFRKANSSIFGKGWHNFSVKLMMELIPELY ETSEEQMTILTRLGKQKTTSSSNKTKYIDEKLLTEEIYNP VVAKSVRQAIKIVNAAIKEYGDFDNIVIEMARETNEDDEK KAIQKIQKANKDEKDAAMLKAANQYNGKAELPHSVFHGHK QLATKIRLWHQQGERCLYTGKTISIHDLINNSNQFEVDHI LPLSITFDDSLANKVLVYATANQEKGQRTPYQALDSMDDA WSFRELKAFVRESKTLSNKKKEYLLTEEDISKFDVRKKFI ERNLVDTRYASRVVLNALQEHFRAHKIDTKVSVVRGQFTS QLRRHWGIEKTRDTYHHHAVDALIIAASSQLNLWKKQKNT | N622A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | LVSYSEDQLLDIETGELISDDEYKESVFKAPYQHFVDTLK SKEFEDSILFSYQVDSKFNRKISDATIYATRQAKVGKDKA DETYVLGKIKDIYTQDGYDAFMKIYKKDKSKFLMYRHDPQ TFEKVIEPILENYPNKQINEKGKEVPCNPFLKYKEEHGYI RKYSKKGNGPEIKSLKYYDSKLGNHIDITPKDSNNKVVLQ SVSPWRADVYFNKTTGKYEILGLKYADLQFEKGTGTYKIS QEKYNDIKKKEGVDSDSEFKFTLYKNDLLLVKDTETKEQQ LFRFLSRTMPKQKHYVELKPYDKQKFEGGEALIKVLGNVA NSGQCKKGLGKSNISIYKVRTDVLGNQHIIKNEGDKPKLD F | |
| BlatCas9 | Brevibacillus laterosporus | 3273 | MAYTMGIDVGIASCGWAIVDLERQRIIDIGVRTFEKAENP KNGEALAVPRREARSSRRRLRKKHRIERLKHMFVRNGLA VDIQHLEQTLRSQNEIDVWQLRVDGLDRMLTQKEWLRVLI HLAQRRGFQSNRKTDGSSEDGQVLVNVTENDRLMEEKDYR TVAEMMVKDEKFSDHKRNKNGNYHGVVSRSSLLVEIHTLF ETQRQHHNSLASKDFELEYVNIWSAQRPVATKDQIEKMIG TCTFLPKEKRAPKASWHFQYFMLLQTINHIRITNVQGTRS LNKEEIEQVVNMALTKSKVSYHDTRKILDLSEEYQFVGLD YGKEDEKKKVESKETIIKLDDYHKLNKIFNEVELAKGETW EADDYDTVAYALTFFKDDEDIRDYLQNKYKDSKNRLVKNL ANKEYTNELIGKVSTLSFRKVGHLSLKALRKIIPFLEQGM TYDKACQAAGFDFQGISKKKRSVVLPVIDQISNPVVNRAL TQTRKVINALIKKYGSPETIHIETARELSKTFDERKNITK DYKENRDKNEHAKKHLSELGIINPTGLDIVKYKLWCEQQG RCMYSNQPISFERLKESGYTEVDHIIPYSRSMNDSYNNRV LVMTRENREKGNQTPFEYMGNDTQRWYEFEQRVTTNPQIK KEKRQNLLLKGFTNRRELEMLERNLNDTRYITKYLSHFIS TNLEFSPSDKKKKVVNTSGRITSHLRSRWGLEKNRGQNDL HHAMDAIVIAVTSDSFIQQVTNYYKRKERRELNGDDKFPL PWKFFREEVIARLSPNPKEQIEALPNHFYSEDELADLQPI FVSRMPKRSITGEAHQAQFRRVVGKTKEGKNITAKKTALV DISYDKNGDFNMYGRETDPATYEAIKERYLEFGGNVKKAF STDLHKPKKDGTKGPLIKSVRIMENKTLVHPVNKPNDLIF IRQNPKKKISLKKRIESHSISDSKEVQEIHAYYKGVDSST AAIEFIIHDGSYYAKGVGVQNLDCFEKYQVDILGNYFKVK GEKRLELETSDSNHKGKDVNSIKSTSR | N607A |
| cCas9-v16 | Staphylococcus aureus | 3274 | MKRNYILGLDIGITSVGYGIIDYETRDVIDAGVRLFKEAN VENNEGRRSKRGARRLKRRRRHRIQRVKKLLFDYNLLTDH SELSGINPYEARVKGLSQKLSEEEFSAALLHLAKRRGVHN VNEVEEDTGNELSTKEQISRNSKALEEKYVAELQLERLKK DGEVRGSINRFKTSDYVKEAKQLLKVQKAYHQLDQSFIDT YIDLLETRRTYYEGPGEGSPFGWKDIKEWYEMLMGHCTYF PEELRSVKYAYNADLYNALNVYHDIKDITARKEIIENAEL LDQIAKILTIYQSSEDIQEELTNLNSELTQEEIEQISNLK GYTGTHNLSLKAINLILDELWHTNDNQIAIFNRLKLVPKK VDLSQQKEIPTTLVDDFILSPVVKRSFIQSIKVINAIIKK YGLPNDIIIELAREKNSKDAQKMINEMQKRNRQTNERIEE IIRTTGKENAKYLIEKIKLHDMQEGKCLYSLEAIPLEDLL NNPFNYEVDHIIPRSVSFDNSFNNKVLVKQEENSKKGNRT PFQYLSSSDSKISYETFKKHILNLAKGKGRISKTKKEYLL EERDINRFSVQKDFINRNLVDTRYATRGLMNLLRSYFRVN NLDVKVKSINGGFTSFLRRKWKFKKERNKGYKHHAEDALI IANADFIFKEWKKLDKAKKVMENQMFEEKQAESMPEIETE QEYKEIFITPHQIKHIKDFKDYKYSHRVDKKPNRKLINDT LYSTRKDDKGNTLIVNNLNGLYDKDNDKLKKLINKSPEKL LMYHHDPQTYQKLKLIMEQYGDEKNPLYKYYEETGNYLTK YSKKDNGPVIKKIKYYGNKLNAHLDITDDYPNSRNKVVKL SLKPYRFDVYLDNGVYKFVTVKNLDVIKKENYYEVNSKCY EEAKKLKKISNQAEFIASFYKNDLIKINGELYRVIGVNSD KNNLIEVNMIDITYREYLENMNDKRPPHIIKTIASKTQSI KKYSTDILGNLYEVKSKKHPQIIKKG | N580A |
| cCas9-v17 | Staphylococcus aureus | 3275 | MKRNYILGLDIGITSVGYGIIDYETRDVIDAGVRLFKEAN VENNEGRRSKRGARRLKRRRRHRIQRVKKLLFDYNLLTDH SELSGINPYEARVKGLSQKLSEEEFSAALLHLAKRRGVHN VNEVEEDTGNEFIDTYIDLLETRRTYYEGPGEGSPFGWKD IKEWYEMLMGHCTYFPEELRSVKYAYNADLYNALNDLNNL VITRDENEKLEYYEKFQIIENVFKQKKKPTLKQIAKEILV NEEDIKGYRVSTGKPEFTNLKVYHDIKDITARKEIIENA ELLDQIAKILTIYQSSEDIQEELTNLNSELTQEEIEQISN LKGYTGTHNLSLKAINLILDELWHTNDNQIAIFNRLKLVP KKVDLSQQKEIPTTLVDDFILSPVVKRSFIQSIKVINAII | N580A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | KKYGLPNDIIIELAREKNSKDAQKMINEMQKRNRQTNERI EEIIRTTGKENAKYLIEKIKLHDMQEGKCLYSLEAIPLED LLNNPFNYEVDHIIPRSVSFDNSFNNKVLVKQEENSKKGN RTPFQYLSSSDSKISYETFKKHILNLAKGKGRISKTKKEY LLEERDINRFSVQKDFINRNLVDTRYATRGLMNLLRSYFR VNNLDVKVKSINGGFTSFLRRKWKFKKERNGYKHHAEDA LIIANADFIFKEWKKLDKAKKVMENQMFEEKQAESMPEIE TEQEYKEIFITPHQIKHIKDFKDYKYSHRVDKKPNRKLIN DTLYSTRKDDKGNTLIVNNLNGLYDKDNDKLKKLINKSPE KLLMYHHDPQTYQKLKLIMEQYGDEKNPLYKYYEETGNYL TKYSKKDNGPVIKKIKYYGNKLNAHLDITDDYPNSRNKVV KLSLKPYRFDVYLDNGVYKFVTVKNLDVIKKENYYEVNSK CYEEAKKLKKISNQAEFIASFYKNDLIKINGELYRVIGVN NSTRNIVELNMIDITYREYLENMNDKRPPHIIKTIASKTQ SIKKYSTDILGNLYEVKSKKHPQIIKKG | |
| cCas9-v21 | Staphylococcus aureus | 3276 | MKRNYILGLDIGITSVGYGIIDYETRDVIDAGVRLFKEAN VENNEGRRSKRGARRLKRRRRHRIQRVKKLLFDYNLLTDH SELSGINPYEARVKGLSQKLSEEEFSAALLHLAKRRGVHN VNEVEEDTGNELSTKEQISRNSKALEEKYVAELQLERLKK DGEVRGSINRFKTSDYVKEAKQLLKVQKAYHQLDQSFIDT YIDLLETRRTYYEGPGEGSPFGWKDIKEWYEMLMGHCTYF PEELRSVKYAYNADLYNALNDLNNLVITRDENEKLEYYEK FQIIENVFKQKKKPTLKQIAKEILVNEEDIKGYRVTSTGK PEFTNLKVYHDIKDITARKEIIENAELLDQIAKILTIYQS SEDIQEELTNLNSELTQEEIEQISNLKGYTGTHNLSLKAI NLILDELWHTNDNQIAIFNRLKLVPKKVDLSQQKEIPTTL VDDDFILSPVVKRSFIQSIKVINAIIKKYGLPNDIIIELAR EKNSKDAQKMINEMQKRNRQTNERIEEIIRTTGKENAKYL IEKIKLHDMQEGKCLYSLEAIPLEDLLNNPFNYEVDHIIP RSVSFDNSFNNKVLVKQEENSKKGNRTPFQYLSSSDSKIS YETFKKHILNLAKGKGRISKTKKEYLLEERDINRFSVQKD FINRNLVDTRYATRGLMNLLRSYFRVNNLDVKVKSINGGF TSFLRRKWKFKKERNGYKHHAEDALIIANADFIFKEWKK LDKAKKVMENQMFEEKQAESMPEIETEQEYKEIFITPHQI KHIKDFKDYKYSHRVDKKPNRKLINDTLYSTRKDDKGNTL IVNNLNGLYDKDNDKLKKLINKSPEKLLMYHHDPQTYQKL KLIMEQYGDEKNPLYKYYEETGNYLTKYSKKDNGPVIKKI KYYGNKLNAHLDITDDYPNSRNKVVKLSLKPYRFDVYLDN GVYKFVTVKNLDVIKKENYYEVNSKCYEEAKKLKKISNQA EFIASFYKNDLIKINGELYRVIGVNSDDRNIIELNMIDIT YREYLENMNDKRPPHIIKTIASKTQSIKKYSTDILGNLYE VKSKKHPQIIKKG | N580A |
| cCas9-v42 | Staphylococcus aureus | 3277 | MKRNYILGLDIGITSVGYGIIDYETRDVIDAGVRLFKEAN VENNEGRRSKRGARRLKRRRRHRIQRVKKLLFDYNLLTDH SELSGINPYEARVKGLSQKLSEEEFSAALLHLAKRRGVHN VNEVEEDTGNELSTKEQISRNSKALEEKYVAELQLERLKK DGEVRGSINRFKTSDYVKEAKQLLKVQKAYHQLDQSFIDT YIDLLETRRTYYEGPGEGSPFGWKDIKEWYEMLMGHCTYF PEELRSVKYAYNADLYNALNDLNNLVITRDENEKLEYYEK FQIIENVFKQKKKPTLKQIAKEILVNEEDIKGYRVTSTGK PEFTNLKVYHDIKDITARKEIIENAELLDQIAKILTIYQS SEDIQEELTNLNSELTQEEIEQISNLKGYTGTHNLSLKAI NLILDELWHTNDNQIAIFNRLKLVPKKVDLSQQKEIPTTL VDDDFILSPVVKRSFIQSIKVINAIIKKYGLPNDIIIELAR EKNSKDAQKMINEMQKRNRQTNERIEEIIRTTGKENAKYL IEKIKLHDMQEGKCLYSLEAIPLEDLLNNPFNYEVDHIIP RSVSFDNSFNNKVLVKQEENSKKGNRTPFQYLSSSDSKIS YETFKKHILNLAKGKGRISKTKKEYLLEERDINRFSVQKD FINRNLVDTRYATRGLMNLLRSYFRVNNLDVKVKSINGGF TSFLRRKWKFKKERNGYKHHAEDALIIANADFIFKEWKK LDKAKKVMENQMFEEKQAESMPEIETEQEYKEIFITPHQI KHIKDFKDYKYSHRVDKKPNRKLINDTLYSTRKDDKGNTL IVNNLNGLYDKDNDKLKKLINKSPEKLLMYHHDPQTYQKL KLIMEQYGDEKNPLYKYYEETGNYLTKYSKKDNGPVIKKI KYYGNKLNAHLDITDDYPNSRNKVVKLSLKPYRFDVYLDN GVYKFVTVKNLDVIKKENYYEVNSKCYEEAKKLKKISNQA EFIASFYKNDLIKINGELYRVIGVNNNRLNKIELNMIDIT YREYLENMNDKRPPHIIKTIASKTQSIKKYSTDILGNLYE VKSKKHPQIIKKG | N580A |

TABLE 16-continued

CRISPR/Cas Proteins, Species, and Mutations

| Variant | Parental Host | SEQ ID NO: | Protein Sequence | Nickase Mutation |
|---|---|---|---|---|
| CdiCas9 | Corynebacterium diphtheriae | 3278 | MKYHVGIDVGTFSVGLAAIEVDDAGMPIKTLSLVSHIHDS GLDPDEIKSAVTRLASSGIARRTRRLYRRKRRRLQQLDKF IQRQGWPVIELEDYSDPLYPWKVRAELAASYIADEKERGE KLSVALRHIARHRGWRNPYAKVSSLYLPDGPSDAFKAIRE EIKRASGQPVPETATVGQMVTLCELGTLKLRGEGGVLSAR LQQSDYAREIQEICRMQEIGQELYRKIIDVVFAAESPKGS ASSRVGKDPLQPGKNRALKASDAFQRYRIAALIGNLRVRV DGEKRILSVEEKNLVFDHLVNLTPKKEPEWVTIAEILGID RGQLIGTATMTDDGERAGARPPTHDTNRSIVNSRIAPLVD WWKTASALEQHAMVKALSNAEVDDFDSPEGAKVQAFFADL DDDVHAKLDSLHLPVGRAAYSEDTLVRLTRRMLSDGVDLY TARLQEFGIEPSWTPPTPRIGEPVGNPAVDRVLKTVSRWL ESATKTWGAPERVIIEHVREGFVTEKRAREMDGDMRRRAA RNAKLFQEMQEKLNVQGKPSRADLWRYQSVQRQNCQCAYC GSPITFSNSEMDHIVPRAGQGSTNTRENLVAVCHRCNQSK GNTPFAIWAKNTSIEGVSVKEAVERTRHWVTDTGMRSTDF KKFTKAVVERFQRATMDEEIDARSMESVAWMANELRSRVA QHFASHGTTVRVYRGSLTAEARRASGISGKLKFFDGVGKS RLDRRHHAIDAAVIAFTSDYVAETLAVRSNLKQSQAHRQE APQWREFTGKDAEHRAAWRVWCQKMEKLSALLTEDLRDDR VVVMSNVRLRLGNGSAHKETIGKLSKVKLSSQLSVSDIDK ASSEALWCALTREPGFDPKEGLPANPERHIRVNGTHVYAG DNIGLFPVSAGSIALRGGYAELGSSFHHARVYKITSGKKP AFAMLRVYTIDLLPYRNQDLFSVELKPQTMSMRQAEKKLR DALATGNAEYLGWLVVDDELVVDTSKIATDQVKAVEAELG TIRRWRVDGFFSPSKLRLRPLQMSKEGIKKESAPELSKII DRPGWLPAVNKLFSDGNVTVVRRDSLGRVRLESTAHLPVT WKVQ | H573A (Alternate) |
| CjeCas9 | Campylobacter jejuni | 3279 | MARILAFDIGISSIGWAFSENDELKDCGVRIFTKVENPKT GESLALPRRLARSARKRLARRKARLNHLKHLIANEFKLNY EDYQSFDESLAKAYKGSLISPYELRFRALNELLSKQDFAR VILHIAKRRGYDDIKNSDDKEKGAILKAIKQNEEKLANYQ SVGEYLYKEYFQKFKENSKEFTNVRNKKESYERCIAQSFL KDELKLIFKKQREFGFSFSKKFEEEVLSVAFYKRALKDFS HLVGNCSFFTDEKRAPKNSPLAFMFVALTRIINLLNNLKN TEGILYTKDDLNALLNEVLKNGTLTYKQTKKLLGLSDDYE FKGEKGTYFIEFKKYKEFIKALGEHNLSQDDLNEIAKDIT LIKDEIKLKKALAKYDLNQNQIDSLSKLEFKDHLNISFKA LKLVTPLMLEGKKYDEACNELNLKVAINEDKKDFLPAFNE TYYKDEVTNPVVLRAIKEYRKVLNALLKKYGKVHKINIEL AREVGKNHSQRAKIEKEQNENYKAKKDAELECEKLGLKIN SKNILKLRLFKEQKEFCAYSGEKIKISDLQDEKMLEIDHI YPYSRSFDDSYMNKVLVFTKQNQEKLNQTPFEAFGNDSAK WQKIEVLAKNLPTKKQKRILDKNYKDKEQKNFKDRNLNDT RYIARLVLNYTKDYLDFLPLSDDENTKLNDTQKGSKVHVE AKSGMLTSALRHTWGFSAKDRNNHLHHAIDAVIIAYANNS IVKAFSDFKKEQESNSAELYAKKISELDYKNKRKFFEPFS GFRQKVLDKIDEIFVSKPERKKPSGALHEETFRKEEEFYQ SYGGKEGVLKALELGKIRKVNGKIVKNGDMFRVDIFKHKK TNKFYAVPIYTMDFALKVLPNKAVARSKKGEIKDWILMDE NYEFCFSLYKDSLILIQTKDMQEPEFVYYNAFTSSTVSLI VSKHDNKFETLSKNQKILFKNANEKEVIAKSIGIQNLKVF EKYIVSALGEVTKAEFRQREDFKK | N582A |
| GeoCas9 | Geobacillus stearothermophilus | 3280 | MRYKIGLDIGITSVGWAVMNLDIPRIEDLGVRIFDRAENP QTGESLALPRRLARSARRRLRRRKHRLERIRRLVIREGIL TKEELDKLFEEKHEIDVWQLRVEALDRKLNNDELARVLLH LAKRRGFKSNRKSERSNKENSTMLKHIEENRAILSSYRTV GEMIVKDPKFALHKRNKGENYTNTIARDDLEREIRLIFSK QREFGNMSCTEEFENEYITIWASQRPVASKDDIEKKVGFC TFEPKEKRAPKATYTFQSFIAWEHINKLRLISPSGARGLT DEERRLLYEQAFQKNKITYHDIRTLLHLPDDTYFKGIVYD RGESRKQNENIRFLELDAYHQIRKAVDKVYGKGKSSSFLP IDFDTFGYALTLFKDDADIHSYLRNEYEQNGKRMPNLANK VYDNELIEELLNLSFTKFGHLSLKALRSILPYMEQGEVYS SACERAGYTFTGPKKKQKTMLLPNIPPIANPVVMRALTQA RKVVNAIIKKYGSPVSIHIELARDLSQTFDERRKTKKEQD ENRKKNETAIRQLMEYGLTLNPTGHDIVKFKLWSEQNGRC AYSLQPIEIERLLEPGYVEVDHVIPYSRSLDDSYTNKVLV LTRENREKGNRIPAEYLGVGTERWQQFETFVLTNKQFSKK KRDRLLRLHYDENEETEFKNRNLNDTRYISRFFANFIREH LKFAESDDKQKVYTVNGRVTAHLRSRWEFNKNREESDLHH | N605A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | AVDAVIVACTTPSDIAKVTAFYQRREQNKELAKKTEPHFP QPWPHFADELRARLSKHPKESIKALNLGNYDDQKLESLQP VFVSRMPKRSVTGAAHQETLRRYVGIDERSGKIQTVVKTK LSEIKLDASGHFPMYGKESDPRTYEAIRQRLLEHNNDPKK AFQEPLYKPKKNGEPGPVIRTVKIIDTKNQVIPLNDGKTV AYNSNIVRVDVFEKDGKYYCVPVYTMDIMKGILPNKAIEP NKPYSEWKEMTEDYTFRFSLYPNDLIRIELPREKTVKTAA GEEINVKDVFVYYKTIDSANGGLELISHDHRFSLRGVGSR TLKRFEKYQVDVLGNIYKVRGEKRVGLASSAHSKPGKTIR PLQSTRD | |
| iSpyMac Cas9 | Streptococcus spp. | 3281 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRKLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLKREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEIQTVGQNGGLFDDNPKSPLEV TPSKLVPLKKELNPKKYGGYQKPTTAYPVLLITDTKQLIP ISVMNKKQFEQNPVKFLRDRGYQQVGKNDFIKLPKYTLVD IGDGIKRLWASSKEIHKGNQLVVSKKSQILLYHAHHLDSD LSNDYLQNHNQQFDVLFNEIISFSKKCKLGKEHIQKIENV YSNKKNSASIEELAESFIKLLGFTQLGATSPFNFLGVKLN QKQYKGKKDYILPCTEGTLIRQSITGLYETRVDLSKIGED SGGSGGSKRTADGSEFES | N863A |
| NmeCas9 | Neisseria meningitidis | 3282 | MAAFKPNSINYILGLDIGIASVGWAMVEIDEEENPIRLID LGVRVFERAEVPKTGDSLAMARRLARSVRRLTRRRAHRLL RTRRLLKREGVLQAANFDENGLIKSLPNTPWQLRAAALDR KLTPLEWSAVLLHLIKHRGYLSQRKNEGETADKELGALLK GVAGNAHALQTGDFRTPAELALNKFEKESGHIRNQRSDYS HTFSRKDLQAELILLFEKQKEFGNPHVSGGLKEGIETLLM TQRPALSGDAVQKMLGHCTFEPAEPKAAKNTYTAERFIWL TKLNNLRILEQGSERPLTDTERATLMDEPYRKSKLTYAQA RKLLGLEDTAFFKGLRYGKDNAEASTLMEMKAYHAISRAL EKEGLKDKKSPLNLSPELQDEIGTAFSLFKTDEDITGRLK DRIQPEILEALLKHISFDKFVQISLKALRRIVPLMEQGKR YDEACAEIYGDHYGKKNTEEKIYLPPIPADEIRNPVVLRA LSQARKVINGVVRRYGSPARIHIETAREVGKSFKDRKEIE KRQEENRKDREKAAAKFREYFPNFVGEPKSKDILKLRLYE QQHGKCLYSGKEINLGRLNEKGYVEIDHALPFSRTWDDSF NNKVLVLGSENQNKGNQTPYEYFNGKDNSREWQEFKARVE TSRFPRSKKQRILLQKFDEDGFKERNLNDTRYVNRFLCQF VADRMRLTGKGKKRVFASNGQITNLLRGFWGLRKVRAEND RHHALDAVVVACSTVAMQQKITRFVRYKEMNAFDGKTIDK ETGEVLHQKTHFPQPWEFFAQEVMIRVFGKPDGKPEFEEA DTLEKLRTLLAEKLSSRPEAVHEYVTPLFVSRAPNRKMSG QGHMETVKSAKRLDEGVSVLRVPLTQLKLKDLEKMVNRER EPKLYEALKARLEAHKDDPAKAFAEPFYKYDKAGNRTQQV KAVRVEQVQKTGVWVRNHNGIADNATMVRVDVFEKGDKYY LVPIYSWQVAKGILPDRAVVQGKDEEDWQLIDDSFNFKFS | N611A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | LHPNDLVEVITKKARMFGYFASCHRGTGNINIRIHDLDHK IGKNGILEGIGVKTALSFQKYQIDELGKEIRPCRLKKRPP VR | |
| ScaCas9 | Streptococcus canis | 3283 | MEKKYSIGLDIGTNSVGWAVITDDYKVPSKKFKVLGNTNR KSIKKNLMGALLFDSGETAEATRLKRTARRRYTRRKNRIR YLQEIFANEMAKLDDSFFQRLEESFLVEEDKKNERHPIFG NLADEVAYHRNYPTIYHLRKKLADSPEKADLRLIYLALAH IIKFRGHFLIEGKLNAENSDVAKLFYQLIQTYNQLFEESP LDEIEVDAKGILSARLSKSKRLEKLIAVFPNEKKNGLFGN IIALALGLTPNFKSNFDLTEDAKLQLSKDTYDDDLDELLG QIGDQYADLFSAAKNLSDAILLSDILRSNSEVTKAPLSAS MVKRYDEHHQDLALLKTLVRQQFPEKYAEIFKDDTKNGYA GYVGIGIKHRKRTTKLATQEEFYKFIKPILEKMDGAEELL AKLNRDDLLRKQRTFDNGSIPHQIHLKELHAILRRQEEFY PFLKENREKIEKILTFRIPYYVGPLARGNSRFAWLTRKSE EAITPWNFEEVVDKGASAQSFIERMTNFDEQLPNKKVLPK HSLLYEYFTVYNELTKVKYVTERMRKPEFLSGEQKKAIVD LLFKTNRKVTVKQLKEDYFKKIECFDSVEIIGVEDRFNAS LGTYHDLLKIIKDKDFLDNEENEDILEDIVLTLTLFEDRE MIEERLKTYAHLFDDKVMKQLKRRHYTGWGRLSRKMINGI RDKQSGKTILDFLKSDGFSNRNFMQLIHDDSLTFKEEIEK AQVSGQGDSLHEQIADLAGSPAIKKGILQTVKIVDELVKV MGHKPENIVIEMARENQTTTKGLQQSRERKKRIEEGIKEL ESQILKENPVENTQLQNEKLYLYYLQNGRDMYVDQELDIN RLSDYDVDHIVPQSFIKDDSIDNKVLTRSVENRGKSDNVP SEEVVKKMKNYWRQLLNAKLITQRKFDNLTKAERGGLSEA DKAGFIKRQLVETRQITKHVARILDSRMNTKRDKNDKPIR EVKVITLKSKLVSDFRKDFQLYKVRDINNYHHAHDAYLNA VVGTALIKKYPKLESEFVYGDYKVYDVRKMIAKSEQEIGK ATAKRFFYSNIMNFFKTEVKLANGEIRKRPLIETNGETGE VVWNKEKDFATVRKVLAMPQVNIVKKTEVQTGGFSKESIL SKRESAKLIPRKKGWDTRKYGGFGSPTVAYSILVVAKVEK GKAKKLKSVKVLVGITIMEKGSYEKDPIGFLEAKGYKDIK KELIFKLPKYSLFELENGRRRMLASATELQKANELVLPQH LVRLLYYTQNISATTGSNNLGYIEQHREEFKEIFEKIIDF SEKYILKNKVNSNLKSSFDEQFAVSDSILLSNSFVSLLKY TSFGASGGFTFLDLDVKQGRLRYQTVTEVLDATLIYQSIT GLYETRTDLSQLGGD | N872A |
| ScaCas9-HiFi-Sc++ | Streptococcus canis | 3284 | MEKKYSIGLDIGTNSVGWAVITDDYKVPSKKFKVLGNTNR KSIKKNLMGALLFDSGETAEATRLKRTARRRYTRRKNRIR YLQEIFANEMAKLDDSFFQRLEESFLVEEDKKNERHPIFG NLADEVAYHRNYPTIYHLRKKLADSPEKADLRLIYLALAH IIKFRGHFLIEGKLNAENSDVAKLFYQLIQTYNQLFEESP LDEIEVDAKGILSARLSKSKRLEKLIAVFPNEKKNGLFGN IIALALGLTPNFKSNFDLTEDAKLQLSKDTYDDDLDELLG QIGDQYADLFSAAKNLSDAILLSDILRSNSEVTKAPLSAS MVKRYDEHHQDLALLKTLVRQQFPEKYAEIFKDDTKNGYA GYVGADKKLRKRSGKLATEEEFYKFIKPILEKMDGAEELL AKLNRDDLLRKQRTFDNGSIPHQIHLKELHAILRRQEEFY PFLKENREKIEKILTFRIPYYVGPLARGNSRFAWLTRKSE EAITPWNFEEVVDKGASAQSFIERMTNFDEQLPNKKVLPK HSLLYEYFTVYNELTKVKYVTERMRKPEFLSGEQKKAIVD LLFKTNRKVTVKQLKEDYFKKIECFDSVEIIGVEDRFNAS LGTYHDLLKIIKDKDFLDNEENEDILEDIVLTLTLFEDRE MIEERLKTYAHLFDDKVMKQLKRRHYTGWGRLSRKMINGI RDKQSGKTILDFLKSDGFSNANFMQLIHDDSLTFKEEIEK AQVSGQGDSLHEQIADLAGSPAIKKGILQTVKIVDELVKV MGHKPENIVIEMARENQTTTKGLQQSRERKKRTEEGIKEL ESQILKENPVENTQLQNEKLYLYYLQNGRDMYVDQELDIN RLSDYDVDHIVPQSFIKDDSIDNKVLTRSVENRGKSDNVP SEEVVKKMKNYWRQLLNAKLITQRKFDNLTKAERGGLSEA DKAGFIKRQLVETRQITKHVARILDSRMNTKRDKNDKPIR EVKVITLKSKLVSDFRKDFQLYKVRDINNYHHAHDAYLNA VVGTALIKKYPKLESEFVYGDYKVYDVRKMIAKSEQEIGK ATAKRFFYSNIMNFFKTEVKLANGEIRKRPLIETNGETGE VVWNKEKDFATVRKVLAMPQVNIVKKTEVQTGGFSKESIL SKRESAKLIPRKKGWDTRKYGGFGSPTVAYSILVVAKVEK GKAKKLKSVKVLVGITIMEKGSYEKDPIGFLEAKGYKDIK KELIFKLPKYSLFELENGRRRMLASAKELQKANELVLPQH LVRLLYYTQNISATTGSNNLGYIEQHREEFKEIFEKIIDF | N872A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | SEKYILKNKVNSNLKSSFDEQFAVSDSILLSNSFVSLLKY TSFGASGGFTFLDLDVKQGRLRYQTVTEVLDATLIYQSIT GLYETRTDLSQLGGD | |
| SpyCas9-3var-NRRH | Streptococcus pyogenes | 3285 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MVKRYDEHHQDLTLLKALVRQQLPEKYKEIFFDQSKNGYA GYIDGGASQEEFYKFIKPILEKMDGTEELLVKLNREDLLR KQRTFDNGIIPHQIHLGELHAILRRQGDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRLRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGGHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKGNSDKLI ARKKDWDPKKYGGFNSPTAAYSVLVVAKVEKGKSKKLKSV KELLGITIMERSSFEKNPIGFLEAKGYKEVKKDLIIKLPK YSLFELENGRKRMLASAGVLHKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGV PAAFKYFDTTIDKKRYTSTKEVLDATLIHQSITGLYETRI DLSQLGGD | N863A |
| SpyCas9-3var-NRTH | Streptococcus pyogenes | 3286 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MVKRYDEHHQDLTLLKALVRQQLPEKYKEIFFDQSKNGYA GYIDGGASQEEFYKFIKPILEKMDGTEELLVKLNREDLLR KQRTFDNGIIPHQIHLGELHAILRRQGDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRLRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGGHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKGNSDKLI ARKKDWDPKKYGGFNSPTVAYSVLVVAKVEKGKSKKLKSV KELLGITIMERSSFEKNPIGFLEAKGYKEVKKDLIIKLPK YSLFELENGRKRMLASASVLHKGNELALPSKYVNFLYLAS | N863A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | HYEKLKGSSEDNKQKQLFVEQHKHYLDEIIEQISEFSKRV ILADANLDKVLSAYNKHRDKPIREQAENIIHLFTLTNLGA SAAFKYFDTTIGRKLYTSTKEVLDATLIHQSITGLYETRI DLSQLGGD | |
| SpyCas9-3var-NRCH | Streptococcus pyogenes | 3287 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MVKRYDEHHQDLTLLKALVRQQLPEKYKEIFFDQSKNGYA GYIDGGASQEEFYKFIKPILEKMDGTEELLVKLNREDLLR KQRTFDNGIIPHQIHLGELHAILRRQGDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRLRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGGHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKGNSDKLI ARKKDWDPKKYGGFNSPTVAYSVLVVAKVEKGKSKKLKSV KELLGITIMERSSFEKNPIDFLEAKGYKEVKKDLIIKLPK YSLFELENGRKRMLASAGVLQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PAAFKYFDTTINRKQYNTTKEVLDATLIRQSITGLYETRI DLSQLGGD | N863A |
| SpyCas9-HF1 | Streptococcus pyogenes | 3269 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLNREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKRNSDKLI ARKKDWDPKKYGGFDSPTVAYSVLVVAKVEKGKSKKLKSV KELLGITIMERSSFEKNPIDFLEAKGYKEVKKDLIIKLPK YSLFELENGRKRMLASAGELQKGNELALPSKYVNFLYLAS HYEKLKGSPNLGAPAAFKYFDTTIDRKRYTSTKEVLDATL IHQSITGLYETRIDLSQLGGD | N863A |

TABLE 16-continued

CRISPR/Cas Proteins, Species, and Mutations

| Variant | Parental Host | SEQ ID NO: | Protein Sequence | Nickase Mutation |
|---|---|---|---|---|
| SpyCas9-QQR1 | *Streptococcus pyogenes* | 3288 | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKRNSDKLI<br>ARKKDWDPKKYGGFDSPTVAYSVLVVAKVEKGKSKKLKSV<br>KELLGITIMERSSFEKNPIDFLEAKGYKEVKKDLIIKLPK<br>YSLFELENGRKRMLASARELQKGNELALPSKYVNFLYLAS<br>HYEKLKGSPEDNEQKQLFVEQHKHYLDEIIEQISEFSKRV<br>ILADAQLDKVLSAYNKHRDKPIREQAENIIHLFTLTNLGA<br>PAAFKYFDTTFKQKQYRSTKEVLDATLIHQSITGLYETRI<br>DLSQLGGD | N863A |
| SpyCas9-SpG | *Streptococcus pyogenes* | 3289 | MDKKYSIGLDIGTNSVGWAVITDEYKVPSKKFKVLGNTDR<br>HSIKKNLIGALLFDSGETAEATRLKRTARRRYTRRKNRIC<br>YLQEIFSNEMAKVDDSFFHRLEESFLVEEDKKHERHPIFG<br>NIVDEVAYHEKYPTIYHLRKKLVDSTDKADLRLIYLALAH<br>MIKFRGHFLIEGDLNPDNSDVDKLFIQLVQTYNQLFEENP<br>INASGVDAKAILSARLSKSRRLENLIAQLPGEKKNGLFGN<br>LIALSLGLTPNFKSNFDLAEDAKLQLSKDTYDDDLDNLLA<br>QIGDQYADLFLAAKNLSDAILLSDILRVNTEITKAPLSAS<br>MIKRYDEHHQDLTLLKALVRQQLPEKYKEIFFDQSKNGYA<br>GYIDGGASQEEFYKFIKPILEKMDGTEELLVKLNREDLLR<br>KQRTFDNGSIPHQIHLGELHAILRRQEDFYPFLKDNREKI<br>EKILTFRIPYYVGPLARGNSRFAWMTRKSEETITPWNFEE<br>VVDKGASAQSFIERMTNFDKNLPNEKVLPKHSLLYEYFTV<br>YNELTKVKYVTEGMRKPAFLSGEQKKAIVDLLFKTNRKVT<br>VKQLKEDYFKKIECFDSVEISGVEDRFNASLGTYHDLLKI<br>IKDKDFLDNEENEDILEDIVLTLTLFEDREMIEERLKTYA<br>HLFDDKVMKQLKRRRYTGWGRLSRKLINGIRDKQSGKTIL<br>DFLKSDGFANRNFMQLIHDDSLTFKEDIQKAQVSGQGDSL<br>HEHIANLAGSPAIKKGILQTVKVVDELVKVMGRHKPENIV<br>IEMARENQTTQKGQKNSRERMKRIEEGIKELGSQILKEHP<br>VENTQLQNEKLYLYYLQNGRDMYVDQELDINRLSDYDVDH<br>IVPQSFLKDDSIDNKVLTRSDKNRGKSDNVPSEEVVKKMK<br>NYWRQLLNAKLITQRKFDNLTKAERGGLSELDKAGFIKRQ<br>LVETRQITKHVAQILDSRMNTKYDENDKLIREVKVITLKS<br>KLVSDFRKDFQFYKVREINNYHHAHDAYLNAVVGTALIKK<br>YPKLESEFVYGDYKVYDVRKMIAKSEQEIGKATAKYFFYS<br>NIMNFFKTEITLANGEIRKRPLIETNGETGEIVWDKGRDF<br>ATVRKVLSMPQVNIVKKTEVQTGGFSKESILPKRNSDKLI<br>ARKKDWDPKKYGGFLWPTVAYSVLVVAKVEKGKSKKLKSV<br>KELLGITIMERSSFEKNPIDFLEAKGYKEVKKDLIIKLPK<br>YSLFELENGRKRMLASAKQLQKGNELALPSKYVNFLYLAS<br>HYEKLKGSPEDNEQKQLFVEQHKHYLDEIIEQISEFSKRV<br>ILADANLDKVLSAYNKHRDKPIREQAENIIHLFTLTNLGA<br>PAAFKYFDTTIDRKQYRSTKEVLDATLIHQSITGLYETRI<br>DLSQLGGD | N863A |

TABLE 16-continued

CRISPR/Cas Proteins, Species, and Mutations

| Variant | Parental Host | SEQ ID NO: | Protein Sequence | Nickase Mutation |
|---|---|---|---|---|
| SpyCas9-VOR | *Streptococcus pyogenes* | 3290 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLNREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKRNSDKLI ARKKDWDPKKYGGFVSPTVAYSVLVVAKVEKGKSKKLKSV KELLGITIMERSSFEKNPIDFLEAKGYKEVKKDLIIKLPK YSLFELENGRKRMLASAGELQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PAAFKYFDTTIDRKQYRSTKEVLDATLIHQSITGLYETRI DLSQLGGD | N863A |
| SpyCas9-VRER | *Streptococcus pyogenes* | 3291 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDAKLQLSKDTYDDDLDNLLA QIGDQYADLFLAAKNLSDAILLSDILRVNTEITKAPLSAS MIKRYDEHHQDLTLLKALVRQQLPEKYKEIFFDQSKNGYA GYIDGGASQEEFYKFIKPILEKMDGTEELLVKLNREDLLR KQRTFDNGSIPHQIHLGELHAILRRQEDFYPFLKDNREKI EKILTFRIPYYVGPLARGNSRFAWMTRKSEETITPWNFEE VVDKGASAQSFIERMTNFDKNLPNEKVLPKHSLLYEYFTV YNELTKVKYVTEGMRKPAFLSGEQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFMQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKRNSDKLI ARKKDWDPKKYGGFVSPTVAYSVLVVAKVEKGKSKKLKSV KELLGITIMERSSFEKNPIDFLEAKGYKEVKKDLIIKLPK YSLFELENGRKRMLASARELQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PAAFKYFDTTIDRKEYRSTKEVLDATLIHQSITGLYETRI DLSQLGGD | N863A |

TABLE 16-continued

CRISPR/Cas Proteins, Species, and Mutations

| Variant | Parental Host | SEQ ID NO: | Protein Sequence | Nickase Mutation |
|---|---|---|---|---|
| SpyCas9-xCas | *Streptococcus pyogenes* | 3292 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDTKLQLSKDTYDDDLDNLLA QIGDQYADLFLAAKNLSDAILLSDILRVNTEITKAPLSAS MIKLYDEHHQDLTLLKALVRQQLPEKYKEIFFDQSKNGYA GYIDGGASQEEFYKFIKPILEKMDGTEELLVKLNREDLLR KQRTFDNGIIPHQIHLGELHAILRRQEDFYPFLKDNREKI EKILTFRIPYYVGPLARGNSRFAWMTRKSEETITPWNFEK VVDKGASAQSFIERMTNFDKNLPNEKVLPKHSLLYEYFTV YNELTKVKYVTEGMRKPAFLSGDQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFIQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESILPKRNSDKLI ARKKDWDPKKYGGFDSPTVAYSVLVVAKVEKGKSKKLKSV KELLGITIMERSSFEKNPIDFLEAKGYKEVKKDLIIKLPK YSLFELENGRKRMLASAGVLQKGNELALPSKYVNFLYLAS HYEKLKGSPNLGAPAAFKYFDTTIDRKRYTSTKEVLDATL IHQSITGLYETRIDLSQLGGD | N863A |
| SpyCas9-xCas-NG | *Streptococcus pyogenes* | 3293 | MDKKYSIGLDIGTNSVGWAVITDEYKVPSKKFKVLGNTDR HSIKKNLIGALLFDSGETAEATRLKRTARRRYTRRKNRIC YLQEIFSNEMAKVDDSFFHRLEESFLVEEDKKHERHPIFG NIVDEVAYHEKYPTIYHLRKKLVDSTDKADLRLIYLALAH MIKFRGHFLIEGDLNPDNSDVDKLFIQLVQTYNQLFEENP INASGVDAKAILSARLSKSRRLENLIAQLPGEKKNGLFGN LIALSLGLTPNFKSNFDLAEDTKLQLSKDTYDDDLDNLLA QIGDQYADLFLAAKNLSDAILLSDILRVNTEITKAPLSAS MIKLYDEHHQDLTLLKALVRQQLPEKYKEIFFDQSKNGYA GYIDGGASQEEFYKFIKPILEKMDGTEELLVKLNREDLLR KQRTFDNGIIPHQIHLGELHAILRRQEDFYPFLKDNREKI EKILTFRIPYYVGPLARGNSRFAWMTRKSEETITPWNFEK VVDKGASAQSFIERMTNFDKNLPNEKVLPKHSLLYEYFTV YNELTKVKYVTEGMRKPAFLSGDQKKAIVDLLFKTNRKVT VKQLKEDYFKKIECFDSVEISGVEDRFNASLGTYHDLLKI IKDKDFLDNEENEDILEDIVLTLTLFEDREMIEERLKTYA HLFDDKVMKQLKRRRYTGWGRLSRKLINGIRDKQSGKTIL DFLKSDGFANRNFIQLIHDDSLTFKEDIQKAQVSGQGDSL HEHIANLAGSPAIKKGILQTVKVVDELVKVMGRHKPENIV IEMARENQTTQKGQKNSRERMKRIEEGIKELGSQILKEHP VENTQLQNEKLYLYYLQNGRDMYVDQELDINRLSDYDVDH IVPQSFLKDDSIDNKVLTRSDKNRGKSDNVPSEEVVKKMK NYWRQLLNAKLITQRKFDNLTKAERGGLSELDKAGFIKRQ LVETRQITKHVAQILDSRMNTKYDENDKLIREVKVITLKS KLVSDFRKDFQFYKVREINNYHHAHDAYLNAVVGTALIKK YPKLESEFVYGDYKVYDVRKMIAKSEQEIGKATAKYFFYS NIMNFFKTEITLANGEIRKRPLIETNGETGEIVWDKGRDF ATVRKVLSMPQVNIVKKTEVQTGGFSKESIRPKRNSDKLI ARKKDWDPKKYGGFVSPTVAYSVLVVAKVEKGKSKKLKSV KELLGITIMERSSFEKNPIDFLEAKGYKEVKKDLIIKLPK YSLFELENGRKRMLASARFLQKGNELALPSKYVNFLYLAS HYEKLKGSPEDNEQKQLFVEQHKHYLDEIIEQISEFSKRV ILADANLDKVLSAYNKHRDKPIREQAENIIHLFTLTNLGA PRAFKYFDTTIDRKVYRSTKEVLDATLIHQSITGLYETRI DLSQLGGD | N863A |
| St1Cas9-CNRZ1066 | *Streptococcus thermophilus* | 3294 | MSDLVLGLDIGIGSVGVGILNKVTGEIIHKNSRIFPAAQA ENNLVRRTNRQGRRLARRKKHRRVRLNRLFEESGLITDFT KISINLNPYQLRVKGLTDELSNEELFIALKNMVKHRGISY | N622A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | LDDASDDGNSSVGDYAQIVKENSKQLETKTPGQIQLERYQ<br>TYGQLRGDFTVEKDGKKHRLINVFPTSAYRSEALRILQTQ<br>QEFNPQITDEFINRYLEILTGKRKYYHGPGNEKSRTDYGR<br>YRTSGETLDNIFGILIGKCTFYPDEFRAAKASYTAQEFNL<br>LNDLNNLTVPTETKKLSKEQKNQIINYVKNEKAMGPAKLF<br>KYIAKLLSCDVADIKGYRIDKSGKAEIHTFEAYRKMKTLE<br>TLDIEQMDRETLDKLAYVLTLNTEREGIQEALEHEFADGS<br>FSQKQVDELVQFRKANSSIFGKGWHNFSVKLMMELIPELY<br>ETSEEQMTILTRLGKQKTTSSSNKTKYIDEKLLTEEIYNP<br>VVAKSVRQAIKIVNAAIKEYGDFDNIVIEMARETNEDDEK<br>KAIQKIQKANKDEKDAAMLKAANQYNGKAELPHSVFHGHK<br>QLATKIRLWHQQGERCLYTGKTISIHDLINNSNQFEVDHI<br>LPLSITFDDSLANKVLVYATANQEKGQRTPYQALDSMDDA<br>WSFRELKAFVRESKTLSNKKKEYLLTEEDISKFDVRKKFI<br>ERNLVDTRYASRVVLNALQEHFRAHKIDTKVSVVRGQFTS<br>QLRRHWGIEKTRDTYHHHAVDALIIAASSQLNLWKKQKNT<br>LVSYSEEQLLDIETGELISDDEYKESVFKAPYQHFVDTLK<br>SKEFEDSILFSYQVDSKFNRKISDATIYATRQAKVGKDKK<br>DETYVLGKIKDIYTQDGYDAFMKIYKKDKSKFLMYRHDPQ<br>TFEKVIEPILENYPNKQMNEKGKEVPCNPFLKYKEEHGYI<br>RKYSKKGNGPEIKSLKYYDSKLLGNPIDITPENSKNKVVL<br>QSLKPWRTDVYFNKATGKYEILGLKYADLQFEKGTGTYKI<br>SQEKYNDIKKKEGVDSDSEFKFTLYKNDLLLVKDTETKEQ<br>QLFRFLSRTLPKQKHYVELKPYDKQKFEGGEALIKVLGNV<br>ANGGQCIKGLAKSNISIYKVRTDVLGNQHIIKNEGDKPKL<br>DF | |
| St1Cas9-LMG1831 | *Streptococcus thermophilus* | 3295 | MSDLVLGLDIGIGSVGVGILNKVTGEIIHKNSRIFPAAQA<br>ENNLVRRTNRQGRRLARRKKHRRVRLNRLFEESGLITDFT<br>KISINLNPYQLRVKGLTDELSNEELFIALKNMVKHRGISY<br>LDDASDDGNSSVGDYAQIVKENSKQLETKTPGQIQLERYQ<br>TYGQLRGDFTVEKDGKKHRLINVFPTSAYRSEALRILQTQ<br>QEFNPQITDEFINRYLEILTGKRKYYHGPGNEKSRTDYGR<br>YRTSGETLDNIFGILIGKCTFYPDEFRAAKASYTAQEFNL<br>LNDLNNLTVPTETKKLSKEQKNQIINYVKNEKAMGPAKLF<br>KYIAKLLSCDVADIKGYRIDKSGKAEIHTFEAYRKMKTLE<br>TLDIEQMDRETLDKLAYVLTLNTEREGIQEALEHEFADGS<br>FSQKQVDELVQFRKANSSIFGKGWHNFSVKLMMELIPELY<br>ETSEEQMTILTRLGKQKTTSSSNKTKYIDEKLLTEEIYNP<br>VVAKSVRQAIKIVNAAIKEYGDFDNIVIEMARETNEDDEK<br>KAIQKIQKANKDEKDAAMLKAANQYNGKAELPHSVFHGHK<br>QLATKIRLWHQQGERCLYTGKTISIHDLINNSNQFEVDHI<br>LPLSITFDDSLANKVLVYATANQEKGQRTPYQALDSMDDA<br>WSFRELKAFVRESKTLSNKKKEYLLTEEDISKFDVRKKFI<br>ERNLVDTRYASRVVLNALQEHFRAHKIDTKVSVVRGQFTS<br>QLRRHWGIEKTRDTYHHHAVDALIIAASSQLNLWKKQKNT<br>LVSYSEEQLLDIETGELISDDEYKESVFKAPYQHFVDTLK<br>SKEFEDSILFSYQVDSKFNRKISDATIYATRQAKVGKDKK<br>DETYVLGKIKDIYTQDGYDAFMKIYKKDKSKFLMYRHDPQ<br>TFEKVIEPILENYPNKQMNEKGKEVPCNPFLKYKEEHGYI<br>RKYSKKGNGPEIKSLKYYDSKLLGNPIDITPENSKNKVVL<br>QSLKPWRTDVYFNKNTGKYEILGLKYADLQFEKKTGTYKI<br>SQEKYNGIMKEEGVDSDSEFKFTLYKNDLLLVKDTETKEQ<br>QLFRFLSRTMPNVKYYVELKPYSKDKFEKNESLIEILGSA<br>DKSGRCIKGLGKSNISIYKVRTDVLGNQHIIKNEGDKPKL<br>DF | N622A |
| St1Cas9-MTH17CL396 | *Streptococcus thermophilus* | 3296 | MSDLVLGLDIGIGSVGVGILNKVTGEIIHKNSRIFPAAQA<br>ENNLVRRTNRQGRRLARRKKHRRVRLNRLFEESGLITDFT<br>KISINLNPYQLRVKGLTDELSNEELFIALKNMVKHRGISY<br>LDDASDDGNSSVGDYAQIVKENSKQLETKTPGQIQLERYQ<br>TYGQLRGDFTVEKDGKKHRLINVFPTSAYRSEALRILQTQ<br>QEFNPQITDEFINRYLEILTGKRKYYHGPGNEKSRTDYGR<br>YRTSGETLDNIFGILIGKCTFYPDEFRAAKASYTAQEFNL<br>LNDLNNLTVPTETKKLSKEQKNQIINYVKNEKAMGPAKLF<br>KYIAKLLSCDVADIKGYRIDKSGKAEIHTFEAYRKMKTLE<br>TLDIEQMDRETLDKLAYVLTLNTEREGIQEALEHEFADGS<br>FSQKQVDELVQFRKANSSIFGKGWHNFSVKLMMELIPELY<br>ETSEEQMTILTRLGKQKTTSSSNKTKYIDEKLLTEEIYNP<br>VVAKSVRQAIKIVNAAIKEYGDFDNIVIEMARETNEDDEK<br>KAIQKIQKANKDEKDAAMLKAANQYNGKAELPHSVFHGHK<br>QLATKIRLWHQQGERCLYTGKTISIHDLINNSNQFEVDHI<br>LPLSITFDDSLANKVLVYATANQEKGQRTPYQALDSMDDA<br>WSFRELKAFVRESKTLSNKKKEYLLTEEDISKFDVRKKFI | N622A |

TABLE 16-continued

CRISPR/Cas Proteins, Species, and Mutations

| Variant | Parental Host | SEQ ID NO: | Protein Sequence | Nickase Mutation |
|---|---|---|---|---|
| | | | ERNLVDTRYASRVVLNALQEHFRAHKIDTKVSVVRGQFTS QLRRHWGIEKTRDTYHHHAVDALIIAASSQLNLWKKQKNT LVSYSEDQLLDIETGELISDDEYKESVFKAPYQHFVDTLK SKEFEDSILFSYQVDSKFNRKISDATIYATRQAKVGKDKA DETYVLGKIKDIYTQDGYDAFMKIYKKDKSKFLMYRHDPQ TFEKVIEPILENYPNKQINEKGKEVPCNPFLKYKEEHGYI RKYSKKGNGPEIKSLKYYDSKLGNHIDITPKDSNNKVVLQ SLKPWRTDVYFNKNTGKYEILGLKYSDMQFEKGTGKYSIS KEQYENIKVREGVDENSEFKFTLYKNDLLLLKDSENGEQI LLRFTSRNDTSKHYVELKPYNRQKFEGSEYLIKSLGTVAK GGQCIKGLGKSNISIYKVRTDVLGNQHIIKNEGDKPKLDF | |
| St1Cas9-TH1477 | *Streptococcus thermophilus* | 3297 | MSDLVLGLDIGIGSVGVGILNKVTGEIIHKNSRIFPAAQA ENNLVRRTNRQGRRLARRKKHRRVRLNRLFEESGLITDFT KISINLNPYQLRVKGLTDELSNEELFIALKNMVKHRGISY LDDASDDGNSSVGDYAQIVKENSKQLETKTPGQIQLERYQ TYGQLRGDFTVEKDGKKHRLINVFPTSAYRSEALRILQTQ QEFNPQITDEFINRYLEILTGKRKYYHGPGNEKSRTDYGR YRTSGETLDNIFGILIGKCTFYPDEFRAAKASYTAQEFNL LNDLNNLTVPTETKKLSKEQKNQIINYVKNEKAMGPAKLF KYIAKLLSCDVADIKGYRIDKSGKAEIHTFEAYRKMKTLE TLDIEQMDRETLDKLAYVLTLNTEREGIQEALEHEFADGS FSQKQVDELVQFRKANSSIFGKGWHNFSVKLMMELIPELY ETSEEQMTILTRLGKQKTTSSSNKTKYIDEKLLTEEIYNP VVAKSVRQAIKIVNAAIKEYGDFDNIVIEMARETNEDDEK KAIQKIQKANKDEKDAAMLKAANQYNGKAELPHSVFHGHK QLATKIRLWHQQGERCLYTGKTISIHDLINNSNQFEVDHI LPLSITFDDSLANKVLVYATANQEKGQRTPYQALDSMDDA WSFRELKAFVRESKTLSNKKKEYLLTEEDISKFDVRKKFI ERNLVDTRYASRVVLNALQEHFRAHKIDTKVSVVRGQFTS QLRRHWGIEKTRDTYHHHAVDALIIAASSQLNLWKKQKNT LVSYSEDQLLDIETGELISDDEYKESVFKAPYQHFVDTLK SKEFEDSILFSYQVDSKFNRKISDATIYATRQAKVGKDKA DETYVLGKIKDIYTQDGYDAFMKIYKKDKSKFLMYRHDPQ TFEKVIEPILENYPNKQINEKGKEVPCNPFLKYKEEHGYI RKYSKKGNGPEIKSLKYYDSKLGNHIDITPKDSNNKVVLQ SLKPWRTDVYFNKNTGKYEILGLKYSDMQFEKGTGKYSIS KEQYENIKVREGVDENSEFKFTLYKNDLLLLKDSENGEQI LLRFTSRNDTSKHYVELKPYNRQKFEGSEYLIKSLGTVVK GGRCIKGLGKSNISIYKVRTDVLGNQHIIKNEGDKPKLDF | N622A |

Table 17 provides parameters to define the necessary components for designing gRNA and/or Template RNAs to apply Cas variants listed in Table 11 for GENE WRITING™. Tier indicates preferred Cas variants if they are available for use at a given locus. The cut site indicates the validated or predicted protospacer adjacent motif (PAM) requirements, validated or predicted location of cut site (relative to the most upstream base of the PAM site). The gRNA for a given enzyme can be assembled by concatenating the crRNA, Tetraloop, and tracrRNA sequences, and further adding a 5' spacer of a length within Spacer (min) and Spacer (max) that matches a protospacer at a target site. Further, the predicted location of the ssDNA nick at the target is important for designing the 3' region of a Template RNA that needs to anneal to the sequence immediately 5' of the nick in order to initiate target primed reverse transcription.

TABLE 17 parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| Nme2Cas9 | NNNNCC | -3 | 1 | 22 | 24 | GTTG TAGC TCCCT TTCTC ATTTC G | 3535 | GAA A | CGAAATGA GAACCGTT GCTACAAT AAGGCCGT CTGAAAAG ATGTGCCG CAACGCTC TGCCCCTT AAAGCTTC | 3536 |

TABLE 17-continued parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| | | | | | | | | | TGCTTTAA GGGGCATC GTTTA | |
| PpnCas9 | NNNNR TT | | 1 | 21 | 24 | GTTG TAGC TCCCT TTTTC ATTTC GC | 3537 | GAA A | GCGAAATG AAAAACGT TGTTACAA TAAGAGAT GAATTTCT CGCAAAGC TCTGCCTC TTGAAATT TCGGTTTC AAGAGGCA TCTTTTT | 3538 |
| SauCas9 | NNGRR; NNGRRT | −3 | 1 | 21 | 23 | GTTTT AGTA CTCT G | 3539 | GAA A | CAGAATCT ACTAAAAC AAGGCAAA ATGCCGTG TTTATCTC GTCAACTT GTTGGCGA GA | 3540 |
| SauCas9-KKH | NNNRR; NNNRRT | −3 | 1 | 21 | 21 | GTTTT AGTA CTCT GTAA T | 3541 | GAA A | ATTACAGA ATCTACTA AAACAAGG CAAAATGC CGTGTTTA TCTCGTCA ACTTGTTG GCGAGA | 3542 |
| SauriCas9 | NNGG | −3 | 1 | 21 | 21 | GTTTT AGTA CTCT G | 3539 | GAA A | CAGAATCT ACTAAAAC AAGGCAAA ATGCCGTG TTTATCTC GTCAACTT GTTGGCGA GATTTTT | 3543 |
| SauriCas9-KKH | NNRG | −3 | 1 | 21 | 21 | GTTTT AGTA CTCT G | 3539 | GAA A | CAGAATCT ACTAAAAC AAGGCAAA ATGCCGTG TTTATCTC GTCAACTT GTTGGCGA GATTTTT | 3543 |
| ScaCas9-Sc++ | NNG | 3 | 1 | 20 | 20 | GTTTT AGAG CTA | 3544 | GAA A | TAGCAAGT TAAAATAA GGCTAGTC CGTTATCA ACTTGAAA AAGTGGCA CCGAGTCG GTGC | 3545 |
| SpyCas9 | NGG | 3 | 1 | 20 | 20 | GTTTT AGAG CTA | 3544 | GAA A | TAGCAAGT TAAAATAA GGCTAGTC CGTTATCA ACTTGAAA AAGTGGCA CCGAGTCG GTGC | 3545 |

TABLE 17-continued parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| SpyCas9-NG | NG (NGG = NGA = NGT > NGC) | -3 | 1 | 20 | 20 | GTTT AAGA GCTA TGCT G | 3546 | GAAA | CAGCATAG CAAGTTTA AATAAGGC TAGTCCGT TATCAACT TGAAAAAG TGGCACCG AGTCGGTG C | 3547 |
| SpyCas9-SpRY | NRN > NYN | -3 | 1 | 20 | 20 | GTTTT AGAG CTA | 3544 | GAAA | TAGCAAGT TAAAATAA GGCTAGTC CGTTATCA ACTTGAAA AAGTGGCA CCGAGTCG GTGC | 3545 |
| St1Cas9 | NNAGA AW > NN AGGAW = NNGG AAW | -3 | 1 | 20 | 20 | GTCTT TGTA CTCT G | 3548 | GTAC | CAGAAGCT ACAAAGAT AAGGCTTC ATGCCGAA ATCAACAC CCTGTCAT TTTATGGC AGGGTGTT TT | 3549 |
| BlatCas9 | NNNNC NAA > N NNNCN DD > NN NNC | -3 | 1 | 19 | 23 | GCTA TAGT TCCTT ACT | 3550 | GAAA | GGTAAGTT GCTATAGT AAGGGCAA CAGACCCG AGGCGTTG GGGATCGC CTAGCCCG TGTTTACG GGCTCTCC CCATATTC AAAATAAT GACAGACG AGCACCTT GGAGCATT TATCTCCG AGGTGCT | 3551 |
| cCas9-v16 | NNVAC T; NNVA TGM; NN VATT; N NVGCT; NNVGT G; NNVG TT | -3 | 2 | 21 | 21 | GUCU UAGU ACUC UG | 3552 | GAAA | CAGAAUCU ACUAAGAC AAGGCAAA AUGCCGUG UUUAUCUC GUCAACUU GUUGGCGA GAUUUUUU U | 3553 |
| cCas9-v17 | NNVRR N | -3 | 2 | 21 | 21 | GUCU UAGU ACUC UG | 3552 | GAAA | CAGAAUCU ACUAAGAC AAGGCAAA AUGCCGUG UUUAUCUC GUCAACUU GUUGGCGA GAUUUUUU U | 3553 |

TABLE 17-continued parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| cCas9-v21 | NNVACT; NNVATGM; NNVATT; NNVGCT; NNVGTG; NNVGTT | -3 | 2 | 21 | 21 | GUCUUAGUACUCUG | 3552 | GAAA | CAGAAUCUACUAAGACAAGGCAAAAUGCCGUGUUUAUCUCGUCAACUUGUUGGCGAGAUUUUUUU | 3553 |
| cCas9-v42 | NNVRRN | -3 | 2 | 21 | 21 | GUCUUAGUACUCUG | 3552 | GAAA | CAGAAUCUACUAAGACAAGGCAAAAUGCCGUGUUUAUCUCGUCAACUUGUUGGCGAGAUUUUUUU | 3553 |
| CdiCas9 | NNRHHHY; NNRAAAY | | 2 | 22 | 22 | ACUGGGGUUCAG | 3554 | GAAA | CUGAACCUCAGUAAGCAUUGGCUCGUUUCCAAUGUUGAUUGCUCCGCCGGUGCUCCUUAUUUUUAAGGGCGCCGGC | 3555 |
| CjeCas9 | NNNNRYAC | -3 | 2 | 21 | 23 | GTTTTAGTCCCT | 3556 | GAAA | AGGGACTAAAATAAAGAGTTTGCGGGACTCTGCGGGGTTACAATCCCCTAAAACCGCTTTTTT | 3557 |
| GeoCas9 | NNNNCRAA | | 2 | 21 | 23 | GUCAUAGUUCCCCUGA | 3558 | GAAA | UCAGGGUUACUAUGAUAAGGGCUUUCUGCCUAAGGCAGACUGACCCGCGGCGUUGGGGAUCGCCUGUCGCCCGCUUUUGGCGGGCAUUCCCCAUCCUU | 3559 |
| iSpyMacCas9 | NAAN | -3 | 2 | 19 | 21 | GTTTTAGAGCTA | 3544 | GAAA | TAGCAAGTTAAAATAAGGCTAGTCCGTTATCAACTTGAAAAAGTGGCACCGAGTCGGTGC | 3545 |
| NmeCas9 | NNNNGAYT; NNNNGYTT; NNNNGAYA; NNNNGTCT | -3 | 2 | 20 | 24 | GTTGTAGCTCCCTTTCTCATTTCG | 3535 | GAAA | CGAAATGAGAACCGTTGCTACAATAAGGCCGTCTGAAAAGATGTGCCGCAACGCTCTGCCCCTTAAAGCTTC | 3536 |

TABLE 17-continued parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| | | | | | | | | | TGCTTTAA GGGGCATC GTTTA | |
| ScaCas9 | NNG | -3 | 2 | 20 | 20 | GTTTT AGAG CTA | 3544 | GAA A | TAGCAAGT TAAAATAA GGCTAGTC CGTTATCA ACTTGAAA AAGTGGCA CCGAGTCG GTGC | 3545 |
| ScaCas9-HiFi-Sc++ | NNG | -3 | 2 | 20 | 20 | GTTTT AGAG CTA | 3544 | GAA A | TAGCAAGT TAAAATAA GGCTAGTC CGTTATCA ACTTGAAA AAGTGGCA CCGAGTCG GTGC | 3545 |
| SpyCas9-3var-NRRH | NRRH | -3 | 2 | 20 | 20 | GTTT AAGA GCTA TGCT G | 3546 | GAA A | CAGCATAG CAAGTTTA AATAAGGC TAGTCCGT TATCAACT TGAAAAAG TGGCACCG AGTCGGTG C | 3547 |
| SpyCas9-3var-NRTH | NRTH | -3 | 2 | 20 | 20 | GTTT AAGA GCTA TGCT G | 3546 | GAA A | CAGCATAG CAAGTTTA AATAAGGC TAGTCCGT TATCAACT TGAAAAAG TGGCACCG AGTCGGTG C | 3547 |
| SpyCas9-3var-NRCH | NRCH | -3 | 2 | 20 | 20 | GTTT AAGA GCTA TGCT G | 3546 | GAA A | CAGCATAG CAAGTTTA AATAAGGC TAGTCCGT TATCAACT TGAAAAAG TGGCACCG AGTCGGTG C | 3547 |
| SpyCas9-HF1 | NGG | -3 | 2 | 20 | 20 | GTTTT AGAG CTA | 3544 | GAA A | TAGCAAGT TAAAATAA GGCTAGTC CGTTATCA ACTTGAAA AAGTGGCA CCGAGTCG GTGC | 3545 |
| SpyCas9-QQR1 | NAAG | -3 | 2 | 20 | 20 | GTTTT AGAG CTA | 3544 | GAA A | TAGCAAGT TAAAATAA GGCTAGTC CGTTATCA ACTTGAAA AAGTGGCA CCGAGTCG GTGC | 3545 |
| SpyCas9-SpG | NGN | -3 | 2 | 20 | 20 | GTTTT AGAG CTA | 3544 | GAA A | TAGCAAGT TAAAATAA GGCTAGTC | 3545 |

TABLE 17-continued parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| | | | | | | | | | CGTTATCA ACTTGAAA AAGTGGCA CCGAGTCG GTGC | |
| SpyCas9-VOR | NGAN | -3 | 2 | 20 | 20 | GTTTT AGAG CTA | 3544 | GAAA | TAGCAAGT TAAAATAA GGCTAGTC CGTTATCA ACTTGAAA AAGTGGCA CCGAGTCG GTGC | 3545 |
| SpyCas9-VRER | NGCG | -3 | 2 | 20 | 20 | GTTTT AGAG CTA | 3544 | GAAA | TAGCAAGT TAAAATAA GGCTAGTC CGTTATCA ACTTGAAA AAGTGGCA CCGAGTCG GTGC | 3545 |
| SpyCas9-xCas | NG; GAA; GAT | -3 | 2 | 20 | 20 | GTTT AAGA GCTA TGCT G | 3546 | GAAA | CAGCATAG CAAGTTTA AATAAGGC TAGTCCGT TATCAACT TGAAAAAG TGGCACCG AGTCGGTG C | 3547 |
| SpyCas9-xCas-NG | NG | -3 | 2 | 20 | 20 | GTTT AAGA GCTA TGCT G | 3546 | GAAA | CAGCATAG CAAGTTTA AATAAGGC TAGTCCGT TATCAACT TGAAAAAG TGGCACCG AGTCGGTG C | 3547 |
| St1Cas9-CNRZ1066 | NNACA A | -3 | 2 | 20 | 20 | GTCTT TGTA CTCT G | 3548 | GTAC | CAGAAGCT ACAAAGAT AAGGCTTC ATGCCGAA ATCAACAC CCTGTCAT TTTATGGC AGGGTGTT TT | 3549 |
| St1Cas9-LMG1831 | NNGCA A | -3 | 2 | 20 | 20 | GTCTT TGTA CTCT G | 3548 | GTAC | CAGAAGCT ACAAAGAT AAGGCTTC ATGCCGAA ATCAACAC CCTGTCAT TTTATGGC AGGGTGTT TT | 3549 |
| St1Cas9-MTH17 CL396 | NNAAA A | -3 | 2 | 20 | 20 | GTCTT TGTA CTCT G | 3548 | GTAC | CAGAAGCT ACAAAGAT AAGGCTTC ATGCCGAA ATCAACAC CCTGTCAT TTTATGGC AGGGTGTT TT | 3549 |

TABLE 17-continued parameters to define the necessary components for designing gRNA and/or Template RNAs to apply Cas variants listed in Table 11 for Gene Writing ™

| Variant | PAM(s) | Cut | Tier | Spacer (min) | Spacer (max) | crRNA | SEQ ID NO: | Tetra loop | tracrRNA | SEQ ID NO: |
|---|---|---|---|---|---|---|---|---|---|---|
| St1Cas9-TH1477 | NNGAAA | -3 | 2 | 20 | 20 | GTCTTTGTACTCTG | 3548 | GTAC | CAGAAGCTACAAAGATAAGGCTTCATGCCGAAATCAACACCCTGTCATTTTATGGCAGGGTGTTTT | 3549 |

In some embodiments, the opener molecule is exogenous to the cell comprising the GENE WRITER™ polypeptide and or template nucleic acid. In some embodiments, the opener molecule comprises an endogenous agent (e.g., endogenous to the cell comprising the GENE WRITER™ polypeptide and or template nucleic acid comprising the gRNA and blocking domain). For example, an inducible gRNA, blocking domain, and opener molecule may be chosen such that the opener molecule is an endogenous agent expressed in a target cell or tissue, e.g., thereby ensuring activity of a GENE WRITER™ system in the target cell or tissue. As a further example, an inducible gRNA, blocking domain, and opener molecule may be chosen such that the opener molecule is absent or not substantially expressed in one or more non-target cells or tissues, e.g., thereby ensuring that activity of a GENE WRITER™ system does not occur or substantially occur in the one or more non-target cells or tissues, or occurs at a reduced level compared to a target cell or tissue. Exemplary blocking domains, opener molecules, and uses thereof are described in PCT App. Publication WO2020044039A1, which is incorporated herein by reference in its entirety. In some embodiments, the template nucleic acid, e.g., template RNA, may comprise one or more UTRs (e.g. from an R2-type retrotransposon) and a gRNA. In some embodiments, the UTR facilitates interaction of the template nucleic acid (e.g., template RNA) with the writing domain, e.g., reverse transcriptase domain, of the GENE WRITER™ polypeptide. In some embodiments, the gRNA facilitates interaction with the template nucleic acid binding domain (e.g., RNA binding domain) of the polypeptide. In some embodiments, the gRNA directs the polypeptide to the matching target sequence, e.g., in a target cell genome. In some embodiments, the template nucleic acid may contain only the reverse transcriptase binding motif (e.g. 3' UTR from R2) and the gRNA may be provided as a second nucleic acid molecule (e.g., second RNA molecule) for target site recognition. In some embodiments, the template nucleic acid containing the RT-binding motif may exist on the same molecule as the gRNA, but be processed into two RNA molecules by cleavage activity (e.g. ribozyme).

In some embodiments, a template RNA may be customized to correct a given mutation in the genomic DNA of a target cell (e.g., ex vivo or in vivo, e.g., in a target tissue or organ, e.g., in a subject). For example, the mutation may be a disease-associated mutation relative to the wild-type sequence. Without wishing to be bound by theory, sets of empirical parameters help ensure optimal initial in silico designs of template RNAs or portions thereof. As a non-limiting illustrative example, for a selected mutation, the following design parameters may be employed. In some embodiments, design is initiated by acquiring approximately 500 bp (e.g., up to 50, 100, 150, 200, 250, 300, 350, 400, 450, 500, 550, 600, 650, or 700 bp, and optionally at least 20, 30, 40, 50, 100, 150, 200, 250, 300, 350, 400, 450, 500, 550, 600, or 650 bp) flanking sequence on either side of the mutation to serve as the target region. In some embodiments, a template nucleic acid comprises a gRNA. Methodology for designing gRNAs is known to those of skill in the art. In some embodiments, a gRNA comprises a sequence (e.g., a CRISPR spacer) that binds a target site. In some embodiments, the sequence (e.g., a CRISPR spacer) that binds a target site for use in targeting a template nucleic acid to a target region is selected by considering the particular GENE WRITER™ polypeptide (e.g., endonuclease domain or writing domain, e.g., comprising a CRISPR/Cas domain) being used (e.g., for Cas9, a protospacer-adjacent motif (PAM) of NGG immediately 3' of a 20 nt gRNA binding region). In some embodiments, the CRISPR spacer is selected by ranking first by whether the PAM will be disrupted by the GENE WRITING™ induced edit. In some embodiments, disruption of the PAM may increase edit efficiency. In some embodiments, the PAM can be disrupted by also introducing (e.g., as part of or in addition to another modification to a target site in genomic DNA) a silent mutation (e.g., a mutation that does not alter an amino acid residue encoded by the target nucleic acid sequence, if any) in the target site during GENE WRITING™. In some embodiments, the CRISPR spacer is selected by ranking sequences by the proximity of their corresponding genomic site to the desired edit location. In some embodiments, the gRNA comprises a gRNA scaffold. In some embodiments, the gRNA scaffold used may be a standard scaffold (e.g., for Cas9, 5'-GTTTTAGAGCTAGAAATAGCAAGTTAAAATAAGGCTAGTCCGTTATCAACTTGAAAAAGTGGGACCGAGTCGGTCC-3' (SEQ ID NO: 1591)), or may contain one or more nucleotide substitutions. In some embodiments, the heterologous object sequence has at least 90% identity, e.g., at least 90%, 95%, 98%, 99%, or 100% identity, or comprises no more than 1, 2, 3, 4, or 5 positions of non-identity to the target site 3' of the first strand nick (e.g., immediately 3' of the first strand nick or up to 1, 2, 3, 4, or 5 nucleotides 3' of the first strand nick), with the exception of any insertion, substitution, or deletion that may be written into the target site by the GENE WRITER™. In some embodiments, the 3' target homology domain contains at least 90% identity, e.g., at least 90%, 95%, 98%, 99%, or 100% identity, or comprises no more than 1, 2, 3, 4, or 5 positions of non-identity to the target site 5' of the first strand nick (e.g., immediately 5' of the first strand nick or up to 1, 2, 3, 4, or 5 nucleotides 3' of the first strand nick).

Methods and Compositions for Modified RNA (e.g., gRNA or Template RNA)

Figure 1:
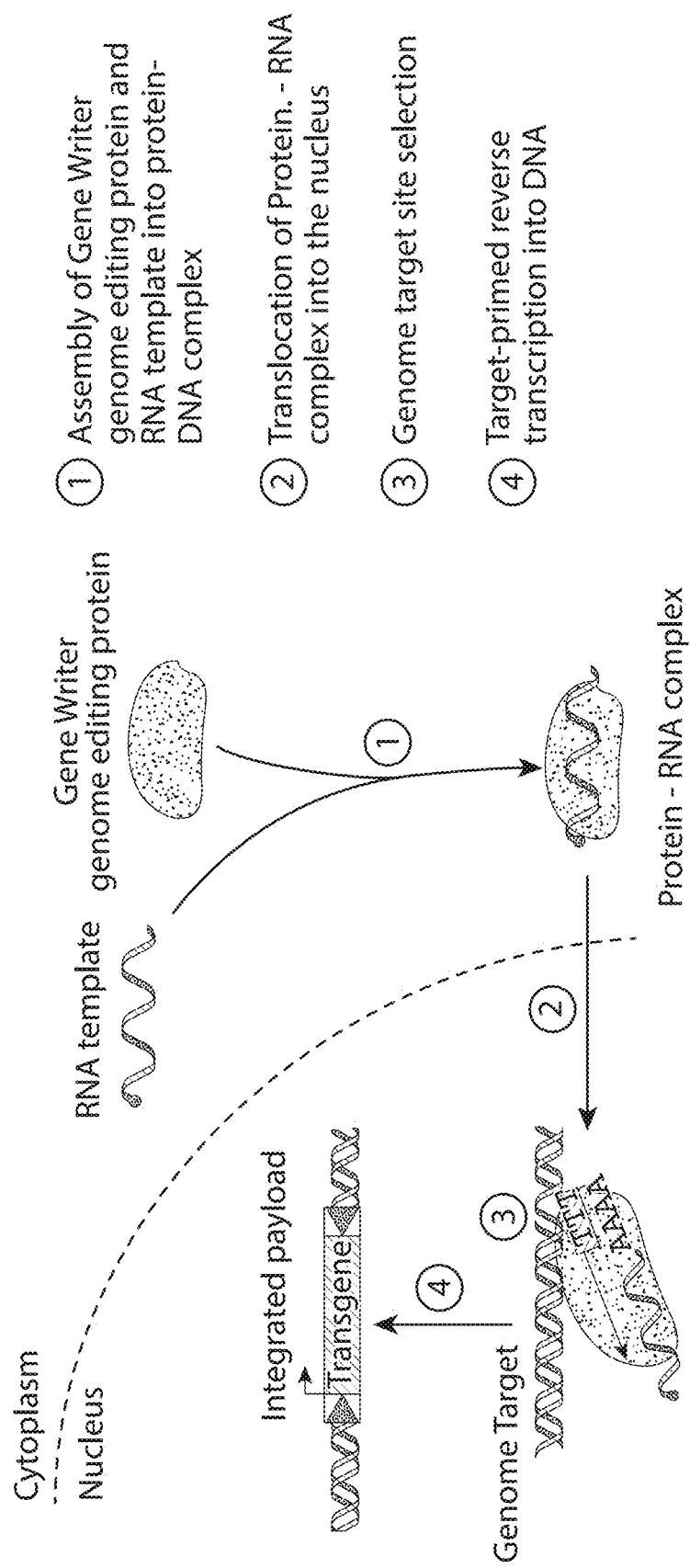
FIG. 1 is a schematic of the GENE WRITING™ genome editing system.

In some embodiments, an RNA component of the system (e.g., a template RNA or a gRNA) comprises one or more nucleotide modifications. In some embodiments, the modification pattern of a gRNA can significantly affect in vivo activity compared to unmodified or end-modified guides (e.g., as shown in FIG. 1D from Finn et al. *Cell Rep* 22 (9): 2227-2235 (2018); incorporated herein by reference in its entirety). Without wishing to be bound by theory, this process may be due, at least in part, to a stabilization of the RNA conferred by the modifications. Non-limiting examples of such modifications may include 2'-O-methyl (2'-O-Me), 2'-O-(2-methoxyethyl) (2'-O-MOE), 2'-fluoro (2'-F), phosphorothioate (PS) bond between nucleotides, G-C substitutions, and inverted abasic linkages between nucleotides and equivalents thereof.

In some embodiments, the template RNA (e.g., at the portion thereof that binds a target site) or the guide RNA comprises a 5' terminus region. In some embodiments, the template RNA or the guide RNA does not comprise a 5' terminus region. In some embodiments, the 5' terminus region comprises a CRISPR spacer region, e.g., as described with respect to sgRNA in Briner A E et al, Molecular Cell 56:333-339 (2014) (incorporated herein by reference in its entirety; applicable herein, e.g., to all guide RNAs). In some embodiments, the 5' terminus region comprises a 5' end modification. In some embodiments, a 5' terminus region with or without a spacer region may be associated with a crRNA, trRNA, sgRNA and/or dgRNA. The CRISPR spacer region can, in some instances, comprise a guide region, guide domain, or targeting domain. In some embodiments, a target domain or target sequence may comprise a sequence of nucleic acid to which the guide region/domain directs a nuclease for cleavage. In some embodiments, a spyCas9 protein may be directed by a guide region/domain to a target sequence of a target nucleic acid molecule by the nucleotides present in the CRISPR spacer region.

In some embodiments, the template RNAs (e.g., at the portion thereof that binds a target site) or guide RNAs described herein comprises any of the sequences shown in Table 4 of WO2018107028A1, incorporated herein by reference in its entirety. In some embodiments, where a sequence shows a guide and/or spacer region, the composition may comprise this region or not. In some embodiments, a guide RNA comprises one or more of the modifications of any of the sequences shown in Table 4 of WO2018107028A1, e.g., as identified therein by a SEQ ID NO. In embodiments, the nucleotides may be the same or different, and/or the modification pattern shown may be the same or similar to a modification pattern of a guide sequence as shown in Table 4 of WO2018107028A1. In some embodiments, a modification pattern includes the relative position and identity of modifications of the gRNA or a region of the gRNA (e.g. 5' terminus region, lower stem region, bulge region, upper stem region, nexus region, hairpin 1 region, hairpin 2 region, 3' terminus region). In some embodiments, the modification pattern contains at least 50%, 55%, 60%, 70%, 75%, 80%, 85%, 90%, 95%, 96%, 97%, 98%, 99%, or 100% of the modifications of any one of the sequences shown in the sequence column of Table 4 of WO2018107028A1, and/or over one or more regions of the sequence. In some embodiments, the modification pattern is at least 50%, 55%, 60%, 70%, 75%, 80%, 85%, 90%, 95%, 96%, 97%, 98%, 99%, or 100% identical to the modification pattern of any one of the sequences shown in the sequence column of Table 4 of WO2018107028A1. In some embodiments, the modification pattern is at least 50%, 55%, 60%, 70%, 75%, 80%, 85%, 90%, 95%, 96%, 97%, 98%, 99%, or 100% identical over one or more regions of the sequence shown in Table 4 of WO2018107028A1, e.g., in a 5' terminus region, lower stem region, bulge region, upper stem region, nexus region, hairpin 1 region, hairpin 2 region, and/or 3' terminus region. In some embodiments, the modification pattern is least 50%, 55%, 60%, 70%, 75%, 80%, 85%, 90%, 95%, 96%, 97%, 98%, 99%, or 100% identical to the modification pattern of a sequence over the 5'terminus region. In some embodiments, the modification pattern is least 50%, 55%, 60%, 70%, 75%, 80%, 85%, 90%, 95%, 96%, 97%, 98%, 99%, or 100% identical over the lower stem. In some embodiments, the modification pattern is least 50%, 55%, 60%, 70%, 75%, 80%, 85%, 90%, 95%, 96%, 97%, 98%, 99%, or 100% identical over the bulge. In some embodiments, the modification pattern is least 50%, 55%, 60%, 70%, 75%, 80%, 85%, 90%, 95%, 96%, 97%, 98%, 99%, or 100% identical over the upper stem. In some embodiments, the modification pattern is least 50%, 55%, 60%, 70%, 75%, 80%, 85%, 90%, 95%, 96%, 97%, 98%, 99%, or 100% identical over the nexus. In some embodiments, the modification pattern is least 50%, 55%, 60%, 70%, 75%, 80%, 85%, 90%, 95%, 96%, 97%, 98%, 99%, or 100% identical over the hairpin 1. In some embodiments, the modification pattern is least 50%, 55%, 60%, 70%, 75%, 80%, 85%, 90%, 95%, 96%, 97%, 98%, 99%, or 100% identical over the hairpin 2. In some embodiments, the modification pattern is least 50%, 55%, 60%, 70%, 75%, 80%, 85%, 90%, 95%, 96%, 97%, 98%, 99%, or 100% identical over the 3' terminus. In some embodiments, the modification pattern differs from the modification pattern of a sequence of Table 4 of WO2018107028A1, or a region (e.g. 5' terminus, lower stem, bulge, upper stem, nexus, hairpin 1, hairpin 2, 3' terminus) of such a sequence, e.g., at 0, 1, 2, 3, 4, 5, 6, or more nucleotides. In some embodiments, the gRNA comprises modifications that differ from the modifications of a sequence of Table 4 of WO2018107028A1, e.g., at 0, 1, 2, 3, 4, 5, 6, or more nucleotides. In some embodiments, the gRNA comprises modifications that differ from modifications of a region (e.g. 5' terminus, lower stem, bulge, upper stem, nexus, hairpin 1, hairpin 2, 3' terminus) of a sequence of Table 4 of WO2018107028A1, e.g., at 0, 1, 2, 3, 4, 5, 6, or more nucleotides.

In some embodiments, the template RNAs (e.g., at the portion thereof that binds a target site) or the gRNA comprises a 2'-O-methyl (2'-O-Me) modified nucleotide. In some embodiments, the gRNA comprises a 2'-O-(2-methoxy ethyl) (2'-O-moc) modified nucleotide. In some embodiments, the gRNA comprises a 2'-fluoro (2'-F) modified nucleotide. In some embodiments, the gRNA comprises a phosphorothioate (PS) bond between nucleotides. In some embodiments, the gRNA comprises a 5' end modification, a 3' end modification, or 5' and 3' end modifications. In some embodiments, the 5' end modification comprises a phosphorothioate (PS) bond between nucleotides. In some embodiments, the 5' end modification comprises a 2'-O-methyl (2'-O-Mc), 2'-O-(2-methoxy ethyl) (2'-O-MOE), and/or 2'-fluoro (2'-F) modified nucleotide. In some embodiments, the 5' end modification comprises at least one phosphorothioate (PS) bond and one or more of a 2'-O-methyl (2'-O-Me), 2'-O-(2-methoxyethyl) (2'-O-MOE), and/or 2'-fluoro (2'-F) modified nucleotide. The end modification may comprise a phosphorothioate (PS), 2'-O-methyl (2'-O-Me), 2'-O-(2-methoxyethyl) (2'-O-MOE), and/or 2'-fluoro (2'-F) modification. Equivalent end modifications are also encompassed by embodiments described herein. In some embodiments, the template RNA or gRNA comprises an end modification in combination with a modification of one or more regions of the template RNA or gRNA. Additional exemplary modifications and methods for protecting RNA, e.g., gRNA, and formulae thereof, are described in WO2018126176A1, which is incorporated herein by reference in its entirety.

In some embodiments, structure-guided and systematic approaches are used to introduce modifications (e.g., 2'-OMe-RNA, 2'-F-RNA, and PS modifications) to a template RNA or guide RNA, for example, as described in Mir et al. *Nat Commun* 9:2641 (2018) (incorporated by reference herein in its entirety). In some embodiments, the incorporation of 2'-F-RNAs increases thermal and nuclease stability of RNA: RNA or RNA: DNA duplexes, e.g., while minimally interfering with C3'-endo sugar puckering. In some embodiments, 2'-F may be better tolerated than 2'-OMe at positions where the 2'-OH is important for RNA: DNA duplex stability. In some embodiments, a crRNA comprises one or more modifications that do not reduce Cas9 activity, e.g., C10, C20, or C21 (fully modified), e.g., as described in Supplementary Table 1 of Mir et al. *Nat Commun* 9:2641 (2018), incorporated herein by reference in its entirety. In some embodiments, a tracrRNA comprises one or more modifications that do not reduce Cas9 activity, e.g., T2, T6, T7, or T8 (fully modified) of Supplementary Table 1 of Mir et al. *Nat Commun* 9:2641 (2018). In some embodiments, a crRNA comprises one or more modifications (e.g., as described herein) may be paired with a tracrRNA comprising one or more modifications, e.g., C20 and T2. In some embodiments, a gRNA comprises a chimera, e.g., of a crRNA and a tracrRNA (e.g., Jinek et al. *Science* 337 (6096): 816-821 (2012)). In embodiments, modifications from the crRNA and tracrRNA are mapped onto the single-guide chimera, e.g., to produce a modified gRNA with enhanced stability.

In some embodiments, gRNA molecules may be modified by the addition or subtraction of the naturally occurring structural components, e.g., hairpins. In some embodiments, a gRNA may comprise a gRNA with one or more 3' hairpin elements deleted, e.g., as described in WO2018106727, incorporated herein by reference in its entirety. In some embodiments, a gRNA may contain an added hairpin structure, e.g., an added hairpin structure in the spacer region, which was shown to increase specificity of a CRISPR-Cas system in the teachings of Kocak et al. *Nat Biotechnol* 37 (6): 657-666 (2019). Additional modifications, including examples of shortened gRNA and specific modifications improving in vivo activity, can be found in US20190316121, incorporated herein by reference in its entirety.

In some embodiments, structure-guided and systematic approaches (e.g., as described in Mir et al. *Nat Commun* 9:2641 (2018); incorporated herein by reference in its entirety) are employed to find modifications for the template RNA. In embodiments, the modifications are identified with the inclusion or exclusion of a guide region of the template RNA. In some embodiments, a structure of polypeptide bound to template RNA is used to determine non-protein-contacted nucleotides of the RNA that may then be selected for modifications, e.g., with lower risk of disrupting the association of the RNA with the polypeptide. Secondary structures in a template RNA can also be predicted in silico by software tools, e.g., the RNAstructure tool available at rna.urmc.rochester.edu/RNAstructureWeb (Bellaousov et al. *Nucleic Acids Res* 41: W471-W474 (2013); incorporated by reference herein in its entirety), e.g., to determine secondary structures for selecting modifications, e.g., hairpins, stems, and/or bulges.

Further included here are compositions and methods for the assembly of full or partial template RNA molecules (e.g., GENE WRITING™ template RNA molecules optionally comprising a gRNA, or separate gRNA molecules). In some embodiments, RNA molecules may be assembled by the connection of two or more (e.g., two, three, four, five, six, seven, eight, nine, ten, or more) RNA segments with each other. In an aspect, the disclosure provides methods for producing nucleic acid molecules, the methods comprising contacting two or more linear RNA segments with each other under conditions that allow for the 5' terminus of a first RNA segment to be covalently linked with the 3' terminus of a second RNA segment. In some embodiments, the joined molecule may be contacted with a third RNA segment under conditions that allow for the 5' terminus of the joined molecule to be covalently linked with the 3' terminus of the third RNA segment. In embodiments, the method further comprises joining a fourth, fifth, or additional RNA segments to the elongated molecule. This form of assembly may, in some instances, allow for rapid and efficient assembly of RNA molecules.

The present disclosure also provides compositions and methods for the connection (e.g., covalent connection) of crRNA molecules and tracrRNA molecules. In some embodiments, guide RNA molecules with specificity for different target sites can be generated using a single tracrRNA molecule/segment connected to a target site specific crRNA molecule/segment (e.g., as shown in FIG. 10 of US20160102322A1; incorporated herein by reference in its entirety). For example, FIG. 10 of US20160102322A1 shows four tubes with different crRNA molecules with crRNA molecule 3 being connected to a tracrRNA molecule to form a guide RNA molecule, thereby depicting an exemplary connection of two RNA segments to form a product RNA molecule.

The disclosure also provides compositions and methods for the production of template RNA molecules with specificity for a GENE WRITER™ polypeptide and/or a genomic target site. In an aspect, the method comprises: (1) identification of the target site and desired modification thereto, (2) production of RNA segments including an upstream homology segment, a heterologous object sequence segment, a GENE WRITER™ polypeptide binding motif, and a gRNA segment, and/or (3) connection of the four or more segments into at least one molecule, e.g., into a single RNA molecule. In some embodiments, some or all of the template RNA segments comprised in (2) are assembled into a template RNA molecule, e.g., one, two, three, or four of the listed components. In some embodiments, the segments comprised in (2) may be produced in further segmented molecules, e.g., split into at least 2, at least 3, at least 4, or at least 5 or more sub-segments, e.g., that are subsequently assembled, e.g., by one or more methods described herein.

In some embodiments, RNA segments may be produced by chemical synthesis. In some embodiments, RNA segments may be produced by in vitro transcription of a nucleic acid template, e.g., by providing an RNA polymerase to act on a cognate promoter of a DNA template to produce an RNA transcript. In some embodiments, in vitro transcription is performed using, e.g., a T7, T3, or SP6 RNA polymerase, or a derivative thereof, acting on a DNA, e.g., dsDNA, ssDNA, linear DNA, plasmid DNA, linear DNA amplicon, linearized plasmid DNA, e.g., encoding the RNA segment, e.g., under transcriptional control of a cognate promoter, e.g., a T7, T3, or SP6 promoter. In some embodiments, a combination of chemical synthesis and in vitro transcription is used to generate the RNA segments for assembly. In embodiments, the gRNA, upstream target homology, and GENE WRITER™ polypeptide binding segments are produced by chemical synthesis and the heterologous object sequence segment is produced by in vitro transcription. Without wishing to be bound by theory, in vitro transcription may be better suited for the production of longer RNA molecules. In some embodiments, reaction temperature for in vitro transcription may be lowered, e.g., be less than 37° C. (e.g., between 0-10 C, 10-20 C, or 20-30 C), to result in a higher proportion of full-length transcripts (Krieg *Nucleic Acids Res* 18:6463 (1990)). In some embodiments, a protocol for improved synthesis of long transcripts is employed to synthesize a long template RNA, e.g., a template RNA greater than 5 kb, such as the use of e.g., T7 RIBOMAX™ Express, which can generate 27 kb transcripts in vitro (Thiel et al. *J Gen Virol* 82 (6): 1273-1281 (2001)). In some embodiments, modifications to RNA molecules as described herein may be incorporated during synthesis of RNA segments (e.g., through the inclusion of modified nucleotides or alternative binding chemistries), following synthesis of RNA segments through chemical or enzymatic processes, following assembly of one or more RNA segments, or a combination thereof.

In some embodiments, an mRNA of the system (e.g., an mRNA encoding a GENE WRITER™ polypeptide) is synthesized in vitro using T7 polymerase-mediated DNA-dependent RNA transcription from a linearized DNA template, where UTP is optionally substituted with 1-methylpseudoUTP. In some embodiments, the transcript incorporates 5' and 3' UTRs, e.g., GGGAAAUAAGAGAGAAAAGAAGA GUAAGAAGAAAUAUAAGAGCCACC (SEQ ID NO: 1603) and UGAUAAUAGGCUGGAGCCUCGGUGGC-CAUGCUUCUUGCCCCUUGGGCCUCCCCCC AGCC CCUCCUCCCCUUCCUGCACCCGUACCCCGUGGU-CUUUGAAUAAAGUCUGA (SEQ ID NO: 1604), or functional fragments or variants thereof, and optionally includes a poly-A tail, which can be encoded in the DNA template or added enzymatically following transcription. In some embodiments, a donor methyl group, e.g., S-adenosylmethionine, is added to a methylated capped RNA with cap 0 structure to yield a cap 1 structure that increases mRNA translation efficiency (Richner et al. *Cell* 168 (6): P1114-1125 (2017)).

In some embodiments, the transcript from a T7 promoter starts with a GGG motif. In some embodiments, a transcript from a T7 promoter does not start with a GGG motif. It has been shown that a GGG motif at the transcriptional start, despite providing superior yield, may lead to T7 RNAP synthesizing a ladder of poly (G) products as a result of slippage of the transcript on the three C residues in the template strand from +1 to +3 (Imburgio et al. Biochemistry 39 (34): 10419-10430 (2000). For tuning transcription levels and altering the transcription start site nucleotides to fit alternative 5' UTRs, the teachings of Davidson et al. *Pac Symp Biocomput* 433-443 (2010) describe T7 promoter variants, and the methods of discovery thereof, that fulfill both of these traits.

In some embodiments, RNA segments may be connected to each other by covalent coupling. In some embodiments, an RNA ligase, e.g., T4 RNA ligase, may be used to connect two or more RNA segments to each other. When a reagent such as an RNA ligase is used, a 5' terminus is typically linked to a 3' terminus. In some embodiments, if two segments are connected, then there are two possible linear constructs that can be formed (i.e., (1) 5'-Segment 1-Segment 2-3' and (2) 5'-Segment 2-Segment 1-3'). In some embodiments, intramolecular circularization can also occur. Both of these issues can be addressed, for example, by blocking one 5' terminus or one 3' terminus so that RNA ligase cannot ligate the terminus to another terminus. In embodiments, if a construct of 5'-Segment 1-Segment 2-3' is desired, then placing a blocking group on either the 5' end of Segment 1 or the 3' end of Segment 2 may result in the formation of only the correct linear ligation product and/or prevent intramolecular circularization. Compositions and methods for the covalent connection of two nucleic acid (e.g., RNA) segments are disclosed, for example, in US20160102322A1 (incorporated herein by reference in its entirety), along with methods including the use of an RNA ligase to directionally ligate two single-stranded RNA segments to each other.

One example of an end blocker that may be used in conjunction with, for example, T4 RNA ligase, is a dideoxy terminator. T4 RNA ligase typically catalyzes the ATP-dependent ligation of phosphodiester bonds between 5'-phosphate and 3'-hydroxyl termini. In some embodiments, when T4 RNA ligase is used, suitable termini must be present on the termini being ligated. One means for blocking T4 RNA ligase on a terminus comprises failing to have the correct terminus format. Generally, termini of RNA segments with a 5-hydroxyl or a 3'-phosphate will not act as substrates for T4 RNA ligase.

Additional exemplary methods that may be used to connect RNA segments is by click chemistry (e.g., as described in U.S. Pat. Nos. 7,375,234 and 7,070,941, and US Patent Publication No. 2013/0046084, the entire disclosures of which are incorporated herein by reference). For example, one exemplary click chemistry reaction is between an alkyne group and an azide group (see FIG. 11 of US20160102322A1, which is incorporated herein by reference in its entirety). Any click reaction may potentially be used to link RNA segments (e.g., Cu-azide-alkyne, strain-promoted-azide-alkyne, staudinger ligation, tetrazine ligation, photo-induced tetrazole-alkene, thiol-ene, NHS esters, epoxides, isocyanates, and aldehyde-aminooxy). In some embodiments, ligation of RNA molecules using a click chemistry reaction is advantageous because click chemistry reactions are fast, modular, efficient, often do not produce toxic waste products, can be done with water as a solvent, and/or can be set up to be stereospecific.

In some embodiments, RNA segments may be connected using an Azide-Alkyne Huisgen Cycloaddition. reaction, which is typically a 1,3-dipolar cycloaddition between an azide and a terminal or internal alkyne to give a 1,2,3-triazole for the ligation of RNA segments. Without wishing to be bound by theory, one advantage of this ligation method may be that this reaction can be initiated by the addition of required Cu (I) ions. Other exemplary mechanisms by which RNA segments may be connected include, without limitation, the use of halogens (F—, Br—, I—)/alkynes addition reactions, carbonyls/sulfhydryls/maleimide, and carboxyl/amine linkages. For example, one RNA molecule may be modified with thiol at 3' (using disulfide amidite and universal support or disulfide modified support), and the other RNA molecule may be modified with acrydite at 5' (using acrylic phosphoramidite), then the two RNA molecules can be connected by a Michael addition reaction. This strategy can also be applied to connecting multiple RNA molecules stepwise. Also provided are methods for linking more than two (e.g., three, four, five, six, etc.) RNA molecules to each other. Without wishing to be bound by theory, this may be useful when a desired RNA molecule is longer than about 40 nucleotides, e.g., such that chemical synthesis efficiency degrades, e.g., as noted in US20160102322A1 (incorporated herein by reference in its entirety).

By way of illustration, a tracrRNA is typically around 80 nucleotides in length. Such RNA molecules may be produced, for example, by processes such as in vitro transcription or chemical synthesis. In some embodiments, when chemical synthesis is used to produce such RNA molecules, they may be produced as a single synthesis product or by linking two or more synthesized RNA segments to each other. In embodiments, when three or more RNA segments are connected to each other, different methods may be used to link the individual segments together. Also, the RNA segments may be connected to each other in one pot (e.g., a container, vessel, well, tube, plate, or other receptacle), all at the same time, or in one pot at different times or in different pots at different times. In a non-limiting example, to assemble RNA Segments 1, 2 and 3 in numerical order, RNA Segments 1 and 2 may first be connected, 5' to 3', to each other. The reaction product may then be purified for reaction mixture components (e.g., by chromatography), then placed in a second pot, for connection of the 3' terminus with the 5' terminus of RNA Segment 3. The final reaction product may then be connected to the 5' terminus of RNA Segment 3.

In another non-limiting example, RNA Segment 1 (about 30 nucleotides) is the target locus recognition sequence of a crRNA and a portion of Hairpin Region 1. RNA Segment 2 (about 35 nucleotides) contains the remainder of Hairpin Region 1 and some of the linear tracrRNA between Hairpin Region 1 and Hairpin Region 2. RNA Segment 3 (about 35 nucleotides) contains the remainder of the linear tracrRNA between Hairpin Region 1 and Hairpin Region 2 and all of Hairpin Region 2. In this example, RNA Segments 2 and 3 are linked, 5' to 3', using click chemistry. Further, the 5' and 3' end termini of the reaction product are both phosphorylated. The reaction product is then contacted with RNA Segment 1, having a 3' terminal hydroxyl group, and T4 RNA ligase to produce a guide RNA molecule.

A number of additional linking chemistries may be used to connect RNA segments according to method of the invention. Some of these chemistries are set out in Table 6 of US20160102322A1, which is incorporated herein by reference in its entirety.

Template Nucleic Acid Composition

In some embodiments, the template nucleic acid is a template RNA. In some embodiments, the template RNA comprises one or more modified nucleotides. For example, in some embodiments, the template RNA comprises one or more deoxyribonucleotides. In some embodiments, regions of the template RNA are replaced by DNA nucleotides, e.g., to enhance stability of the molecule. For example, the 3' end of the template may comprise DNA nucleotides, while the rest of the template comprises RNA nucleotides that can be reverse transcribed. For instance, in some embodiments, the heterologous object sequence is primarily or wholly made up of RNA nucleotides (e.g., at least 90%, 95%, 98%, or 99% RNA nucleotides). In some embodiments, one or both of the 3' UTR and the 3' target homology domain are primarily or wholly made up of DNA nucleotides (e.g., at least 90%, 95%, 98%, or 99% DNA nucleotides). In other embodiments, the template region for writing into the genome may comprise DNA nucleotides. In some embodiments, the DNA nucleotides in the template are copied into the genome by a domain capable of DNA-dependent DNA polymerase activity. In some embodiments, the DNA-dependent DNA polymerase activity is provided by a DNA polymerase domain in the polypeptide. In some embodiments, the DNA-dependent DNA polymerase activity is provided by a reverse transcriptase domain that is also capable of DNA-dependent DNA polymerization, e.g., second strand synthesis. In some embodiments, the DNA-dependent DNA polymerase activity is provided by a DNA polymerase. In some embodiments, the DNA-dependent DNA polymerase activity provided by a DNA polymerase domain in the polypeptide is not capable of reverse transcription activity. In some embodiments, the template molecule is composed of only DNA nucleotides. In some embodiments, the DNA template is polymerized into the genome by a DNA polymerase. In some embodiments, the template composed of DNA nucleotides comprises modified DNA nucleotides. In some embodiments, the template composed of DNA nucleotides comprises a modified backbone.

The nucleotides comprising the template of the GENE WRITER™ system can be natural or modified bases, or a combination thereof. For example, the template may contain pseudouridine, dihydrouridine, inosine, 7-methylguanosine, or other modified bases. In some embodiments, the template may contain locked nucleic acid nucleotides. In some embodiments, the modified bases used in the template do not inhibit the reverse transcription of the template. In some embodiments, the modified bases used in the template may improve reverse transcription, e.g., specificity or fidelity.

Additional Functional Characteristics for GENE WRITER™ Genome Editor Polypeptides A GENE WRITER™ as described herein may, in some instances, be characterized by one or more functional measurements or characteristics. In some embodiments, the DNA binding domain has one or more of the functional characteristics described below. In some embodiments, the RNA binding domain has one or more of the functional characteristics described below. In some embodiments, the endonuclease domain has one or more of the functional characteristics described below. In some embodiments, the reverse transcriptase domain has one or more of the functional characteristics described below. In some embodiments, the template (e.g., template RNA) has one or more of the functional characteristics described below. In some embodiments, the target site bound by the GENE WRITER™ has one or more of the functional characteristics described below.

GENE WRITER™ Polypeptide

DNA Binding Domain

In some embodiments, the DNA binding domain is capable of binding to a target sequence (e.g., a dsDNA target sequence) with greater affinity than a reference DNA binding domain. In some embodiments, the reference DNA binding domain is a DNA binding domain from R2_BM of B. mori. In some embodiments, the DNA binding domain is capable of binding to a target sequence (e.g., a dsDNA target sequence) with an affinity between 100 pM-10 nM (e.g., between 100 pM-1 nM or 1 nM-10 nM).

In some embodiments, the affinity of a DNA binding domain for its target sequence (e.g., dsDNA target sequence) is measured in vitro, e.g., by thermophoresis, e.g., as described in Asmari et al. Methods 146:107-119 (2018) (incorporated by reference herein in its entirety).

In embodiments, the DNA binding domain is capable of binding to its target sequence (e.g., dsDNA target sequence), e.g, with an affinity between 100 pM-10 nM (e.g., between 100 pM-1 nM or 1 nM-10 nM) in the presence of a molar excess of scrambled sequence competitor dsDNA, e.g., of about 100-fold molar excess.

In some embodiments, the DNA binding domain is found associated with its target sequence (e.g., dsDNA target sequence) more frequently than any other sequence in the genome of a target cell, e.g., human target cell, e.g., as measured by ChIP-seq (e.g., in HEK293T cells), e.g., as described in He and Pu (2010) Curr. Protoc Mol Biol Chapter 21 (incorporated herein by reference in its entirety). In some embodiments, the DNA binding domain is found associated with its target sequence (e.g., dsDNA target sequence) at least about 5-fold or 10-fold, more frequently than any other sequence in the genome of a target cell, e.g., as measured by ChIP-seq (e.g., in HEK293T cells), e.g., as described in He and Pu (2010), supra.

RNA Binding Domain

In some embodiments, the RNA binding domain is capable of binding to a template RNA with greater affinity than a reference RNA binding domain. In some embodiments, the reference RNA binding domain is an RNA binding domain from R2_BM of B. mori. In some embodiments, the RNA binding domain is capable of binding to a template RNA with an affinity between 100 pM-10 nM (e.g., between 100 pM-1 nM or 1 nM-10 nM). In some embodiments, the affinity of a RNA binding domain for its template RNA is measured in vitro, e.g., by thermophoresis, e.g., as described in Asmari et al. Methods 146:107-119 (2018) (incorporated by reference herein in its entirety). In some embodiments, the affinity of a RNA binding domain for its template RNA is measured in cells (e.g., by FRET or CLIP-Seq).

In some embodiments, the RNA binding domain is associated with the template RNA in vitro at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019) Nucleic Acids Res 47 (11): 5490-5501 (incorporated by reference herein in its entirety). In some embodiments, the RNA binding domain is associated with the template RNA in cells (e.g., in HEK293T cells) at a frequency at least about 5-fold or 10-fold higher than with a scrambled RNA. In some embodiments, the frequency of association between the RNA binding domain and the template RNA or scrambled RNA is measured by CLIP-seq, e.g., as described in Lin and Miles (2019), supra.

Endonuclease Domain

In some embodiments, the endonuclease domain is associated with the target dsDNA in vitro at a frequency at least about 5-fold or 10-fold higher than with a scrambled dsDNA. In some embodiments, the endonuclease domain is associated with the target dsDNA in vitro at a frequency at least about 5-fold or 10-fold higher than with a scrambled dsDNA, e.g., in a cell (e.g., a HEK293T cell). In some embodiments, the frequency of association between the endonuclease domain and the target DNA or scrambled DNA is measured by ChIP-seq, e.g., as described in He and Pu (2010) Curr. Protoc Mol Biol Chapter 21 (incorporated by reference herein in its entirety).

In some embodiments, the endonuclease domain can catalyze the formation of a nick at a target sequence, e.g., to an increase of at least about 5-fold or 10-fold relative to a non-target sequence (e.g., relative to any other genomic sequence in the genome of the target cell). In some embodiments, the level of nick formation is determined using NickSeq, e.g., as described in Elacqua et al. (2019) bioRxiv doi.org/10.1101/867937 (incorporated herein by reference in its entirety).

In some embodiments, the endonuclease domain is capable of nicking DNA in vitro. In embodiments, the nick results in an exposed base. In embodiments, the exposed base can be detected using a nuclease sensitivity assay, e.g., as described in Chaudhry and Weinfeld (1995) Nucleic Acids Res 23 (19): 3805-3809 (incorporated by reference herein in its entirety). In embodiments, the level of exposed bases (e.g., detected by the nuclease sensitivity assay) is increased by at least 10%, 50%, or more relative to a reference endonuclease domain. In some embodiments, the reference endonuclease domain is an endonuclease domain from R2_BM of B. mori.

In some embodiments, the endonuclease domain is capable of nicking DNA in a cell. In embodiments, the endonuclease domain is capable of nicking DNA in a HEK293T cell. In embodiments, an unrepaired nick that undergoes replication in the absence of Rad51 results in increased NHEJ rates at the site of the nick, which can be detected, e.g., by using a Rad51 inhibition assay, e.g., as described in Bothmer et al. (2017) Nat Commun 8:13905 (incorporated by reference herein in its entirety). In embodiments, NHEJ rates are increased above 0-5%. In embodiments, NHEJ rates are increased to 20-70% (e.g., between 30%-60% or 40-50%), e.g., upon Rad51 inhibition.

Figure 2:
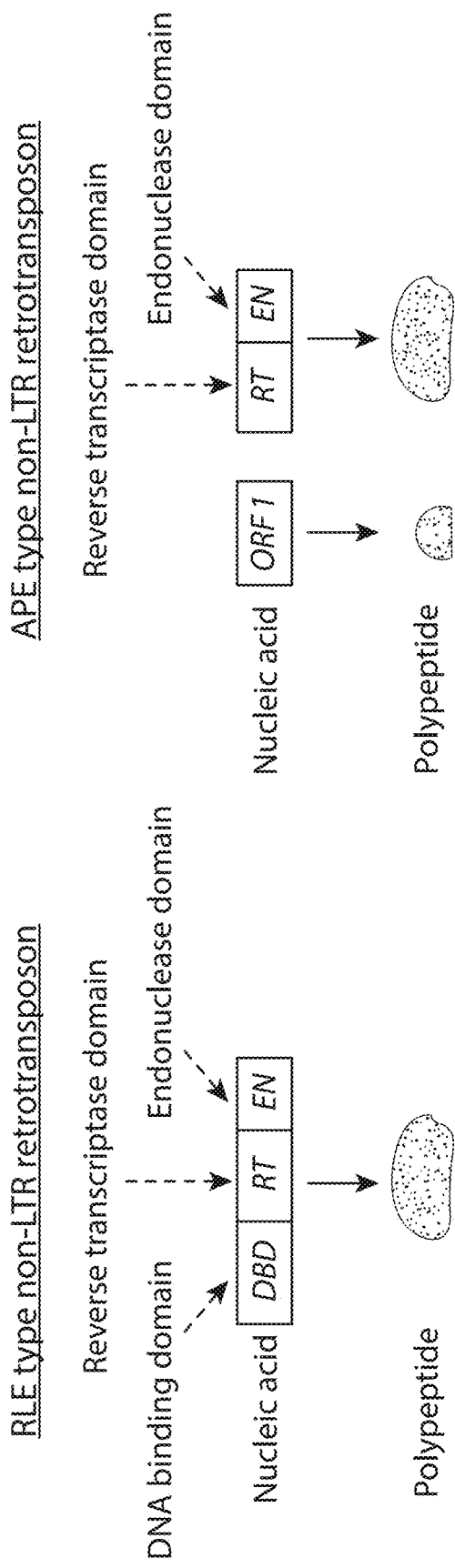
FIG. 2 is a schematic of the structure of the GENE WRITER™ genome editor polypeptide.
Figure 3:
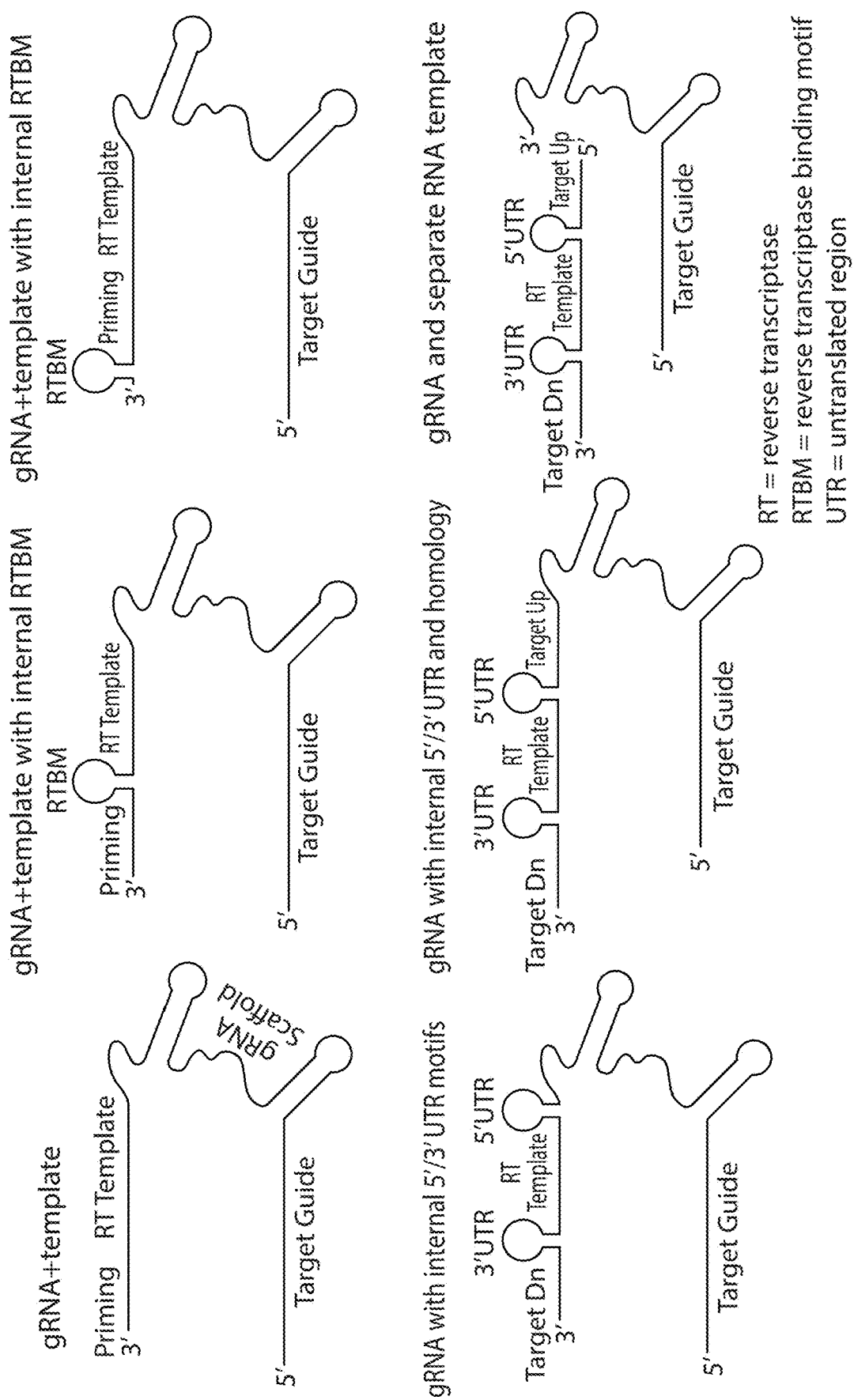
FIG. 3 is a schematic of the structure of exemplary GENE WRITER™ template RNAs.
Figure 4A:
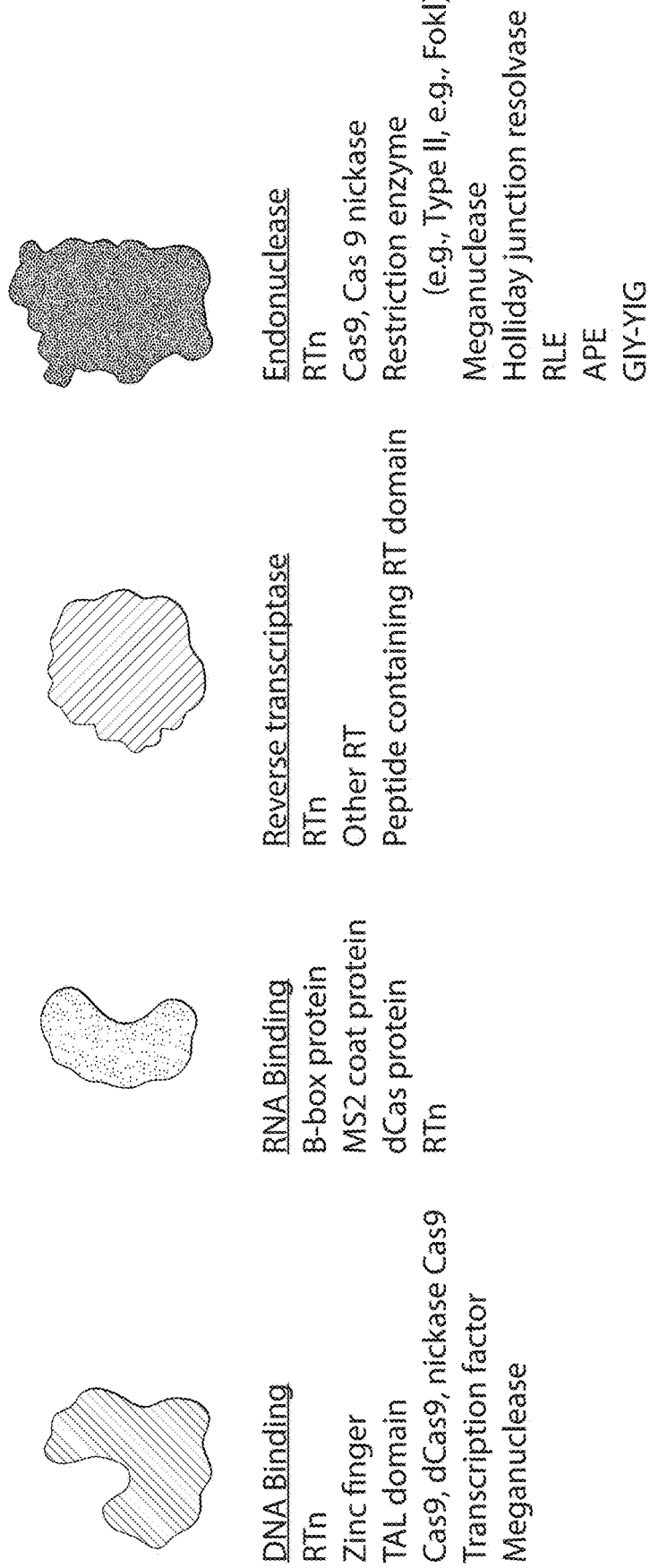
FIGS. 4A and 4B are a series of diagrams showing examples of configurations of GENE WRITER™ genome editor polypeptides using domains derived from a variety of sources. GENE WRITER™ genome editor polypeptides as described herein may or may not comprise all domains depicted. For example, a GENE WRITER™ genome editor polypeptide may, in some instances, lack an RNA-binding domain, or may have single domains that fulfill the functions of multiple domains, e.g., a Cas9 domain for DNA binding and endonuclease activity. Exemplary domains that can be included in a GeneWriter polypeptide include DNA binding domains (e.g., comprising a DNA binding domain, e.g., of a Table herein; a zinc finger; a TAL domain; Cas9; dCas9; nickase Cas9; a transcription factor, or a meganuclease), RNA binding domains (e.g., comprising an RNA binding domain of B-box protein, MS2 coat protein, dCas, or an element of a sequence of a Table herein), reverse transcriptase domains (e.g., comprising a reverse transcriptase domain of an element of a sequence of a Table herein; other retrotransposases (e.g., as listed in a Table herein); a peptide containing a reverse transctipase domain (e.g., as listed in a Table herein)), and/or an endonuclease domain (e.g., comprising an endonuclease domain of an element of a Table herein; Cas9; nickase Cas9; a restriction enzyme (e.g., a type II restriction enzyme, e.g., FokI); a meganuclease; a Holliday junction resolvase; an RLE retrotranspase; an APE retrotransposase; or a GIY-YIG retrotransposase). Exemplary GeneWriter polypeptides comprising exemplary combinations of such domains are shown in the bottom panel.
Figure 4B:
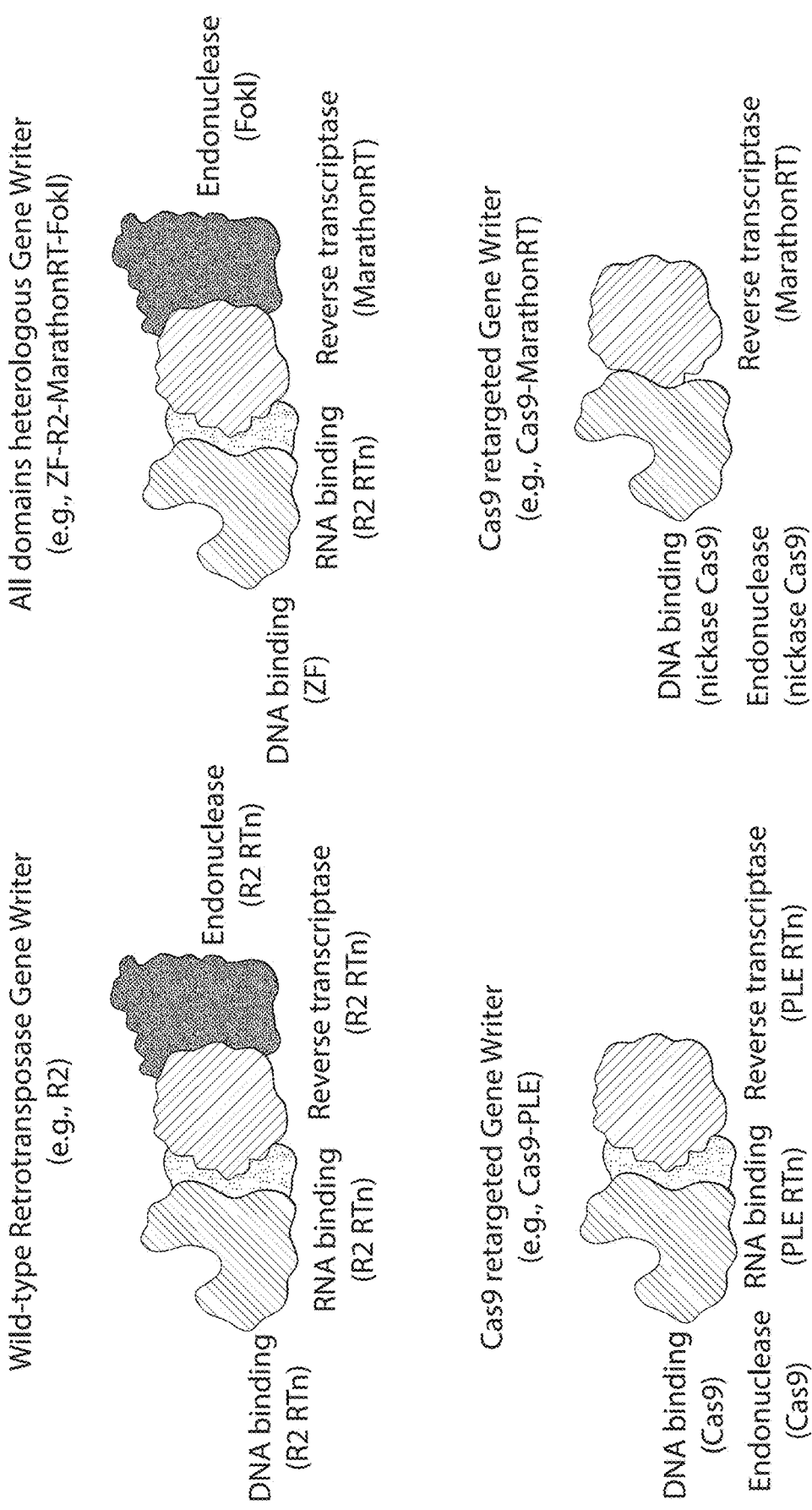

In some embodiments, the endonuclease domain releases the target after cleavage. In some embodiments, release of the target is indicated indirectly by assessing for multiple turnovers by the enzyme, e.g., as described in Yourik at al. RNA 25 (1): 35-44 (2019) (incorporated by reference in its entirety) and shown in FIG. 2. In some embodiments, the $k_{exp}$ of an endonuclease domain is $1 \times 10^{-3}$-$1 \times 10^{-5}$ min-1 as measured by such methods.

In some embodiments, the endonuclease domain has a catalytic efficiency ($k_{cat}/K_m$) greater than about $1 \times 10^8$ s$^{-1}$ M$^{-1}$ in vitro. In embodiments, the endonuclease domain has a catalytic efficiency greater than about $1 \times 10^5$, $1 \times 10^6$, $1 \times 10^7$, or $1 \times 10^8$, s$^{-1}$ M$^{-1}$ in vitro. In embodiments, catalytic efficiency is determined as described in Chen et al. (2018) Science 360 (6387): 436-439 (incorporated herein by reference in its entirety). In some embodiments, the endonuclease domain has a catalytic efficiency ($k_{cat}/K_m$) greater than about $1 \times 10^8$ s$^{-1}$ M$^{-1}$ in cells. In embodiments, the endonuclease domain has a catalytic efficiency greater than about $1 \times 10^5$, $1 \times 10^6$, $1 \times 10^7$, or $1 \times 10^8$ s$^{-1}$ M$^{-1}$ in cells.

Reverse Transcriptase Domain

In some embodiments, the reverse transcriptase domain has a lower probability of premature termination rate ($P_{off}$) in vitro relative to a reference reverse transcriptase domain. In some embodiments, the reference reverse transcriptase domain is a reverse transcriptase domain from R2_BM of B. mori or a viral reverse transcriptase domain, e.g., the RT domain from M-MLV.

In some embodiments, the reverse transcriptase domain has a lower probability of premature termination rate ($P_{off}$) in vitro of less than about $5 \times 10^{-3}$/nt, $5 \times 10^{-4}$/nt, or $5 \times 10^{-6}$/nt, e.g., as measured on a 1094 nt RNA. In embodiments, the in vitro premature termination rate is determined as described in Bibillo and Eickbush (2002) J Biol Chem 277 (38): 34836-34845 (incorporated by reference herein its entirety).

In some embodiments, the reverse transcriptase domain is able to complete at least about 30% or 50% of integrations in cells. The percent of complete integrations can be measured by dividing the number of substantially full-length integration events (e.g., genomic sites that comprise at least 98% of the expected integrated sequence) by the number of total (including substantially full-length and partial) integration events in a population of cells. In embodiments, the integrations in cells is determined (e.g., across the integration site) using long-read amplicon sequencing, e.g., as described in Karst et al. (2020) bioRxiv doi.org/10.1101/645903 (incorporated by reference herein its in entirety).

In embodiments, quantifying integrations in cells comprises counting the fraction of integrations that contain at least about 75%, 80%, 85%, 90%, 95%, 96%, 97%, 98%, 99%, or 100% of the DNA sequence corresponding to the template RNA (e.g., a template RNA having a length of at least 0.05, 0.1, 0.5, 0.6, 0.7, 0.8, 0.9, 1, 1.5, 2, 3, 4, or 5 kb, e.g., a length between 0.5-0.6, 0.6-0.7, 0.7-0.8, 0.8-0.9, 1.0-1.2, 1.2-1.4, 1.4-1.6, 1.6-1.8, 1.8-2.0, 2-3, 3-4, or 4-5 kb).

In some embodiments, the reverse transcriptase domain is capable of polymerizing dNTPs in vitro. In embodiments, the reverse transcriptase domain is capable of polymerizing dNTPs in vitro at a rate between 0.1-50 nt/sec (e.g., between 0.1-1, 1-10, or 10-50 nt/sec). In embodiments, polymerization of dNTPs by the reverse transcriptase domain is measured by a single-molecule assay, e.g., as described in Schwartz and Quake (2009) *PNAS* 106 (48): 20294-20299 (incorporated by reference in its entirety).

In some embodiments, the reverse transcriptase domain has an in vitro error rate (e.g., misincorporation of nucleotides) of between $1\times10^{-3}$-$1\times10^{-4}$ or $1\times10^{-4}$-$1\times10^{-5}$ substitutions/nt, e.g., as described in Yasukawa et al. (2017) *Biochem Biophys Res Commun* 492 (2): 147-153 (incorporated herein by reference in its entirety). In some embodiments, the reverse transcriptase domain has an error rate (e.g., misincorporation of nucleotides) in cells (e.g., HEK293T cells) of between $1\times10^{-3}$-$1\times10^{-4}$ or $1\times10^{-4}$-$1\times10^{-5}$ substitutions/nt, e.g., by long-read amplicon sequencing, e.g., as described in Karst et al. (2020) bioRxiv doi.org/10.1101/645903 (incorporated by reference herein in its entirety).

In some embodiments, the reverse transcriptase domain is capable of performing reverse transcription of a target RNA in vitro. In some embodiments, the reverse transcriptase requires a primer of at least 3 nt to initiate reverse transcription of a template. In some embodiments, reverse transcription of the target RNA is determined by detection of cDNA from the target RNA (e.g., when provided with a ssDNA primer, e.g., which anneals to the target with at least 3, 4, 5, 6, 7, 8, 9, or 10 nt at the 3' end), e.g., as described in Bibillo and Eickbush (2002) *J Biol Chem* 277 (38): 34836-34845 (incorporated herein by reference in its entirety).

In some embodiments, the reverse transcriptase domain performs reverse transcription at least 5 or 10 times more efficiently (e.g., by cDNA production), e.g., when converting its RNA template to cDNA, for example, as compared to an RNA template lacking the protein binding motif (e.g., a 3' UTR). In embodiments, efficiency of reverse transcription is measured as described in Yasukawa et al. (2017) *Biochem Biophys Res Commun* 492 (2): 147-153 (incorporated by reference herein in its entirety).

In some embodiments, the reverse transcriptase domain specifically binds a specific RNA template with higher frequency (e.g., about 5 or 10-fold higher frequency) than any endogenous cellular RNA, e.g., when expressed in cells (e.g., HEK293T cells). In embodiments, frequency of specific binding between the reverse transcriptase domain and the template RNA are measured by CLIP-seq, e.g., as described in Lin and Miles (2019) *Nucleic Acids Res* 47 (11): 5490-5501 (incorporated herein by reference in its entirety).

In some embodiments, a reverse transcriptase domain may comprise a mutation, e.g., as listed in Table 18. In embodiments, the mutation modifies, e.g., increases the stability and functionality of the RT domain. In some embodiments, the mutation modifies, e.g., increases processivity and template affinity of the RT domain. In some embodiments, the mutated RT domain may show at least 5 fold, at least 10 fold, at least 15 fold, at least 20 fold, at least 25 fold, at least 30 fold, at least 40 fold, at least 45 fold, at least 50 fold, at least 55 fold, at least 60 fold, at least 65 fold, at least 70 fold, at least 80 fold, at least 100 fold increase to processivitiy compared to an unmutated RT domain. In embodiments, a mutated RT domain may show at least at least 5 fold, at least 10 fold, at least 15 fold, at least 20 fold, at least 25 fold, at least 30 fold, at least 40 fold, at least 45 fold, at least 50 fold, at least 55 fold, at least 60 fold, at least 65 fold, at least 70 fold, at least 80 fold, at least 100 fold increase in template affinity compared to an unmutated RT domain. In some embodiments, a mutant RT domain may comprise one or more mutations selected from D200N/T330P/L603W, T306K, W313F, L139P, E607K.

Table 18 discloses mutations improve the properties of various reverse transcriptases. Core mutations expected to be the most impactful were applied across groups of retroviruses. Conservation of sequence across a group of viruses at one of these core mutations led to the installation of the mutation across that group (see Example 33, FIGS. 36A and B). Sequence positions refer to the positions in MMLV RT. In some embodiments, a RT domain described herein comprises a mutation as described in Table 18.

TABLE 18

List of exemplary RT domain mutations

| Group | L139 | D200 | T306 | W313 | T330 | L603 | E607 |
|---|---|---|---|---|---|---|---|
| Gamma | | D200N | T306K | W313F | T330P | L603W | |
| Epsilon | | D200N | T306K | W313F | T330P | L603W | |
| Delta | L139P | D200N | X | X | T330P | L603W* | X |
| Beta | L139P | X | X | X | T330P | X | X |
| Spuma | | D200N | T306K | X | T330P | L603W | |

Cas-RT Fusions

In some embodiments, a GeneWriter polypeptide comprises a RT domain fused to a Cas molecule. In some embodiments, the Cas molecule is the DBD and/or the endonuclease domain of the GeneWriter polypeptide. In some embodiments, the an RT domain comprises Cas9. In some embodiments, the Cas9 may comprise a mutation, e.g., a disclosed in Table 11. Table 19 discloses a list of exemplary Cas-RT fusion proteins.

In some embodiments, a Cas molecule in a GeneWriter polypeptide has a similar activity to an otherwise similar Cas molecule that is not fused to a RT domain. In some embodiments, the activity is at least 40%, 50%, 60%, 70%, 80%, or 90% of that of the otherwise similar Cas molecule. In some embodiments, the Cas molecule in the GeneWriter polypeptide may have an indel formation activity at least 40%, 50%, 60%, 70%, 80%, or 90% of that of an otherwise similar Cas molecule that is not fused to a RT domain, e.g., in an assay according to Example 32.

In some embodiments, a GeneWriter polypeptide comprises an amino acid sequence according to Table 19 below, or a sequence having at least 70%, 75%, 80%, 85%, 90%, 95%, 96%, 97%, 98%, or 99% identity thereto. In some embodiments, a nucleic acid encoding a GeneWriter polypeptide comprises a nucleic acid sequence according to Table 20, or a sequence having at least 70%, 75%, 80%, 85%, 90%, 95%, 96%, 97%, 98%, or 99% identity thereto.

TABLE 19

List of exemplary Gene Writer™ polypeptides comprising Cas-RT fusions

| Name | Cas domain | Linker | RT retroviral source | RT source polypeptide | Gene Writer™ polypeptide sequence |
|---|---|---|---|---|---|
| Cas-RT(MMLV) | Cas9 (N863A) | SGGSS GGSSG SETPG TSESA TPESS GGSSG GSS (SEQ ID NO: 1589) | Moloney murine leukemia virus (MMLV or MLVMS) | P03355 | MKRTADGSEFESPKKKRKVDKKYSIGLDIGTNSVG WAVITDEYKVPSKKFKVLGNTDRHSIKKNLIGALL FDSGETAEATRLKRTARRRYTRRKNRICYLQEIFS NEMAKVDDSFPHRLEESFLVEEDKKHERHPIFGNI VDEVAYHEKYPTIYHLRKKLVDSTDKADLRLIYLA LAHMIKFRGHFLIEGDLNPDNSDVDKLFIQLVQTY NQLFEENPINASGVDAKAILSARLSKSRRLENLIA QLPGEKKNGLFGNLIALSLGLTPNFKSNFDLAEDA KLQLSKDTYDDDLDNLLAQIGDQYADLFLAAKNLS DAILLSDILRVNTEITKAPLSASMIKRYDEHHQDL TLLKALVRQQLPEKYKEIFFDQSKNGYAGYIDGGA SQEEFYKFIKPILEKMDGTEELLVKLNREDLLRKQ RTFDNGSIPHQIHLGELHAILRRQEDFYPFLKDNR EKIEKILTFRIPYYVGPLARGNSRFAWMTRKSEET ITPWNFEEVVDKGASAQSFIERMTNFDKNLPNEKV LPKHSLLYEYFTVYNELTKVKYVTEGMRKPAFLSG EQKKAIVDLLFKTNRKVTVKQLKEDYFKKIECFDS VEISGVEDRFNASLGTYHDLLKIIKDKDFLDNEEN EDILEDIVLTLTLFEDREMIEERLKTYAHLFDDKV MKQLKRRRYTGWGRLSRKLINGIRDKQSGKTILDF LKSDGFANRNFMQLIHDDSLTFKEDIQKAQVSGQG DSLHEHIANLAGSPAIKKGILQTVKVVDELVKVMG RHKPENIVIEMARENQTTQKGQKNSRERMKRIEEG IKELGSQILKEHPVENTQLQNEKLYLYYLQNGRDM YVDQELDINRLSDYDVDHIVPQSFLKDDSIDNKVL TRSDKARGKSDNVPSEEVVKKMKNYWRQLLNAKLI TQRKFDNLTKAERGGLSELDKAGFIKRQLVETRQI TKHVAQILDSRMNTKYDENDKLIREVKVITLKSKL VSDFRKDFQFYKVREINNYHHAHDAYLNAVVGTAL IKKYPKLESEFVYGDYKVYDVRKMIAKSEQEIGKA TAKYFFYSNIMNFFKTEITLANGEIRKRPLIETNG ETGEIVWDKGRDFATVRKVLSMPQVNIVKKTEVQT GGFSKESILPKRNSDKLIARKKDWDPKKYGGFDSP TVAYSVLVVAKVEKGKSKKLKSVKELLGITIMERS SFEKNPIDFLEAKGYKEVKKDLIIKLPKYSLFELE NGRKRMLASAGELQKGNELALPSKYVNFLYLASHY EKLKGSPEDNEQKQLFVEQHKHYLDEIIEQISEFS KRVILADANLDKVLSAYNKHRDKPIREQAENIIHL FTLTNLGAPAAFKYFDTTIDRKRYTSTKEVLDATL IHQSITGLYETRIDLSQLGGDSGGSSGGSSGSETP GTSESATPESSGGSSGGSSTLNIEDEYRLHETSKE PDVSLGSTWLSDFPQAWAETGGMGLAVRQAPLIIP LKATSTPVSIKQYPMSQEARLGIKPHIQRLLDQGI LVPCQSPWNTPLLPVKKPGTNDYRPVQDLREVNKR VEDIHPTVPNPYNLLSGLPPSHQWYTVLDLKDAFF CLRLHPTSQPLFAFEWRDPEMGISGQLTWTRLPQG FKNSPTLFNEALHRDLADFRIQHPDLILLQYVDDL LLAATSELDCQQGTRALLQTLGNLGYRASAKKAQI CQKQVKYLGYLLKEGQRWLTEARKETVMGQPTPKT PRQLREFLGKAGFCRLFIPGFAEMAAPLYPLTKPG TLFNWGPDQQKAYQEIKQALLTAPALGLPDLTKPF ELFVDEKQGYAKGVLTQKLGPWRRPVAYLSKKLDP VAAGWPPCLRMVAAIAVLTKDAGKLTMGQPLVILA PHAVEALVKQPPDRWLSNARMTHYQALLLDTDRVQ FGPVVALNPATLLPLPEEGLQHNCLDILAEAHGTR PDLTDQPLPDADHTWYTDGSSLLQEGQRKAGAAVT TETEVIWAKALPAGTSAQRAELIALTQALKMAEGK KLNVYTDSRYAFATAHIHGEIYRRRGWLTSEGKEI KNKDEILALLKALFLPKRLSIIHCPGHQKGHSAEA RGNRMADQAARKAAITETPDTSTLLIENSSPSGGS KRTADGSEFEPKKKRKV (SEQ ID NO: 3560) |

TABLE 19-continued

List of exemplary Gene Writer ™ polypeptides comprising Cas-RT fusions

| Name | Cas domain | Linker | RT retroviral source | RT source polypeptide | Gene Writer ™ polypeptide sequence |
|---|---|---|---|---|---|
| Cas-RT(PERV) | Cas9 (N863A) | SGGSS GGSSG SETPG TSESA TPESS GGSSG GSS (SEQ ID NO: 1589) | Porcine endogenous retrovirus (PERV) | Q4VFZ2 | MAPKKKRKVGIHGVPAADKKYSIGLDIGTNSVGWA VITDEYKVPSKKFKVLGNTDRHSIKKNLIGALLFD SGETAEATRLKRTARRRYTRRKNRICYLQEIFSNE MAKVDDSFFHRLEESFLVEEDKKHERHPIFGNIVD EVAYHEKYPTIYHLRKKLVDSTDKADLRLIYLALA HMIKFRGHFLIEGDLNPDNSDVDKLFIQLVQTYNQ LFEENPINASGVDAKAILSARLSKSRRLENLIAQL PGEKKNGLFGNLIALSLGLTPNFKSNFDLAEDAKL QLSKDTYDDDLDNLLAQIGDQYADLFLAAKNLSDA ILLSDILRVNTEITKAPLSASMIKRYDEHHQDLTL LKALVRQQLPEKYKEIFFDQSKNGYAGYIDGGASQ EEFYKFIKPILEKMDGTEELLVKLNREDLLRKQRT FDNGSIPHQIHLGELHAILRRQEDFYPFLKDNREK IEKILTFRIPYYVGPLARGNSRFAWMTRKSEETIT PWNFEEVVDKGASAQSFIERMTNFDKNLPNEKVLP KHSLLYEYFTVYNELTKVKYVTEGMRKPAFLSGEQ KKAIVDLLFKTNRKVTVKQLKEDYFKKIECFDSVE ISGVEDRFNASLGTYHDLLKIIKDKDFLDNEENED ILEDIVLTLTLFEDREMIEERLKTYAHLFDDKVMK QLKRRRYTGWGRLSRKLINGIRDKQSGKTILDFLK SDGFANRNFMQLIHDDSLTFKEDIQKAQVSGQGDS LHEHIANLAGSPAIKKGILQTVKVVDELVKVMGRH KPENIVIEMARENQTTQKGQKNSRERMKRIEEGIK ELGSQILKEHPVENTQLQNEKLYLYYLQNGRDMYV DQELDINRLSDYDVDHIVPQSFLKDDSIDNKVLTR SDKARGKSDNVPSEEVVKKMKNYWRQLLNAKLITQ RKFDNLTKAERGGLSELDKAGFIKRQLVETRQITK HVAQILDSRMNTKYDENDKLIREVKVITLKSKLVS DFRKDFQFYKVREINNYHHAHDAYLNAVVGTALIK KYPKLESEFVYGDYKVYDVRKMIAKSEQEIGKATA KYFFYSNIMNFFKTEITLANGEIRKRPLIETNGET GEIVWDKGRDFATVRKVLSMPQVNIVKKTEVQTGG FSKESILPKRNSDKLIARKKDWDPKKYGGFDSPTV AYSVLVVAKVEKGKSKKLKSVKELLGITIMERSSF EKNPIDFLEAKGYKEVKKDLIIKLPKYSLFELENG RKRMLASAGELQKGNELALPSKYVNFLYLASHYEK LKGSPEDNEQKQLFVEQHKHYLDEIIEQISEFSKR VILADANLDKVLSAYNKHRDKPIREQAENIIHLFT LTNLGAPAAFKYFDTTIDRKRYTSTKEVLDATLIH QSITGLYETRIDLSQLGGDSGGSSGGSSGSETPGT SESATPESSGGSSGGSSLDDEYRLYSPLVKPDQNI QFWLEQFPQAWAETAGMGLAKQVPPQVIQLKASAT PVSVRQYPLSKEAQEGIRPHVQRLIQQGILVPVQS PWNTPLLPVRKPGTNDYRPVQDLREVNKRVQDIHP TVPNPYNLLCALPPQRSWYTVLDLKDAFFCLRLHP TSQPLFAFEWRDPGTGRTGQLTWTRLPQGFKNSPT IFNEALHRDLANFRIQHPQVTLLQYVDDLLLAGAT KQDCLEGTKALLLELSDLGYRASAKKAQICRREVT YLGYSLRDGQRWLTEARKKTVVQIPAPTTAKQVRE FLGKAGFCRLFIPGFATLAAPLYPLTKPKGEFSWA PEHQKAFDAIKKALLSAPALALPDVTKPFTLYVDE RKGVARGVLTQTLGPWRRPVAYLSKKLDPVASGWP VCLKAIAAVAILVKDADKLTLGQNITVIAPHALEN IVRQPPDRWMTNARMTHYQSLLLTERVTFAPPAAL NPATLLPEETDEPVTHDCHQLLIEETGVRKDLTDI PLTGEVLTWFTDGSSYVVEGKRMAGAAVVDGTRTI WASSLPEGTSAQKAELMALTQALRLAEGKSINIYT DSRYAFATAHVHGAIYKQRGWLTSAGREIKNKEEI LSLLEALHLPKRLAIIHCPGHQKAKDPISRGNQMA DRVAKQAAQGVNLLP (SEQ ID NO: 3561) |
| Cas-RT(MLVBM) | Cas9 (N863A) | SGGSS GGSSG SETPG TSESA TPESS GGSSG GSS (SEQ ID NO: 1589) | Murine leukemia virus (MLVBM) | Q7SVK7 | MAPKKKRKVGIHGVPAADKKYSIGLDIGTNSVGWA VITDEYKVPSKKFKVLGNTDRHSIKKNLIGALLFD SGETAEATRLKRTARRRYTRRKNRICYLQEIFSNE MAKVDDSFFHRLEESFLVEEDKKHERHPIFGNIVD EVAYHEKYPTIYHLRKKLVDSTDKADLRLIYLALA HMIKFRGHFLIEGDLNPDNSDVDKLFIQLVQTYNQ LFEENPINASGVDAKAILSARLSKSRRLENLIAQL PGEKKNGLFGNLIALSLGLTPNFKSNFDLAEDAKL QLSKDTYDDDLDNLLAQIGDQYADLFLAAKNLSDA ILLSDILRVNTEITKAPLSASMIKRYDEHHQDLTL LKALVRQQLPEKYKEIFFDQSKNGYAGYIDGGASQ EEFYKFIKPILEKMDGTEELLVKLNREDLLRKQRT |

TABLE 19-continued

List of exemplary Gene Writer ™ polypeptides comprising Cas-RT fusions

| Name | Cas domain | RT Linker | RT retroviral source | RT source polypeptide | Gene Writer ™ polypeptide sequence |
|---|---|---|---|---|---|
| | | | | | FDNGSIPHQIHLGELHAILRRQEDFYPFLKDNREK IEKILTFRIPYYVGPLARGNSRFAWMTRKSEETIT PWNFEEVVDKGASAQSFIERMTNFDKNLPNEKVLP KHSLLYEYFTVYNELTKVKYVTEGMRKPAFLSGEQ KKAIVDLLFKTNRKVTVKQLKEDYFKKIECFDSVE ISGVEDRFNASLGTYHDLLKIIKDKDFLDNEENED ILEDIVLTLTLFEDREMIEERLKTYAHLFDDKVMK QLKRRRYTGWGRLSRKLINGIRDKQSGKTILDFLK SDGFANRNFMQLIHDDSLTFKEDIQKAQVSGQGDS LHEHIANLAGSPAIKKGILQTVKVVDELVKVMGRH KPENIVIEMGRDMYVDQELDINRLSDYDVDHIVPQ SFLKDDSIDNKVLTRSDKARGKSDNVPSEEVVKKM KNYWRQLLNAKLITQRKFDNLTKAERGGLSELDKA GFIKRQLVETRQITKHVAQILDSRMNTKYDENDKL IREVKVITLKSKLVSDFRKDFQFYKVREINNYHHA HDAYLNAVVGTALIKKYPKLESEFVYGDYKVYDVR KMIAKSEQEIGKATAKYFFYSNIMNFFKTEITLAN GEIRKRPLIETNGETGEIVWDKGRDFATVRKVLSM PQVNIVKKTEVQTGGFSKESILPKRNSDKLIARKK DWDPKKYGGFDSPTVAYSVLVVAKVEKGKSKKLKS VKELLGITIMERSSFEKNPIDFLEAKGYKEVKKDL IIKLPKYSLFELENGRKRMLASAGELQKGNELALP SKYVNFLYLASHYEKLKGSPEDNEQKQLFVEQHKH YLDEIIEQISEFSKRVILADANLDKVLSAYNKHRD KPIREQAENIIHLFTLTNLGAPAAFKYFDTTIDRK RYTSTKEVLDATLIHQSITGLYETRIDLSQLGGDS GGSSGGSGSETPGTSESATPESSGGSSGGSSLGI EDEYRLHETSTEPDVSLGSTWLSDFPQAWAETGGM GLAVRQAPLIIPLKATSTPVSIQQYPMSHEARLGI KPHIQRLLDQGILVPCQSPWNTPLLPVKKPGTNDY RPVQDLREVNKRVEDIHPTVPNPYNLLSGLPPSHQ WYTVLDLKDAFFCLRLHPTSQPLFAFEWRDPGMGI SGQLTWTRLPQGFKNSPTLFNEALHRDLADFRIQH PDLILLQYVDDILLAATSELDCQQGTRALLQTLGD LGYRASAKKAQICQKQVKYLGYLLREGQRWLTEAR KETVMGQPVPKTPRQLREFLGKAGFCRLFIPGFAE MAAPLYPLTKPGTLFSWGPDQQKAYQEIKQALLTA PALGLPDLTKPFELFVDEKQGYAKGVLTQKLGPWR RPVAYLSKKLDPVAAGWPPCLRMVAAIAVLTKDAG KLTMGQPLVILAPHAVEALVKQPPDRWLSNARMTH YQAMLLDTDRVQFGPVVALNPATLLPLPEEGAPHD CLEILAETHGTRPDLTDQPIPDADHTWYTDGSSFL QEGQRKAGAAVTTETEVIWAGALPAGTSAQRAELI ALTQALKMAEGKRLNVYTDSRYAFATAHIHGEIYR RRGWLTSEGREIKNKSEILALLKALFLPKRLSIIH CLGHQKGDSAEARGNRLADQAAREAAIKTPPDTST LLI (SEQ ID NO:3562) |
| Cas-RT (MMTVB) | Cas9 (N863A) | SGGSS GGSSG SETPG TSESA TPESS GGSSG GSS (SEQ ID NO: 1589) | Mouse mammary tumor virus (MMTVB | P03365 | MAPKKKRKVGIHGVPAADKKYSIGLDIGTNSVGWA VITDEYKVPSKKFKVLGNTDRHSIKKNLIGALLFD SGETAEATRLKRTARRRYTRRKNRICYLQEIFSNE MAKVDDSFFHRLEESFLVEEDKKHERHPIFGNIVD EVAYHEKYPTIYHLRKKLVDSTDKADLRLIYLALA HMIKFRGHFLIEGDLNPDNSDVDKLFIQLVQTYNQ LFEENPINASGVDAKAILSARLSKSRRLENLIAQL PGEKKNGLFGNLIALSLGLTPNFKSNFDLAEDAKL QLSKDTYDDDLDNLLAQIGDQYADLFLAAKNLSDA ILLSDILRVNTEITKAPLSASMIKRYDEHHQDLTL LKALVRQQLPEKYKEIFFDQSKNGYAGYIDGGASQ EEFYKFIKPILEKMDGTEELLVKLNREDLLRKQRT FDNGSIPHQIHLGELHAILRRQEDFYPFLKDNREK IEKILTFRIPYYVGPLARGNSRFAWMTRKSEETIT PWNFEEVVDKGASAQSFIERMTNFDKNLPNEKVLP KHSLLYEYFTVYNELTKVKYVTEGMRKPAFLSGEQ KKAIVDLLFKTNRKVTVKQLKEDYFKKIECFDSVE ISGVEDRFNASLGTYHDLLKIIKDKDFLDNEENED ILEDIVLTLTLFEDREMIEERLKTYAHLFDDKVMK QLKRRRYTGWGRLSRKLINGIRDKQSGKTILDFLK SDGFANRNFMQLIHDDSLTFKEDIQKAQVSGQGDS LHEHIANLAGSPAIKKGILQTVKVVDELVKVMGRH KPENIVIEMARENQTTQKGQKNSRERMKRIEEGIK ELGSQILKEHPVENTQLQNEKLYLYYLQNGRDMYV DQELDINRLSDYDVDHIVPQSFLKDDSIDNKVLTR SDKARGKSDNVPSEEVVKKMKNYWRQLLNAKLITQ |

TABLE 19-continued

List of exemplary Gene Writer ™ polypeptides comprising Cas-RT fusions

| Name | Cas domain | RT Linker | RT retroviral source | RT source polypeptide | Gene Writer ™ polypeptide sequence |
|---|---|---|---|---|---|
| | | | | | RKFDNLTKAERGGLSELDKAGFIKRQLVETRQITK<br>HVAQILDSRMNTKYDENDKLIREVKVITLKSKLVS<br>DFRKDFQFYKVREINNYHHAHDAYLNAVVGTALIK<br>KYPKLESEFVYGDYKVYDVRKMIAKSEQEIGKATA<br>KYFFYSNIMNFFKTEITLANGEIRKRPLIETNGET<br>GEIVWDKGRDFATVRKVLSMPQVNIVKKTEVQTGG<br>FSKESILPKRNSDKLIARKKDWDPKKYGGFDSPTV<br>AYSVLVVAKVEKGKSKKLKSVKELLGITIMERSSF<br>EKNPIDFLEAKGYKEVKKDLIIKLPKYSLFELENG<br>RKRMLASAGELQKGNELALPSKYVNFLYLASHYEK<br>LKGSPEDNEQKQLFVEQHKHYLDEIIEQISEFSKR<br>VILADANLDKVLSAYNKHRDKPIREQAENIIHLFT<br>LTNLGAPAAFKYFDTTIDRKRYTSTKEVLDATLIH<br>QSITGLYETRIDLSQLGGDSGGSSGGSSGSETPGT<br>SESATPESSGGSSGGSSVQEISDSRPMLHIYLNGR<br>RFLGLLDTGADKTCIAGRDWPANWPIHQTESSLQG<br>LGMACGVARSSQPLRWQHEDKSGIIHPFVIPTLPF<br>TLWGRDIMKDIKVRLMTDSPDDSQDLMIGAIESNL<br>FADQISWKSDQPVWLNQWPLKQEKLQALQQLVTEQ<br>LQLGHLEESNSPWNTPVFVIKKKSGKWRLLQDLRA<br>VNATMHDMGALQPGLPSPVAVPKGWEIIIDLQDC<br>FFNIKLHPEDCKRFAFSVPSPNFKRPYQRFQWKVL<br>PQGMKNSPTLCQKFVDKAILTVRDKYQDSYIVHYM<br>DDILLAHPSRSIVDEILTSMIQALNKHGLVVSTEK<br>IQKYDNLKYLGTHIQGDSVSYQKLQIRTDKLRTLN<br>DFQKLLGNINWIRPFLKLTTGELKPLFEILNGDSN<br>PISTRKLTPEACKALQLMNERLSTARVKRLDLSQP<br>WSLCILKTEYTPTACLWQDGVVEWIHLPHISPKVI<br>TPYDIFCTQLIIKGRHRSKELFSKDPDYIVVPYTK<br>VQFDLLLQEKEDWPISLLGFLGEVHFHLPKDPLLT<br>FTLQTAIIFPHMTSTTPLEKGIVIFTDGSANGRSV<br>TYIQGREPIIKENTQNTAQQAEIVAVITAFEEVSQ<br>PFNLYTDSKYVTGLFPEIETATLSPRTKIYTELKH<br>LQRLIHKRQEKFYIGHIRGHTGLPGPLAQGNAYAD<br>SLTRILTA(SEQ ID NO: 3563) |
| Cas-<br>RT<br>(MPMV) | Cas9<br>(N863A) | SGGSS<br>GGSSG<br>SETPG<br>TSESA<br>TPESS<br>GGSSG<br>GSS<br>(SEQ<br>ID NO:<br>1589) | Mason-<br>Pfizer<br>monkey<br>virus<br>(MPMV) | P07572 | MAPKKKRKVGIHGVPAADKKYSIGLDIGTNSVGWA<br>VITDEYKVPSKKFKVLGNTDRHSIKKNLIGALLFD<br>SGETAEATRLKRTARRRYTRRKNRICYLQEIFSNE<br>MAKVDDSFFHRLEESFLVEEDKKHERHPIFGNIVD<br>EVAYHEKYPTIYHLRKKLVDSTDKADLRLIYLALA<br>HMIKFRGHFLIEGDLNPDNSDVDKLFIQLVQTYNQ<br>LFEENPINASGVDAKAILSARLSKSRRLENLIAQL<br>PGEKKNGLFGNLIALSLGLTPNFKSNFDLAEDAKL<br>QLSKDTYDDDLDNLLAQIGDQYADLFLAAKNLSDA<br>ILLSDILRVNTEITKAPLSASMIKRYDEHHQDLTL<br>LKALVRQQLPEKYKEIFFDQSKNGYAGYIDGGASQ<br>EEFYKFIKPILEKMDGTEELLVKLNREDLLRKQRT<br>FDNGSIPHQIHLGELHAILRRQEDFYPFLKDNREK<br>IEKILTFRIPYYVGPLARGNSRFAWMTRKSEETIT<br>PWNFEEVVDKGASAQSFIERMTNFDKNLPNEKVLP<br>KHSLLYEYFTVYNELTKVKYVTEGMRKPAFLSGEQ<br>KKAIVDLLFKTNRKVTVKQLKEDYFKKIECFDSVE<br>ISGVEDRFNASLGTYHDLLKIIKDKDFLDNEENED<br>ILEDIVLTLTLFEDREMIEERLKTYAHLFDDKVMK<br>QLKRRRYTGWGRLSRKLINGIRDKQSGKTILDFLK<br>SDGFANRNFMQLIHDDSLTFKEDIQKAQVSGQGDS<br>LHEHIANLAGSPAIKKGILQTVKVVDELVKVMGRH<br>KPENIVIEMARENQTTQKGQKNSRERMKRIEEGIK<br>ELGSQILKEHPVENTQLQNEKLYLYYLQNGRDMYV<br>DQELDINRLSDYDVDHIVPQSFLKDDSIDNKVLTR<br>SDKARGKSDNVPSEEVVKKMKNYWRQLLNAKLITQ<br>RKFDNLTKAERGGLSELDKAGFIKRQLVETRQITK<br>HVAQILDSRMNTKYDENDKLIREVKVITLKSKLVS<br>DFRKDFQFYKVREINNYHHAHDAYLNAVVGTALIK<br>KYPKLESEFVYGDYKVYDVRKMIAKSEQEIGKATA<br>KYFFYSNIMNFFKTEITLANGEIRKRPLIETNGET<br>GEIVWDKGRDFATVRKVLSMPQVNIVKKTEVQTGG<br>FSKESILPKRNSDKLIARKKDWDPKKYGGFDSPTV<br>AYSVLVVAKVEKGKSKKLKSVKELLGITIMERSSF<br>EKNPIDFLEAKGYKEVKKDLIIKLPKYSLFELENG<br>RKRMLASAGELQKGNELALPSKYVNFLYLASHYEK<br>LKGSPEDNEQKQLFVEQHKHYLDEIIEQISEFSKR<br>VILADANLDKVLSAYNKHRDKPIREQAENIIHLFT |

TABLE 19-continued

List of exemplary Gene Writer ™ polypeptides comprising Cas-RT fusions

| Name | Cas domain | Linker | RT retroviral source | RT source polypeptide | Gene Writer ™ polypeptide sequence |
|---|---|---|---|---|---|
| | | | | | LTNLGAPAAFKYFDTTIDRKRYTSTKEVLDATLIH QSITGLYETRIDLSQLGGDSGGSSGGSSGSETPGT SESATPESSGGSSGGSSTAAIDILAPQQCAEPITW KSDEPVWVDQWPLTNDKLAAAQQLVQEQLEAGHIT ESSSPWNTPIFVIKKKSGKWRLLQDLRAVNATMVL MGALQPGLPSPVAIPQGYLKIIDLKDCFFSIPLH PSDQKRFAFSLPSTNFKEPMQRFQWKVLPQGMANS PTLCQKYVATAIHKVRHAWKQMYIIHYMDDILIAG KDGQQVLQCFDQLKQELTAAGLHIAPEKVQLQDPY TYLGFELNGPKITNQKAVIRKDKLQTLNDFQKLLG DINWLRPYLKLTTGDLKPLFDTLKGDSDPNSHRSL SKEALASLEKVETAIAEQFVTHINYSLPLIFLIFN TALTPTGLFWQDNPIMWIHLPASPKKVLLPYYDAI ADLIILGRDHSKKYFGIEPSTIIQPYSKSQIDWLM QNTEMWPIACASFVGILDNHYPPNKLIQFCKLHTF VFPQIISKTPLNNALLVFTDGSSTGMAAYTLTDTT IKFQTNLNSAQLVELQALIAVLSAFPNQPLNIYTD SAYLAHSIPLLETVAQIKHISETAKLFLQCQQLIY NRSIPFYIGHVRAHSGLPGPIAQGNQRADLATKIV ASNINTN (SEQ ID NO: 3564) |

TABLE 20

Exemplary Gene Writer ™ polypeptide coding mRNAs sequences

| Name | mRNA (5' to 3') | Tail |
|---|---|---|
| Cas9-RT(MMLV) | AGGAAAUAAGAGAGAAAAGAAGAGU AAGAAGAAAUAUAAGAGCCACCAUG AAACGGACAGCCGACGGAAGCGAGU UCGAGUCACCAAAGAAGAAGCGGAA AGUCGACAAGAAGUACAGCAUCGGC CUGGACAUCGGCACCAACUCUCUGUGG GCUGGGCCGUGAUCACCGACGAGUA CAAGGUGCCCAGCAAGAAAUUCAAG GUGCUGGGCAACACCGACCGGCACA GCAUCAAGAAGAACCUGAUCGGAGC CCUGCUGUUCGACAGCGGCGAAACA GCCGAGGCCACCCGGCUGAAGAGAA CCGCCAGAAGAAGAUACACCAGACG GAAGAACCGGAUCUGCUAUCUGCAA GAGAUCUUCAGCAACGAGAUGGCCA AGGUGGACGACAGCUUCUUCCACAG ACUGGAAGAGUCCUUCCUGGUGGAA GAGGAUAAGAAGCACGAGCGGCACC CCAUCUUCGGCAACAUCGUGGACGA GGUGGCCUACCACGAGAAGUACCCC ACCAUCUACCACCUGAGAAAGAAAC UGGUGGACAGCACCGACAAGGCCGA CCUGCGGCUGAUCUAUCUGGCCCUG GCCCACAUGAUCAAGUUCCGGGGCC ACUUCCUGAUCGAGGGCGACCUGAA CCCCGACAACAGCGACGUGGACAAG CUGUUCAUCCAGCUGGUGCAGACCU ACAACCAGCUGUUCGAGGAAAACCC CAUCAACGCCAGCGGCGUGGACGCC AAGGCCAUCCUGUCUGCCAGACUGA GCAAGAGCAGACGGCUGGAAAAUCU GAUCGCCCAGCUGCCCGGCGAGAAG AAGAAUGGCCUGUUCGGAAACCUGA UUGCCCUGAGCCUGGGCCUGACCCC CAACUUCAAGAGCAACUUCGACCUG GCCGAGGAUGCCAAACUGCAGCUGA GCAAGGACACCUACGACGACGACCU GGACAACCUGCUGGCCCAGAUCGGC GACCAGUACGCCGACCUGUUUCUGG CCGCCAAGAACCUGUCCGACGCCAU CCUGCUGAGCGACAUCCUGAGAGUG AACACCGAGAUCACCAAGGCCCCCC UGAGCGCCUCUAUGAUCAAGAGAUA CGACGAGCACCACCAGGACCUGACC CUGCUGAAAGCCCUCGUGCGGCAGC AGCUGCCUGAGAAGUACAAAGAGAU UUUCUUCGACCAGAGCAAGAACGGC UACGCCGGCUACAUUGACGGCGGAG CCAGCCAGGAAGAGUUCUACAAGUU CAUCAAGCCCAUCCUGGAAAAGAUG GACGGCACCGAGGAACUGCUCGUGA AGCUGAACAGAGAGGACCUGCUGCG GAAGCAGCGGACCUUCGACAACGGC AGCAUCCCCCACCAGAUCCACCUGG GAGAGCUGCACGCCAUUCUGCGGCG GCAGGAAGAUUUUUACCCAUUCCUG AAGGACAACCGGGAAAAGAUCGAGA AGAUCCUGACCUUCCGCAUCCCCUA CUACGUGGGCCCUCUGGCCAGGGGA AACAGCAGAUUCGCCUGGAUGACCA GAAAGAGCGAGGAAACCAUCACCCC CUGGAACUUCGAGGAAGUGGUGGAC AAGGGCGCUUCCGCCCAGAGCUUCA UCGAGCGGAUGACCAACUUCGAUAA GAACCUGCCCAACGAGAAGGUGCUG CCCAAGCACAGCCUGCUGUACGAGU ACUUCACCGUGUAUAACGAGCUGAC CAAAGUGAAAUACGUGACCGAGGGA AUGAGAAAGCCCGCCUUCCUGAGCG GCGAGCAGAAAAAGGCCAUCGUGGA CCUGCUGUUCAAGACCAACCGGAAA GUGACCGUGAAGCAGCUGAAAGAGG ACUACUUCAAGAAAAUCGAGUGCUU CGACUCCGUGGAAAUCUCCGGCGUG GAAGAUCGGUUCAACGCCUCCCUGG GCACAUACCACGAUCUGCUGAAAAU UAUCAAGGACAAGGACUUCCUGGAC AAUGAGGAAAACGAGGACAUUCUGG AAGAUAUCGUGCUGACCCUGACACU GUUUGAGGACAGAGAGAUGAUCGAG GAACGGCUGAAAACCUAUGCCCACC UGUUCGACGACAAAGUGAUGAAGCA GCUGAAGCGGCGGAGAUACACCGGC UGGGGCAGGCUGAGCCGGAAGCUGA UCAACGGCAUCCGGGACAAGCAGUC CGGCAAGACAAUCCUGGAUUUCCUG | (A)80 (SEQ ID NO: 3666) |

TABLE 20-continued

Exemplary Gene Writer ™ polypeptide coding mRNAs sequences

| Name | mRNA (5' to 3') | Tail |
|---|---|---|
| | AAGUCCGACGGCUUCGCCAACAGAA | |
| | ACUUCAUGCAGCUGAUCCACGACGA | |
| | CAGCCUGACCUUAAAGAGGACAUC | |
| | CAGAAAGCCCAGGUGUCCGGCCAGG | |
| | GCGAUAGCCUGCACGAGCACAUUGC | |
| | CAAUCUGGCCGGCAGCCCCGCCAUU | |
| | AAGAAGGGCAUCCUGCAGACAGUGA | |
| | AGGUGGUGGACGAGCUCGUGAAAGU | |
| | GAUGGGCCGGCACAAGCCCGAGAAC | |
| | AUCGUGAUCGAAAUGGCCAGAGAGA | |
| | ACCAGACCACCCAGAAGGGACAGAA | |
| | GAACAGCCGCGAGAGAAUGAAGCGG | |
| | AUCGAAGAGGGCAUCAAAGAGCUGG | |
| | GCAGCCAGAUCCUGAAAGAACACCC | |
| | CGUGGAAAACACCCAGCUGCAGAAC | |
| | GAGAAGCUGUACCUGUACUACCUGC | |
| | AGAAUGGGCGGGAUAUGUACGUGGA | |
| | CCAGGAACUGGACAUCAACCGGCUG | |
| | UCCGACUACGAUGUGGACCAUAUCG | |
| | UGCCUCAGAGCUUUCUGAAGGACGA | |
| | CUCCAUCGACAACAAGGUGCUGACC | |
| | AGAAGCGACAAGGCCCGGGGCAAGA | |
| | GCGACAACGUGCCCUCCGAAGAGGU | |
| | CGUGAAGAAGAUGAAGAACUACUGG | |
| | CGGCAGCUGCUGAACGCCAAGCUGA | |
| | UUACCCAGAGAAAGUUCGACAAUCU | |
| | GACCAAGGCCGAGAGAGGCGGCCUG | |
| | AGCGAACUGGAUAAGGCCGGCUUCA | |
| | UCAAGAGACAGCUGGUGGAAACCCG | |
| | GCAGAUCACAAAGCACGUGGCACAG | |
| | AUCCUGGACUCCCGGAUGAACACUA | |
| | AGUACGACGAGAAUGACAAGCUGAU | |
| | CCGGGAAGUGAAAGUGAUCACCCUG | |
| | AAGUCCAAGCUGGUGUCCGAUUUCC | |
| | GGAAGGAUUUCCAGUUUUACAAAGU | |
| | GCGCGAGAUCAACAACUACCACCAC | |
| | GCCCACGACGCCUACCUGAACGCCG | |
| | UCGUGGGAACCGCCCUGAUCAAAAA | |
| | GUACCCUAAGCUGGAAAGCGAGUUC | |
| | GUGUACGGCGACUACAAGGUGUACG | |
| | ACGUGCGGAAGAUGAUCGCCAAGAG | |
| | CGAGCAGGAAAUCGGCAAGGCUACC | |
| | GCCAAGUACUUCUUCUACAGCAACA | |
| | UCAUGAACUUUUUCAAGACCGAGAU | |
| | UACCCUGGCCAACGGCGAGAUCCGG | |
| | AAGCGGCCUCUGAUCGAGACAAACG | |
| | GCGAAACCGGGGAGAUCGUGUGGGA | |
| | UAAGGGCCGGGAUUUUGCCACCGUG | |
| | CGGAAAGUGCUGAGCAUGCCCCAAG | |
| | UGAAUAUCGUGAAAAAGACCGAGGU | |
| | GCAGACAGGCGGCUUCAGCAAAGAG | |
| | UCUAUCCUGCCCAAGAGGAACAGCG | |
| | AUAAGCUGAUCGCCAGAAAGAAGGA | |
| | CUGGGACCCUAAGAAGUACGGCGGC | |
| | UUCGACAGCCCCACCGUGGCCUAUU | |
| | CUGUGCUGGUGGUGGCCAAAGUGGA | |
| | AAAGGGCAAGUCCAAGAAAACUGAAG | |
| | AGUGUGAAAGAGCUGCUGGGGGAUCA | |
| | CCAUCAUGGAAAGAAGCAGCUUCGA | |
| | GAAGAAUCCCAUCGACUUUCUGGAA | |
| | GCCAAGGGCUACAAAGAAGUGAAAA | |
| | AGGACCUGAUCAUCAAGCUGCCUAA | |
| | GUACUCCCUGUUCGAGCUGGAAAAC | |
| | GGCCGGAAGAGAAUGCUGGCCUCUG | |
| | CCGGCGAACUGCAGAAGGGAAACGA | |
| | ACUGGCCCUGCCCUCCAAAUAUGUG | |
| | AACUUCCUGUACCUGGCCAGCCACU | |
| | AUGAGAAGCUGAAGGGCUCCCCCGA | |
| | GGAUAAUGAGCAGAAACAGCUGUUU | |
| | GUGGAACAGCACAAGCACUACCUGG | |
| | ACGAGAUCAUCGAGCAGAUCAGCGA | |
| | GUUCUCCAAGAGAGUGAUCCUGGCC | |
| | GACGCUAAUCUGGACAAAGUGCUGU | |
| | CCGCCUACAACAAGCACCGGGAUAA | |
| | GCCCAUCAGAGAGCAGGCCGAGAAU | |

TABLE 20-continued

Exemplary Gene Writer ™ polypeptide coding mRNAs sequences

| Name | mRNA (5' to 3') | Tail |
|---|---|---|
| | AUCAUCCACCUGUUUACCCUGACCA | |
| | AUCUGGGAGCCCCUGCCGCCUUCAA | |
| | GUACUUUGACACCACCAUCGACCGG | |
| | AAGAGGUACACCAGCACCAAAGAGG | |
| | UGCUGGACGCCACCCUGAUCCACCA | |
| | GAGCAUCACCGGCCUGUACGAGACA | |
| | CGGAUCGACCUGUCUCAGCUGGGAG | |
| | GUGACUCUGGAGGAUCUAGCGGAGG | |
| | AUCCUCUGGCAGCGAGACACCAGGA | |
| | ACAAGCGAGUCAGCAACACCAGAGA | |
| | GCAGUGGCGGCAGCAGCGGCGGCAG | |
| | CAGCACCCUAAAAUAUGAAGAUGAG | |
| | UAUCGGCUACAUGAGACCUCAAAAG | |
| | AGCCAGAUGUUUCUCUAGGGUCCAC | |
| | AUGGCUGUCUGAUUUUCCUCAGGCC | |
| | UGGGCGGAAACCGGGGGCAUGGGAC | |
| | UGGCAGUUCGCCAAGCUCCUCUGAU | |
| | CAUACCUCUGAAAGCAACCUCUACC | |
| | CCCGUGUCCAUAAAACAAUACCCCA | |
| | UGUCACAAGAAGCCAGACUGGGGAU | |
| | CAAGCCCCACAUACAGAGACUGUUG | |
| | GACCAGGGAAUACUGGUACCCUGCC | |
| | AGUCCCCUGGAACACGCCCCUGCU | |
| | ACCCGUUAAGAAACCAGGGACUAAU | |
| | GAUUAUAGGCCUGUCCAGGAUCUGA | |
| | GAGAAGUCAACAAGCGGGUGGAAGA | |
| | CAUCCACCCCACCGUGCCCAACCCU | |
| | UACAACCUCUUGAGCGGGGCUCCCA | |
| | CGUCCCACCAGUGGUACACUGUGCU | |
| | UGAUUUAAAGGAUGCCUUUUUCUGC | |
| | CUGAGACUCCACCCCACCAGUCAGC | |
| | CUCUCUUCGCCUUUGAGUGGAGAGA | |
| | UCCAGAGAUGGGAAUCUCAGGACAA | |
| | UUGACCUGGACCAGACUCCCACAGG | |
| | GUUUCAAAACAGUCCCCACCCUGUU | |
| | UAAUGAGGCACUGCACAGAGACCUA | |
| | GCAGACUUCCGGAUCCAGCACCCUG | |
| | ACUUGAUCCUGCUACAGUACGUGGA | |
| | UGACUUACUGCUGGCCGCCACUUCU | |
| | GAGCUAGACUGCCAACAAGGUACUC | |
| | GGGCCCUGUUACAAACCCUAGGGAA | |
| | CCUCGGGUAUCGGGCCUCGGCCAAG | |
| | AAAGCCCAAAUUUGCCAGAAACAGG | |
| | UCAAGUAUCUGGGGUAUCUUCUAAA | |
| | AGAGGGACAGAGAUGGCUGACUGAG | |
| | GCCAGAAAAGAGACUGUGAUGGGGC | |
| | AGCCUACUCCGAAGACCCCUCGACA | |
| | ACUAAGGGAGUUCCUAGGGAAGGCA | |
| | GGCUUCGUGUCGCCUCUUCAUCCCUG | |
| | GGUUUGCAGAAAUGGCAGCCCCCU | |
| | GUACCCUCUCACCAAACCGGGGACU | |
| | CUGUUUAAUUGGGGCCCAGACCAAC | |
| | AAAAGGCCUAUCAAGAAAAUCAAGCA | |
| | AGCUCUUUCUAACUGCCCCAGCCCUG | |
| | GGGUUGCCAGAUUUGACUAAGCCCU | |
| | UUGAACUCUUUGUCGACGAGAAGCA | |
| | GGGCUACGCCAAAGGUGUCCUAACG | |
| | CAAAAACUGGGACCUUGGCGUCGGC | |
| | CGGUGGCCUACCUGUCCAAAAAGCU | |
| | AGACCCAGUAGCAGCUGGGUGGCCC | |
| | CCUUGCCUACGGAUGGUAGCAGCCA | |
| | UUGCCGUACUGACAAAAGGAUGCAGG | |
| | CAAGCUAACCAUGGGACAGCCACUA | |
| | GUCAUUCUGGCCCCCCAUGCAGUAG | |
| | AGGCACUAGUCAAACAACCCCCCGA | |
| | CCGCUGGCUUUCCAACGCCCGGAUG | |
| | ACUCACUAUCAGGCCUUGCUUUUGG | |
| | ACACGGACCGGGUCCAGUUCGGACC | |
| | GGUGGUAGCCCUGAACCCGGCUACG | |
| | CUGCUCCCACUGCCUGAGGAAAGGG | |
| | UGCAACACAACUGCCUUGAUAUCCU | |
| | GGCCGAAGCCCACGGAACCCGACCC | |
| | GACCUAACGGACCAGCCGCUCCCAG | |
| | ACGCCGACCACACCUGGUACACGGA | |
| | UGGAAGCAGUCUCUUACAAGAGGGA | |

TABLE 20-continued

Exemplary Gene Writer ™ polypeptide coding mRNAs sequences

| Name | mRNA (5' to 3') | Tail |
|---|---|---|
| | CAGCGUAAGGCGGGAGCUGCGGUGA<br>CCACCGAGACCGAGGUAAUCUGGGC<br>UAAAGCCCUGCCAGCCGGGACAUCC<br>GCUCAGCGGGCUGAACUGAUAGCAC<br>UCACCCAGGCCCUAAAGAUGGCAGA<br>AGGUAAGAAGCUAAAUGUUUAUACU<br>GAUAGCCGUUAUGCUUUUGCUACUG<br>CCCAUAUCCAUGGAGAAAUAUACAG<br>AAGGCGUGGGUGGCUCACAUCAGAA<br>GGCAAAGAGAUCAAAAAUAAAGACG<br>AGAUCUUGGCCCUACUAAAAGCCCU<br>CUUUCUGCCCAAAAGACUUAGCAUA<br>AUCCAUUGUCCAGGACAUCAAAAGG<br>GACACAGCGCCGAGGCUAGAGGCAA<br>CCGGAUGGCUGACCAAGCGGCCCGA<br>AAGGCAGCCAUCACAGAGACUCCAG<br>ACACCUCUACCCUCCUCAUAGAAAA<br>UUCAUCACCCUCUGGCGGCUCAAAA<br>AGAACCGCCGACGGCAGCGAAUUCG<br>AGCCCAAGAAGAGGAAAGUCUG<br>AUUAAUUAAGCUGCCUUCUGCGGGG<br>CUUGCCUUCUGGCCAUGCCCUUCUU<br>CUCUCCCUUGCACCUGUACCUCUUG<br>GUCUUUGAAUAAAGCCUGAGUAGGA<br>AGUCUAG<br>(SEQ ID NO: 3565) | |
| Cas9-<br>RT(PERV) | AGGAAAUAAGAGAGAAAAGAAGAGU<br>AAGAAGAAAUAUAAGAGCCACCAUG<br>GCUCCCAAAAAGAAAAGGAAGGUGG<br>GCAUUCACGGCGUGCCUGCGGCCGA<br>CAAAAAGUACAGCAUCGGCCUUGAU<br>AUCGGCACCAAUAGCGUGGGCUGGG<br>CCGUUAUCACAGACGAAUACAAGGU<br>ACCCAGCAAGAAGUUCAAGGUGCUG<br>GGGAAUACAGACAGGCACUCUAUCA<br>AGAAAAACCUUAUCGGGGCUCUGCU<br>GUUUGACUCAGGCGAGACCGCCGAG<br>GCCACCAGGUUGAAGAGGACCGCAA<br>GGCGAAGGUACACCCGGAGGAAGAA<br>CAGGAUCUGCUAUCGCAGGAGAUC<br>UUCAGCAACGAGAUGGCCAAGGUGG<br>ACGACAGCUUCUUCCACAGGCUGGA<br>GGAGAGCUUCCUUGUCGAGGAGGAU<br>AAGAAGCACGAACGACACCCCAUCU<br>UCGGCAACAUAGUCGACGAGGUCGC<br>UUAUCACGAGAAGUACCCCACCAUC<br>UACCACCUGCGAAAGAAAUUGGUGG<br>AUAGCACCGAUAAAGCCGACUUGCG<br>ACUUAUCUACUUGGCUCUGGCGCAC<br>AUGAUUAAGUUCAGGGGCCACUUCC<br>UGAUCGAGGGCGACCUUAACCCCGA<br>CAACAGUGACGUAGACAAAUUGUUC<br>AUCCAGCUUGUACAGACCUAUAACC<br>AGCUGUUCGAGGAAAACCCUAUUAA<br>CGCCAGCGGGGUGGAUGCGAAGGCC<br>AUACUUAGCGCCAGGCUGAGCAAAA<br>GCAGGCGCUUGGAGAACCUGAUAGC<br>CCAGCUGCCCGGUGAAAAGAAGAAC<br>GGCCUCUUCGGUAAUCUGAUUGCCC<br>UGAGCCUGGGCCUGACCCCCAACUU<br>CAAGAGCAACUUCGACCUGGCAGAA<br>GAUGCCAAGCUGCAGUUGAGUAAGG<br>ACACCUAUGACGACGACUUGGACAA<br>UCUGCUCGCCCAAAUCGGCGACCAG<br>UACGCUGACCUGUUCCUCGCCGCCA<br>AGAACCUUUCUGACGCAAUCCUGCU<br>UAGCGAUAUCCUUAGGGUGAACACA<br>GAGAUCACCAAGGCCCCCCUGAGCG<br>CCGAUGAUCAAGAGGUACGACGA<br>GCACCAUCAGGACCUGACCCUUCUG<br>AAGGCCCUGGUGAGGCAGCAACUGC<br>CCGAGAAGUACAAGGAGAUCUUUUU<br>CGACCAGAGCAAGAACGGCUACGCC<br>GGCUACAUCGACGGCGGAGCCAGCC | (A)80<br>(SEQ<br>ID<br>NO:<br>3666) |

TABLE 20-continued

Exemplary Gene Writer ™ polypeptide coding mRNAs sequences

| Name | mRNA (5' to 3') | Tail |
|---|---|---|
| | AAGAGGAGUUCUACAAGUUCAUCAA<br>GCCCAUCCUGGAGAAGAUGGAUGGC<br>ACCGAGGAGCUGCUGGUGAAGCUGA<br>ACAGGGAAGAUUUGCUCCGGAAGCA<br>GAGGACCUUUGACAACGGUAGCAUC<br>CCCCACCAGAUCCACCUGGGCGAGC<br>UGCACGCAAUACUGAGGCGACAGGA<br>GGAUUUCUACCCCUUCCUCAAGGAC<br>AAUAGGGAGAAAAUCGAAAAGAUUC<br>UGACCUUCAGGAUCCCCUACUACGU<br>GGGCCCUCUUGCCAGGGGCAACAGC<br>CGAUUCGCUUUGGAUGACAAGAAAGA<br>GCGAGGAGACCAUCACCCCCUGGAA<br>CUUCGAGGAAGUGGUGGACAAAGGA<br>GCAAGCGCGCAGUCUUUCAUCGAAC<br>GGAUGACCAAUUUCGACAAAAACCU<br>GCCUAACGAGAAGGUGCUGCCCAAG<br>CACAGCCUGCUUUACGAGUACUUCA<br>CCGUGUACAACGAGCUCACCAAGGU<br>GAAAUAUGUGACCGAGGGCAUGCGA<br>AAACCCGCUUUCCUGAGCGGCGAGC<br>AGAAGAAGGCCAUCGUGGACCUGCU<br>GUUCAAGACCAACAGGAAGGUGACC<br>GUGAAGCAGCUGAAGGAGGACUACU<br>UCAAGAAGAUCGAGUGCUUUGAUAG<br>CGUGGAAAUAAGCGGCGUGGAGGAC<br>AGGUUCAACGCCAGCCUGGGCACCU<br>ACCACGACUUGCUGAAGAUAAUCAA<br>AGACAAGGAUUUCCUGGAUAAUGAG<br>GAGAACGAGGAUAUACUCGAGGACA<br>UCGUGCUGACUUUGACCCUGUUUGA<br>GGACCGAGAGAUGAUUGAAGAAGG<br>CUCAAAACCUACGCCCACCUGUUCG<br>ACGACAAAGUGAUGAAACAACUGAA<br>GAGACGAAGAUACACCGGCUGGGGC<br>AGACUGUCCAGGAAGCUCAUCAACG<br>GCAUUAGGGACAAGCAGAGCGGCAA<br>GACCAUCCUGGAUUUCCUGAAGUCC<br>GACGGCUUCGCCAACCGAAACUUCA<br>UGCAGCUGAUUCACGAUGACAGCUU<br>GACCUUCAAGGAGGACAUCCAGAAG<br>GCCCAGGUUAGCGGCCAGGGCGACU<br>CCCUGCACGAACAUAUUGCAAACCU<br>GGCAGGCUCCCCUGCGAUCAAGAAG<br>GGCAUACUGCAGACCGUUAAGGUUG<br>UGGACGAAUUGGUCAAGGUCAUGGG<br>CAGGCACAAGCCCGAAAACAUAGUU<br>AUAGAGAUGGCCAGAGAGAACCAGA<br>CCACCCAAAAGGGCCAGAAGAACAG<br>CCGGGAGCGCAUGAAAAGGAUCGAG<br>GAGGGUAUCAAGGAACUCGGAAGCC<br>AGAUCCUCAAAGAGCACCCCGUGGA<br>GAAUACCCAGCUCCAGAACGAGAAG<br>CUGUACCUGUACUACCUGCAGAACG<br>GCAGGGACAUGUACGUUGACCAGGA<br>GUUGGACAUCAACAGGCUUUCAGAC<br>UAUGACGUGGAUCACAUAGUGCCCC<br>AGAGCUUCUUAAAGACGAUAGCAU<br>CGACAACAAGGUCCUGACCCGCUCC<br>GACAAAGCCAGGGGCAAAAGCGACA<br>ACGUGCCAAGCGAAGAGGUGGUUAA<br>AAAGAUGAAGAACUACUGGAGGCAA<br>CUGCUCAACGCGAAAUUGAUCACCC<br>AGAGAAAGUUCGAUAACCUGACCAA<br>GGCCGAGAGGGGCGGACUCUCCGAA<br>CUUGACAAAGCAGGCUUCAUCAAGA<br>GGCAGCUGGUCGAGACCCGACAGAU<br>CACGAAGCACGUGGCCCAAAUCCUC<br>GACAGCAGAAUGAAUACCAAGUACG<br>AUGAGAAUGACAAACUCAUCAGGGA<br>AGUGAAAGUGAUUACCCUGAAGAGC<br>AAGUUGGUGUCCGACUUUCGCAAAG<br>AUUUCCAGUUCUACAAGGUGAGGGA<br>GAUCAACAACUACCACCAUGCCCAC<br>GACGCAUACCUGAACGCCGUGGUCG | |

TABLE 20-continued

Exemplary Gene Writer ™ polypeptide coding mRNAs sequences

| Name | mRNA (5' to 3') | Tail |
|---|---|---|
| | GCACCGCCCUGAUUAAGAAGUAUCC | |
| | AAAGCUGGAGUCCGAAUUUGUCUAC | |
| | GGCGACUACAAAGUUUACGAUGUGA | |
| | GGAAGAUGAUCGCUAAGAGCGAACA | |
| | GGAGAUCGGCAAGGCCACCGCUAAG | |
| | UAUUUCUUCUACAGCAACAUCAUGA | |
| | ACUUUUUCAAGACCGAGAUCACACU | |
| | UGCCAACGGCGAAAUCAGGAAGAGG | |
| | CCGCUUAUCGAGACCAACGGUGAGA | |
| | CCGGCGAGAUCGUGUGGGACAAGGG | |
| | CAGGGACUUCGCCACCGUGAGGAAA | |
| | GUCCUGAGCAUGCCCCAGGUGAAUA | |
| | UUGUGAAAAAACUGAGGUGCAGAC | |
| | AGGCGGCUUUAGCAAGGAAUCCAUC | |
| | CUGCCCAAGAGGAACAGCGACAAGC | |
| | UGAUCGCCCGGAAGAAGGACUGGGA | |
| | CCCUAAGAAGUAUGGAGGCUUCGAC | |
| | AGCCCCACCGUAGCCUACAGCGUGC | |
| | UGGUGGUCGCGAAGGUAGAGAAGGG | |
| | GAAGAGCAAGAAACUGAAGAGCGUG | |
| | AAGGAGCUGCUCGGCAUAACCAUCA | |
| | UGGAGAGGUCCAGCUUUGAGAAGAA | |
| | CCCCAUUGACUUUUUGGAAGCCAAG | |
| | GGCUACAAAGAGGUCAAAAAGGACC | |
| | UGAUCAUCAAACUCCCCAAGUACUC | |
| | CCUGUUUGAAUUGGAGAACGGCAGA | |
| | AAGAGGAUGCUGGCGAGCGCUGGGG | |
| | AACUGCAAAAGGGCAACGAACUGGC | |
| | GCUGCCCAGCAAGUACGUGAAUUUU | |
| | CUGUACCUGGCGUCCCACUACGAAA | |
| | AGCUGAAAGGCAGCCCCGAGGACAA | |
| | CGAGCAGAAGCAGCUGUUCGUGGAG | |
| | CAGCACAAGCAUUACCUGGACGAGA | |
| | UAAUCGAGCAAAUCAGCGAGUUCAG | |
| | CAAGAGGGUGAUUCUGGCCGACGCG | |
| | AACCUGGAUAAGGUCCUCAGCGCCU | |
| | ACAACAAGCACCGAGACAAACCCAU | |
| | CAGGGAGCAGGCCGAGAAUAUCAUA | |
| | CACCUGUUCACCCUGACAAAUCUGG | |
| | GCGCACCUGCGGCAUUCAAAUACUU | |
| | CGAUACCACCAUCGACAGGAAAAGG | |
| | UACACUAGCACUAAGGAGGUGCUGG | |
| | AUGCCACCUUGAUCCACCAGUCCAU | |
| | UACCGGCCUGUAUGAGACCAGGAUC | |
| | GACCUGAGCCAGCUUGGAGGCGACU | |
| | CUGGAGGAUCUAGCGGAGGAUCCUC | |
| | UGGCAGCGAGACACCAGGAACAAGC | |
| | GAGUCAGCAACACCAGAGAGCAGUG | |
| | GCGGCAGCAGCGGCGGCAGCAGCCU | |
| | GGACGACGAGUACAGACUGUAUAGC | |
| | CCUCUGGUGAAGCCAGAUCAGAACA | |
| | UUCAGUUCUGGCUGGAACAGUUUCC | |
| | ACAGGCCUGGGCCGAAACAGCCGGA | |
| | AUGGGCCUGGCCAAGCAGGUGCCUC | |
| | CUCAGGUGAUCCAGCUGAAGGCCAG | |
| | CGCCACACCUGUGUCCGUGCGGCAG | |
| | UACCCUCUGUCCAAGGAGGCUCAGG | |
| | AGGGCAUCAGACCUCACGUCCAGCG | |
| | GCUGAUCCAGCAGGGGAUCCUGGUG | |
| | CCCGUGCAAAGCCCUUGGAACACCC | |
| | CUCUUCUGCCCGUGAGAAAACCCGG | |
| | CACAAACGACUACCGGCCUGUGCAG | |
| | GACCUGAGAGAAGUGAACAAGCGGG | |
| | UGCAGGACAUCCACCCCACAGUGCC | |
| | AAAUCCUUACAACCUGCUUUGUGCC | |
| | CUGCCCCCCCAGCGCAGCUGGUACA | |
| | CCGUUCUGGACCUGAAAGAUGCCUU | |
| | UUUCUGUCUGAGACUUCAUCCUACA | |
| | AGCCAGCCCCUGUUCGCCUUCGAGU | |
| | GGCGGGAUCCUGGCACCGGCCGAC | |
| | AGGCCAGCUGACAUGGACCAGACUG | |
| | CCUCAGGGCUUCAAGAACAGCCCUA | |
| | CCAUCUUCAACGAGGCCCUGCACAG | |
| | AGACCUUGCCAACUUCAGAAUCCAA | |
| | CACCCACAGGUGACCCUGCUCCAGU | |
| | ACGUGGAUGACCUGCUGCUGGCCGG | |
| | CGCCACAAAACAAGAUUGCCUGGAA | |
| | GGCACCAAGGCCCUUCUGCUGGAGC | |
| | UGAGCGACCUGGGAUAUCGGGCCUC | |
| | UGCUAAGAAAGCUCAGAUCUGCAGG | |
| | AGAGAGGUGACCUACCUGGGCUACU | |
| | CUCUGAGAGAUGGCCAAAGAUGGCU | |
| | GACCGAGGCCAGAAAGAAAACCGUG | |
| | GUGCAAAUCCCCGCUCCUACAACAG | |
| | CCAAGCAGGUUAGAGAGUUCCUGGG | |
| | AAAGGCUGGAUUUUGCAGACUGUUC | |
| | AUCCCAGGCUUUGCCACCCUGGCCG | |
| | CCCCUCUGUACCCCCUGACCAAACC | |
| | UAAGGGCGAGUUCAGCUGGGCCCCA | |
| | GAGCACCAGAAGGCAUUCGACGCGA | |
| | UCAAGAAGGCUCUGCUGUCUGCCCC | |
| | UGCCCUGGCUCUGCCCGACGUGACA | |
| | AAGCCCUUCACCCUGUACGUGGACG | |
| | AACGGAAGGGCGUGGCUAGAGGCGU | |
| | UCUGACCCAGACCCUGGGUCCUUGG | |
| | AGAAGGCCUGUGGCCUACCUCAGUA | |
| | AGAAGCUGGAUCCUGUGGCCUCUGG | |
| | CUGGCCUGUGUGCCUGAAGGCCAUC | |
| | GCCGCCGUGGCCAUUCUGGUCAAGG | |
| | AUGCCGAUAAGCUGACCCUAGGCCA | |
| | GAAUAUCACCGUGAUCGCCCCUCAC | |
| | GCCCUCGAGAACAUCGUGCGGCAGC | |
| | CUCCCGACAGAUGGAUGACCAACGC | |
| | CAGAAUGACCCACUACCAGAGCCUG | |
| | UUGCUGACCGAGAGAGUGACCUUCG | |
| | CCCCUCCAGCUGCCCUGAAUCCCGC | |
| | CACUCUGCUGCCCGAGGAAACCGAC | |
| | GAGCCUGUGACCCACGACUGCCACC | |
| | AGCUGCUGAUCGAGGAAACCGGCGU | |
| | CAGAAAGGACCUGACAGAUAUCCCU | |
| | CUGACCGGAGAGGUGCUGACAUGGU | |
| | UCACCGACGGCAGCAGCUACGUCGU | |
| | GGAAGGCAAGCGGAUGGCCGGCGCC | |
| | GCUGUGGUCGACGGCACAAGAACCA | |
| | UCUGGGCUUCCAGCCUGCCUGAGGG | |
| | CACCAGCGCCCAGAAGGCCGAGCUG | |
| | AUGGCCCUCACACAGGCCCUGCGGC | |
| | UGGCUGAGGGCAAAAGCAUCAACAU | |
| | CUAUACAGACAGCCGUUACGCCUUC | |
| | GCCACAGCGCACGUGCACGGCGCCA | |
| | UCUACAAGCAGAGAGGAUGGCGAC | |
| | CUCUGCCGGAAGAGAAAUCAAGAAC | |
| | AAGGAAGAAAUCCUGAGCCUGCUGG | |
| | AAGCCCUGCAUCUCCCAAAGAGACU | |
| | GGCCAUCAUCCACUGCCCCGGCCAC | |
| | CAGAAGGCCAAAGACCCUAUCAGCA | |
| | GAGGCAACCAGAUGGCCGACCGGGU | |
| | GGCCAAGCAAGCCGCCCAAGGCGUG | |
| | AAUCUGCUGCCUUAGUUAAUUAAGC | |
| | UGCCUUCUGCGGGGCUUGCCUUCUG | |
| | GCCAUGCCCUUCUUCUCUCCCUUGC | |
| | ACCUGUACCUCUUGGUCUUUGAAUA | |
| | AAGCCUGAGUAGGAAGUCUAG | |
| | (SEQ ID NO: 3566) | |

In some embodiments, a fusion protein may comprise a Cas molecule, e.g., a mutated Cas9, e.g., a Cas-nuclease containing a mutation inhibiting (e.g., inactivating) one endonuclease active site, e.g., the Cas9 nickase Cas9 (N863A). In some embodiments, the fusion protein comprises a peptide linker, e.g., a glycine serine rich flexible peptide linker, e.g., a linker as disclosed in Tables 13 and/or 56, e.g., linker 10, in Table 56. In some embodiments, the fusion protein comprises a RT domain, e.g., a RT domain comprising a sequence from Table 2, Table 4, Table 5, Table 6, Table 8, Table 9, Table 1, or a fragment or variant thereof. In some embodiments, the Cas-RT fusion protein (or nucleic acid encoding the same) is formulated with a gRNA. In some embodiments, the linker length is between 2-40 amino acids, between 5-30 amino acids, between 5-20 amino acids, between 10-20 amino acids, or between 10-15 amino acids. In some embodiments, the Cas-RT fusion proteins has similar DNA binding activity to a Cas molecule that is not fused with a RT domain. In some embodiments, a Cas-RT may comprise a RT domain comprising a mutation. In embodiments, the mutant RT domain shows increased processivity and template affinity compared to an unmutated RT domain. Target Site In some embodiments, after GENE WRITING™, the target site surrounding the integrated sequence contains a limited number of insertions or deletions, for example, in less than about 50% or 10% of integration events, e.g., as determined by long-read amplicon sequencing of the target site, e.g., as described in Karst et al. (2020) bioRxiv doi.org/10.1101/645903 (incorporated by reference herein in its entirety). In some embodiments, the target site does not show multiple insertion events, e.g., head-to-tail or head-to-head duplications, e.g., as determined by long-read amplicon sequencing of the target site, e.g., as described in Karst et al. bioRxiv doi.org/10.1101/645903 (2020) (incorporated herein by reference in its entirety). In some embodiments, the target site contains an integrated sequence corresponding to the template RNA. In some embodiments, the target site does not contain insertions resulting from endogenous RNA in more than about 1% or 10% of events, e.g., as determined by long-read amplicon sequencing of the target site, e.g., as described in Karst et al. bioRxiv doi.org/10.1101/645903 (2020) (incorporated herein by reference in its entirety). In some embodiments, the target site contains the integrated sequence corresponding to the template RNA.

Second Strand Nicking

In some embodiments, a GENE WRITER™ system described herein comprises nickase activity that nicks the first strand and the second strand of target DNA. As discussed herein, without wishing to be bound by theory, nicking of the first strand of the target site DNA is thought to provide a 3' OH that can be used by an RT domain to reverse transcribe a sequence of a template RNA, e.g., a heterologous object sequence. Without wishing to be bound by theory, it is thought that introducing an additional nick to the second strand may bias the cellular DNA repair machinery to adopt the heterologous object sequence-based sequence more frequently than the original genomic sequence. In some embodiments, the additional nick to the second strand is made by the same endonuclease domain (e.g., nickase domain) as the nick to the first strand. In some embodiments, the same GENE WRITER™ polypeptide performs both the nick to the first strand and the nick to the second strand. In some embodiments, the GENE WRITER™ polypeptide comprises a CRISPR/Cas domain and the additional nick to the second strand is directed by an additional nucleic acid, e.g., comprising a second gRNA directing the CRISPR/Cas domain to nick the second strand. In other embodiments, the additional second strand nick is made by a different endonuclease domain (e.g., nickase domain) than the nick to the first strand. In some embodiments, that different endonuclease domain is situated in an additional polypeptide (e.g., a system of the invention further comprises the additional polypeptide), separate from the GENE WRITER™ polypeptide. In some embodiments, the additional polypeptide comprises an endonuclease domain (e.g., nickase domain) described herein. In some embodiments, the additional polypeptide comprises a DNA binding domain, e.g., described herein.

It is contemplated herein that the position at which the second strand nick occurs relative to the first strand nick may influence the extent to which one or more of: desired GENE WRITING™ DNA modifications are obtained, undesired double-strand breaks (DSBs) occur, undesired insertions occur, or undesired deletions occur. Without wishing to be bound by theory, second strand nicking may occur in two general orientations: inward nicks and outward nicks.

In some embodiments, in the inward nick orientation, the RT domain polymerizes (e.g., using the template RNA (e.g., the heterologous object sequence)) away the second strand nick. In some embodiments, in the inward nick orientation, the location of the nick to the first strand and the location of the nick to the second strand are positioned between the first PAM site and second PAM site (e.g., in a scenario wherein both nicks are made by a polypeptide (e.g., a GENE WRITER™ polypeptide) comprising a CRISPR/Cas domain). In some embodiments, in the inward nick orientation, the location of the nick to the first strand and the location of the nick to the second strand are between the sites where the polypeptide and the additional polypeptide bind to the target DNA. In some embodiments, in the inward nick orientation, the location of the nick to the second strand is positioned on the same side of the binding sites of the polypeptide and additional polypeptide relative to the location of the nick to the first strand. In some embodiments, in the inward nick orientation, the location of the nick to the first strand and the location of the nick to the second strand are positioned between the PAM site and the site at a distance from the target site.

An example of a GENE WRITER™ system that provides an inward nick orientation comprises a GENE WRITER™ polypeptide comprising a CRISPR/Cas domain, a template RNA comprising a gRNA that directs nicking of the target site DNA on the first strand, and an additional nucleic acid comprising an additional gRNA that directs nicking at a site a distance from the location of the first nick, wherein the location of the first nick and the location of the second nick are between the PAM sites of the sites to which the two gRNAs direct the GENE WRITER™ polypeptide. As a further example, another GENE WRITER™ system that provides an inward nick orientation comprises a GENE WRITER™ polypeptide comprising a zinc finger molecule and a first nickase domain wherein the zinc finger molecule binds to the target DNA in a manner that directs the first nickase domain to nick the first strand of the target site; an additional polypeptide comprising a CRISPR/Cas domain, and an additional nucleic acid comprising a gRNA that directs the additional polypeptide to nick a site a distance from the target site DNA on the second strand, wherein the location of the first nick and the location of the second nick are between the PAM site and the site to which the zinc finger molecule binds. As a further example, another GENE WRITER™ system that provides an inward nick orientation comprises a GENE WRITER™ polypeptide comprising a zinc finger molecule and a first nickase domain wherein the zinc finger molecule binds to the target DNA in a manner that directs the first nickase domain to nick the first strand of the target site; an additional polypeptide comprising a TAL effector molecule and a second nickase domain wherein the TAL effector molecule binds to a site a distance from the target site in a manner that directs the additional polypeptide to nick the second strand, wherein the location of the first nick and the location of the second nick are between the site to which the TAL effector molecule binds and the site to which the zinc finger molecule binds.

In some embodiments, in the outward nick orientation, the RT domain polymerizes (e.g., using the template RNA (e.g., the heterologous object sequence)) toward the second strand nick. In some embodiments, in the inward nick orientation when both the first and second nicks are made by a polypeptide comprising a CRISPR/Cas domain (e.g., a GENE WRITER™ polypeptide), the first PAM site and second PAM site are positioned between the location of the nick to the first strand and the location of the nick to the second strand. In some embodiments, in the inward nick orientation, the polypeptide (e.g., the GENE WRITER™ polypeptide) and the additional polypeptide bind to sites on the target DNA between the location of the nick to the first strand and the location of the nick to the second. In some embodiments, in the inward nick orientation, the location of the nick to the second strand is positioned on the opposite side of the binding sites of the polypeptide and additional polypeptide relative to the location of the nick to the first strand. In some embodiments, in the inward orientation, the PAM site and the site at a distance from the target site are positioned between the location of the nick to the first strand and the location of the nick to the second strand.

An example of a GENE WRITER™ system that provides an outward nick orientation comprises a GENE WRITER™ polypeptide comprising a CRISPR/Cas domain, a template RNA comprising a gRNA that directs nicking of the target site DNA on the first strand, and an additional nucleic acid comprising an additional gRNA that directs nicking at a site a distance from the location of the first nick, wherein the location of the first nick and the location of the second nick are outside of the PAM sites of the sites to which the two gRNAs direct the GENE WRITER™ polypeptide (i.e., the PAM sites are between the the location of the first nick and the location of the second nick). As a further example, another GENE WRITER™ system that provides an outward nick orientation comprises a GENE WRITER™ polypeptide comprising a zinc finger molecule and a first nickase domain wherein the zinc finger molecule binds to the target DNA in a manner that directs the first nickase domain to nick the first strand of the target site; an additional polypeptide comprising a CRISPR/Cas domain, and an additional nucleic acid comprising a gRNA that directs the additional polypeptide to nick a site a distance from the target site DNA on the second strand, wherein the location of the first nick and the location of the second nick are outside the PAM site and the site to which the zinc finger molecule binds (i.e., the PAM site and the site to which the zinc finger molecule binds are between the the location of the first nick and the location of the second nick). As a further example, another GENE WRITER™ system that provides an outward nick orientation comprises a GENE WRITER™ polypeptide comprising a zinc finger molecule and a first nickase domain wherein the zinc finger molecule binds to the target DNA in a manner that directs the first nickase domain to nick the first strand of the target site; an additional polypeptide comprising a TAL effector molecule and a second nickase domain wherein the TAL effector molecule binds to a site a distance from the target site in a manner that directs the additional polypeptide to nick the second strand, wherein the location of the first nick and the location of the second nick are outside the site to which the TAL effector molecule binds and the site to which the zinc finger molecule binds (i.e., the site to which the TAL effector molecule binds and the site to which the zinc finger molecule binds are between the location of the first nick and the location of the second nick).

Without wishing to be bound by theory, it is thought that, for GENE WRITER™ systems where a second strand nick is provided, an outward nick orientation is preferred in some embodiments. As is described herein, an inward nick may produce a higher number of double-strand breaks (DSBs) than an outward nick orientation. DSBs may be recognized by the DSB repair pathways in the nucleus of a cell, which can result in undesired insertions and deletions. An outward nick orientation may provide a decreased risk of DSB formation, and a corresponding lower amount of undesired insertions and deletions. In some embodiments, undesired insertions and deletions are insertions and deletions not encoded by the heterologous object sequence, e.g., an insertion or deletion produced by the double-strand break repair pathway unrelated to the modification encoded by the heterologous object sequence. In some embodiments, a desired GENE WRITING™ modification comprises a change to the target DNA (e.g., a substitution, insertion, or deletion) encoded by the heterologous object sequence (e.g., and achieved by the GENE WRITER™ writing the heterologous object sequence into the target site). In some embodiments, the first strand nick and the second strand nick are in an outward orientation.

In addition, the distance between the first strand nick and second strand nick may influence the extent to which one or more of: desired GENE WRITING™ DNA modifications are obtained, undesired double-strand breaks (DSBs) occur, undesired insertions occur, or undesired deletions occur. Without wishing to be bound by theory, it is thought the second strand nick benefit, the biasing of DNA repair toward incorporation of the heterologous object sequence into the target DNA, increases as the distance between the first strand nick and second strand nick decreases. However, it is thought that the risk of DSB formation also increases as the distance between the first strand nick and second strand nick decreases. Correspondingly, it is thought that the number of undesired insertions and/or deletions may increase as the distance between the first strand nick and second strand nick decreases. In some embodiments, the distance between the first strand nick and second strand nick is chosen to balance the benefit of biasing DNA repair toward incorporation of the heterologous object sequence into the target DNA and the risk of DSB formation and of undesired deletions and/or insertions. In some embodiments, a system where the first strand nick and the second strand nick are at least a threshold distance apart has an increased level of desired GENE WRITING™ modification outcomes, a decreased level of undesired deletions, and/or a decreased level of undesired insertions relative to an otherwise similar inward nick orientation system where the first nick and the second nick are less than the a threshold distance apart. In some embodiments the threshold distance(s) is given below.

In some embodiments, the first nick and the second nick are at least 20, 25, 30, 35, 40, 45, 50, 55, 60, 65, 70, 75, 80, 85, 90, 95, 100, 110, 120, 130, 140, 150, 160, 170, 180, 190, or 200 nucleotides apart. In some embodiments, the first nick and the second nick are no more than 25, 30, 35, 40, 45, 50, 55, 60, 65, 70, 75, 80, 85, 90, 95, 100, 110, 120, 130, 140, 150, 160, 170, 180, 190, 200, or 250 nucleotides apart. In some embodiments, the first nick and the second nick are 20-200, 30-200, 40-200, 50-200, 60-200, 70-200, 80-200, 90-200, 100-200, 110-200, 120-200, 130-200, 140-200, 150-200, 160-200, 170-200, 180-200, 190-200, 20-190, 30-190, 40-190, 50-190, 60-190, 70-190, 80-190, 90-190, 100-190, 110-190, 120-190, 130-190, 140-190, 150-190, 160-190, 170-190, 180-190, 20-180, 30-180, 40-180, 50-180, 60-180, 70-180, 80-180, 90-180, 100-180, 110-180, 120-180, 130-180, 140-180, 150-180, 160-180, 170-180, 20-170, 30-170, 40-170, 50-170, 60-170, 70-170, 80-170, 90-170, 100-170, 110-170, 120-170, 130-170, 140-170, 150-170, 160-170, 20-160, 30-160, 40-160, 50-160, 60-160, 70-160, 80-160, 90-160, 100-160, 110-160, 120-160, 130-160, 140-160, 150-160, 20-150, 30-150, 40-150, 50-150, 60-150, 70-150, 80-150, 90-150, 100-150, 110-150, 120-150, 130-150, 140-150, 20-140, 30-140, 40-140, 50-140, 60-140, 70-140, 80-140, 90-140, 100-140, 110-140, 120-140, 130-140, 20-130, 30-130, 40-130, 50-130, 60-130, 70-130, 80-130, 90-130, 100-130, 110-130, 120-130, 20-120, 30-120, 40-120, 50-120, 60-120, 70-120, 80-120, 90-120, 100-120, 110-120, 20-110, 30-110, 40-110, 50-110, 60-110, 70-110, 80-110, 90-110, 100-110, 20-100, 30-100, 40-100, 50-100, 60-100, 70-100, 80-100, 90-100, 20-90, 30-90, 40-90, 50-90, 60-90, 70-90, 80-90, 20-80, 30-80, 40-80, 50-80, 60-80, 70-80, 20-70, 30-70, 40-70, 50-70, 60-70, 20-60, 30-60, 40-60, 50-60, 20-50, 30-50, 40-50, 20-40, 30-40, or 20-30 nucleotides apart. In some embodiments, the first nick and the second nick are 40-100 nucleotides apart.

Without wishing to be bound by theory, it is thought that, for GENE WRITER™ systems where a second strand nick is provided and an inward nick orientation is selected, increasing the distance between the first strand nick and second strand nick may be preferred. As is described herein, an inward nick orientation may produce a higher number of DSBs than an outward nick orientation, and may result in a higher amount of undesired insertions and deletions than an outward nick orientation, but increasing the distance between the nicks may mitigate that increase in DSBs, undesired deletions, and/or undesired insertions. In some embodiments, an inward nick orientation wherein the first nick and the second nick are at least a threshold distance apart has an increased level of desired GENE WRITING™ modification outcomes, a decreased level of undesired deletions, and/or a decreased level of undesired insertions relative to an otherwise similar inward nick orientation system where the first nick and the second nick are less than the a threshold distance apart. In some embodiments the threshold distance is given below.

In some embodiments, the first strand nick and the second strand nick are in an inward orientation. In some embodiments, the first strand nick and the second strand nick are in an inward orientation and the first strand nick and second strand nick are at least 100, 110, 120, 130, 140, 150, 160, 170, 180, 190, 200, 220, 240, 260, 280, 300, 350, 400, 450, or 500 nucleotides apart, e.g., at least 100 nucleotides apart, (and optionally no more than 500, 400, 300, 200, 190, 180, 170, 160, 150, 140, 130, or 120 nucleotides apart). In some embodiments, the first strand nick and the second strand nick are in an inward orientation and the first strand nick and second strand nick are 100-200, 110-200, 120-200, 130-200, 140-200, 150-200, 160-200, 170-200, 180-200, 190-200, 100-190, 110-190, 120-190, 130-190, 140-190, 150-190, 160-190, 170-190, 180-190, 100-180, 110-180, 120-180, 130-180, 140-180, 150-180, 160-180, 170-180, 100-170, 110-170, 120-170, 130-170, 140-170, 150-170, 160-170, 100-160, 110-160, 120-160, 130-160, 140-160, 150-160, 100-150, 110-150, 120-150, 130-150, 140-150, 100-140, 110-140, 120-140, 130-140, 100-130, 110-130, 120-130, 100-120, 110-120, or 100-110 nucleotides apart.

Evolved Variants of GENE WRITER™ Genome Editor Polypeptides

In some embodiments, the invention provides evolved variants of GENE WRITER™ genome editor polypeptides. Evolved variants can, in some embodiments, be produced by mutagenizing a reference GENE WRITER™, or one of the fragments or domains comprised therein. In some embodiments, one or more of the domains (e.g., the reverse transcriptase, DNA binding (including, for example, sequence-guided DNA binding elements), RNA-binding, or endonuclease domain) is evolved. One or more of such evolved variant domains can, in some embodiments, be evolved alone or together with other domains. An evolved variant domain or domains may, in some embodiments, be combined with unevolved cognate component(s) or evolved variants of the cognate component(s), e.g., which may have been evolved in either a parallel or serial manner.

In some embodiments, the process of mutagenizing a reference GENE WRITER™, or fragment or domain thereof, comprises mutagenizing the reference Gene Writer or fragment or domain thereof. In embodiments, the mutagenesis comprises a continuous evolution method (e.g., PACE) or non-contious evolution method (e.g., PANCE), e.g., as described herein. In some embodiments, the evolved GENE WRITER™, or a fragment or domain thereof, comprises one or more amino acid variations introduced into its amino acid sequence relative to the amino acid sequence of the reference GENE WRITER™, or fragment or domain thereof. In embodiments, amino acid sequence variations may include one or more mutated residues (e.g., conservative substitutions, non-conservative substitutions, or a combination thereof) within the amino acid sequence of a reference GENE WRITER™, e.g., as a result of a change in the nucleotide sequence encoding the GENE WRITER™ that results in, e.g., a change in the codon at any particular position in the coding sequence, the deletion of one or more amino acids (e.g., a truncated protein), the insertion of one or more amino acids, or any combination of the foregoing. The evolved variant GENE WRITER™ may include variants in one or more components or domains of the GENE WRITER™ (e.g., variants introduced into a reverse transcriptase domain, endonuclease domain, DNA binding domain, RNA binding domain, or combinations thereof).

In some aspects, the invention provides GENE WRITER™ genome editor polypeptides, systems, kits, and methods using or comprising an evolved variant of a GENE WRITER™, e.g., employs an evolved variant of a GENE WRITER™ or a GENE WRITER™ produced or produceable by PACE or PANCE. In embodiments, the unevolved reference GENE WRITER™ is a GENE WRITER™ as disclosed herein.

The term "phage-assisted continuous evolution (PACE)," as used herein, generally refers to continuous evolution that employs phage as viral vectors. Examples of PACE technology have been described, for example, in International PCT Application No. PCT/US 2009/056194, filed Sep. 8, 2009, published as WO 2010/028347 on Mar. 11, 2010; International PCT Application. PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394,537, issued Jul. 19, 2016; International PCT Application, PCT/US2015/012022, filed Jan. 20, 2015, published as WO 2015/134121 on Sep. 11, 2015; U.S. Pat. No. 10,179,911, issued Jan. 15, 2019; and International PCT Application, PCT/US2016/027795, filed Apr. 15, 2016, published as WO 2016/168631 on Oct. 20, 2016, the entire contents of each of which are incorporated herein by reference.

The term "phage-assisted non-continuous evolution (PANCE)." as used herein, generally refers to non-continuous evolution that employs phage as viral vectors. Examples of PANCE technology have been described, for example, in Suzuki T. et al, Crystal structures reveal an elusive functional domain of pyrrolysyl-tRNA synthetase, Nat Chem Biol. 13 (12): 1261-1266 (2017), incorporated herein by reference in its entirety. Briefly. PANCE is a technique for rapid in vivo directed evolution using serial flask transfers of evolving selection phage (SP), which contain a gene of interest to be evolved, across fresh host cells (e.g., E. coli cells). Genes inside the host cell may be held constant while genes contained in the SP continuously evolve. Following phage growth, an aliquot of infected cells may be used to transfect a subsequent flask containing host E. coli. This process can be repeated and/or continued until the desired phenotype is evolved, e.g., for as many transfers as desired.

Methods of applying PACE and PANCE to GENE WRITER™ genome editor polypeptides may be readily appreciated by the skilled artisan by reference to, inter alia, the foregoing references. Additional exemplary methods for directing continuous evolution of genome-modifying proteins or systems, e.g., in a population of host cells, e.g., using phage particles, can be applied to generate evolved variants of GENE WRITER™ genome editor polypeptides, or fragments or subdomains thereof. Non-limiting examples of such methods are described in International PCT Application, PCT/US2009/056194, filed Sep. 8, 2009, published as WO 2010/028347 on Mar. 11, 2010; International PCT Application, PCT/US2011/066747, filed Dec. 22, 2011, published as WO 2012/088381 on Jun. 28, 2012; U.S. Pat. No. 9,023,594, issued May 5, 2015; U.S. Pat. No. 9,771,574, issued Sep. 26, 2017; U.S. Pat. No. 9,394,537, issued Jul. 19, 2016; International PCT Application. PCT/US2015/012022, filed Jan. 20, 2015, published as WO 2015/134121 on Sep. 11, 2015; U.S. Pat. No. 10,179,911, issued Jan. 15, 2019; International Application No. PCT/US2019/37216, filed Jun. 14, 2019, International Patent Publication WO 2019/023680, published Jan. 31, 2019, International PCT Application, PCT/US2016/027795, filed Apr. 15, 2016, published as WO 2016/168631 on Oct. 20, 2016, and International Patent Publication No. PCT/US2019/47996, filed Aug. 23, 2019, each of which is incorporated herein by reference in its entirety.

In some non-limiting illustrative embodiments, a method of evolution of a evolved variant GENE WRITER™, of a fragment or domain thereof, comprises: (a) contacting a population of host cells with a population of viral vectors comprising the gene of interest (the starting GENE WRITER™ or fragment or domain thereof), wherein: (1) the host cell is amenable to infection by the viral vector; (2) the host cell expresses viral genes required for the generation of viral particles; (3) the expression of at least one viral gene required for the production of an infectious viral particle is dependent on a function of the gene of interest; and/or (4) the viral vector allows for expression of the protein in the host cell, and can be replicated and packaged into a viral particle by the host cell. In some embodiments, the method comprises (b) contacting the host cells with a mutagen, using host cells with mutations that elevate mutation rate (e.g., either by carrying a mutation plasmid or some genome modification—e.g., proofing-impaired DNA polymerase, SOS genes, such as UmuC, UmuD', and/or RecA, which mutations, if plasmid-bound, may be under control of an inducible promoter), or a combination thereof. In some embodiments, the method comprises (c) incubating the population of host cells under conditions allowing for viral replication and the production of viral particles, wherein host cells are removed from the host cell population, and fresh, uninfected host cells are introduced into the population of host cells, thus replenishing the population of host cells and creating a flow of host cells. In some embodiments, the cells are incubated under conditions allowing for the gene of interest to acquire a mutation. In some embodiments, the method further comprises (d) isolating a mutated version of the viral vector, encoding an evolved gene product (e.g., an evolved variant GENE WRITER™, or fragment or domain thereof), from the population of host cells.

The skilled artisan will appreciate a variety of features employable within the above-described framework. For example, in some embodiments, the viral vector or the phage is a filamentous phage, for example, an M13 phage, e.g., an M13 selection phage. In certain embodiments, the gene required for the production of infectious viral particles is the M13 gene III (gIII). In embodiments, the phage may lack a functional gIII, but otherwise comprise gI, gII, gIV, gV, gVI, gVII, gVIII, gIX, and a gX. In some embodiments, the generation of infectious VSV particles involves the envelope protein VSV-G. Various embodiments can use different retroviral vectors, for example, Murine Leukemia Virus vectors, or Lentiviral vectors. In embodiments, the retroviral vectors can efficiently be packaged with VSV-G envelope protein, e.g., as a substitute for the native envelope protein of the virus. In some embodiments, host cells are incubated according to a suitable number of viral life cycles, e.g., at least 10, at least 20, at least 30, at least 40, at least 50, at least 100, at least 200, at least 300, at least 400, at least, 500, at least 600, at least 700, at least 800, at least 900, at least 1000, at least 1250, at least 1500, at least 1750, at least 2000, at least 2500, at least 3000, at least 4000, at least 5000, at least 7500, at least 10000, or more consecutive viral life cycles, which in on illustrative and non-limiting examples of M13 phage is 10-20 minutes per virus life cycle. Similarly, conditions can be modulated to adjust the time a host cell remains in a population of host cells, e.g., about 10, about 11, about 12, about 13, about 14, about 15, about 16, about 17, about 18, about 19, about 20, about 21, about 22, about 23, about 24, about 25, about 30, about 35, about 40, about 45, about 50, about 55, about 60, about 70, about 80, about 90, about 100, about 120, about 150, or about 180 minutes. Host cell populations can be controlled in part by density of the host cells, or, in some embodiments, the host cell density in an inflow, e.g., $10^3$ cells/ml, about $10^4$ cells/ml, about $10^5$ cells/ml, about $5 \cdot 10^5$ cells/ml, about $10^6$ cells/ml, about $5 \cdot 10^6$ cells/ml, about $10^7$ cells/ml, about $5 \cdot 10^7$ cells/ml, about $10^8$ cells/ml, about $5 \cdot 10^8$ cells/ml, about $10^9$ cells/ml, about $5 \cdot 10^9$ cells/ml, about $10^{10}$ cells/ml, or about $5 \cdot 10^{10}$ cells/ml.

Promoters

In some embodiments, one or more promoter or enhancer elements are operably linked to a nucleic acid encoding a GENE WRITER™ protein or a template nucleic acid, e.g., that controls expression of the heterologous object sequence. In certain embodiments, the one or more promoter or enhancer elements comprise cell-type or tissue specific elements. In some embodiments, the promoter or enhancer is the same or derived from the promoter or enhancer that naturally controls expression of the heterologous object sequence. For example, the ornithine transcarbomylase promoter and enhancer may be used to control expression of the ornithine transcarbomylase gene in a system or method provided by the invention for correcting ornithine transcarbomylase deficiencies. In some embodiments, a promoter for use in the invention is for a gene described in any one of Tables 27-40, e.g., which may be used with an allele of the reference gene, or, in other embodiments, with a heterologous gene. In some embodiments, the promoter is a promoter of Table 21 or a functional fragment or variant thereof.

Exemplary tissue specific promoters that are commercially available can be found, for example, at a uniform resource locator (e.g., www.invivogen.com/tissue-specificpromoters). In some embodiments, a promoter is a native promoter or a minimal promoter. e.g., which consists of a single fragment from the 5' region of a given gene. In some embodiments, a native promoter comprises a core promoter and its natural 5' UTR. In some embodiments, the 5' UTR comprises an intron. In other embodiments, these include composite promoters, which combine promoter elements of different origins or were generated by assembling a distal enhancer with a minimal promoter of the same origin.

Exemplary cell or tissue specific promoters are provided in the tables, below, and exemplary nucleic acid sequences encoding them are known in the art and can be readily accessed using a variety of resources, such as the NCBI database, including RefSeq, as well as the Eukaryotic Promoter Database (//epd.cpfl.ch//index.php).

TABLE 21

Exemplary cell or tissue-specific promoters

| Promoter | Target cells |
|---|---|
| B29 Promoter | B cells |
| CD14 Promoter | Monocytic Cells |
| CD43 Promoter | Leukocytes and platelets |
| CD45 Promoter | Hematopoeitic cells |
| CD68 promoter | macrophages |
| Desmin promoter | muscle cells |
| Elastase-1 promoter | pancreatic acinar cells |
| Endoglin promoter | endothelial cells |
| fibronectin promoter | differentiating cells, healing tissue |
| Flt-1 promoter | endothelial cells |
| GFAP promoter | Astrocytes |
| GPIIB promoter | megakaryocytes |
| ICAM-2 Promoter | Endothelial cells |
| INF-Beta promoter | Hematopoeitic cells |
| Mb promoter | muscle cells |
| Nphs1 promoter | podocytes |
| OG-2 promoter | Osteoblasts, Odonblasts |
| SP-B promoter | Lung |
| Syn1 promoter | Neurons |
| WASP promoter | Hematopoeitic cells |
| SV40/bAlb promoter | Liver |
| SV40/bAlb promoter | Liver |
| SV40/Cd3 promoter | Leukocytes and platelets |
| SV40/CD45 promoter | hematopoeitic cells |
| NSE/RU5' promoter | Mature Neurons |

TABLE 22

Additional exemplary cell or tissue-specific promoters

| Promoter | Gene Description | Gene Specificity |
|---|---|---|
| APOA2 | Apolipoprotein A-II | Hepatocytes (from hepatocyte progenitors) |
| SERPINA1 (hAAT) | Serpin peptidase inhibitor, clade A (alpha-1 antiproteinase, antitrypsin), member 1 (also named alpha 1 anti-tryps in) | Hepatocytes (from definitive endoderm stage) |
| CYP3A | Cytochrome P450, family 3, subfamily A, polypeptide | Mature Hepatocytes |
| MIR122 | MicroRNA 122 | Hepatocytes (from early stage embryonic liver cells) and endoderm |
| Pancreatic specific promoters |||
| INS | Insulin | Pancreatic beta cells (from definitive endoderm stage) |
| IRS2 | Insulin receptor substrate 2 | Pancreatic beta cells |
| Pdx1 | Pancreatic and duodenal homeobox 1 | Pancreas (from definitive endoderm stage) |

TABLE 22-continued

Additional exemplary cell or tissue-specific promoters

| Promoter | Gene Description | Gene Specificity |
|---|---|---|
| Alx3 | Aristaless-like homeobox 3 | Pancreatic beta cells (from definitive endoderm stage) |
| Ppy | Pancreatic polypeptide | PP pancreatic cells (gamma cells) |
| Cardiac specific promoters |||
| Myh6 (aMHC) | Myosin, heavy chain 6, cardiac muscle, alpha | Late differentiation marker of cardiac muscle cells (atrial specificity) |
| MYL2 (MLC-2v) | Myosin, light chain 2, regulatory, cardiac, slow | Late differentiation marker of cardiac muscle cells (ventricular specificity) |
| ITNN13 (cTnI) | Troponin I type 3 (cardiac) | Cardiomyocytes (from immature state) |
| ITNN13 (cTnI) | Troponin I type 3 (cardiac) | Cardiomyocytes (from immature state) |
| NPPA (ANF) | Natriuretic peptide precursor A (also named Atrial Natriuretic Factor) | Atrial specificity in adult cells |
| Slc8a1 (Ncx1) | Solute carrier family 8 (sodium/calcium exchanger), member 1 | Cardiomyocytes from early developmental stages |
| CNS specific promoters |||
| SYN1 (hSyn) | Synapsin I | Neurons |
| GFAP | Glial fibrillary acidic protein | Astrocytes |
| INA | Internexin neuronal intermediate filament protein, alpha (a-internexin) | Neuroprogenitors |
| NES | Nestin | Neuroprogenitors and ectoderm |
| MOBP | Myelin-associated oligodendrocyte basic protein | Oligodendrocytes |
| MBP | Myelin basic protein | Oligodendrocytes |
| TH | Tyrosine hydroxylase | Dopaminergic neurons |
| FOXA2 (HNF3 beta) | Forkhead box A2 | Dopaminergic neurons (also used as a marker of endoderm) |
| Skin specific promoters |||
| FLG | Filaggrin | Keratinocytes from granular layer |
| K14 | Keratin 14 | Keratinocytes from granular and basal layers |
| TGM3 | Transglutaminase 3 | Keratinocytes from granular layer |
| Immune cell specific promoters |||
| ITGAM (CD11B) | Integrin, alpha M (complement component 3 receptor 3 subunit) | Monocytes, macrophages, granulocytes, natural killer cells |
| Urogential cell specific promoters |||
| Pbsn | Probasin | Prostatic epithelium |
| Upk2 | Uroplakin 2 | Bladder |
| Sbp | Spermine binding protein | Prostate |
| Ferl14 | Fer-1-like 4 | Bladder |
| Endothelial cell specific promoters |||
| ENG | Endoglin | Endothelial cells |
| Pluripotent and embryonic cell specific promoters |||
| Oct4 (POU5F1) | POU class 5 homeobox 1 | Pluripotent cells (germ cells, ES cells, iPS cells) |
| NANOG | Nanog homeobox | Pluripotent cells (ES cells, iPS cells) |
| Synthetic Oct4 | Synthetic promoter based on a Oct-4 core enhancer element | Pluripotent cells (ES cells, iPS cells) |

TABLE 22-continued

Additional exemplary cell or tissue-specific promoters

| Promoter | Gene Description | Gene Specificity |
| --- | --- | --- |
| T brachyury | Brachyury | Mesoderm |
| NES | Nestin | Neuroprogenitors and Ectoderm |
| SOX17 | SRY (sex determining region Y)-box 17 | Endoderm |
| FOXA2 (HNFJ beta) | Forkhead box A2 | Endoderm (also used as a marker of dopaminergic neurons) |
| MIR122 | MicroRNA 122 | Endoderm and hepatocytes (from early stage embryonic liver cells~ |

Depending on the host/vector system utilized, any of a number of suitable transcription and translation control elements, including constitutive and inducible promoters, transcription enhancer elements, transcription terminators, etc, may be used in the expression vector (see e.g., Bitter et al. (1987) *Methods in Enzymology*, 153:516-544; incorporated herein by reference in its entirety).

In some embodiments, a nucleic acid encoding a GENE WRITER™ or template nucleic acid is operably linked to a control element, e.g., a transcriptional control element, such as a promoter. The transcriptional control element may, in some embodiment, be functional in either a eukaryotic cell, e.g., a mammalian cell; or a prokaryotic cell (e.g., bacterial or archaeal cell). In some embodiments, a nucleotide sequence encoding a polypeptide is operably linked to multiple control elements, e.g., that allow expression of the nucleotide sequence encoding the polypeptide in both pro-karyotic and eukaryotic cells.

For illustration purposes, examples of spatially restricted promoters include, but are not limited to, neuron-specific promoters, adipocyte-specific promoters, cardiomyocyte-specific promoters, smooth muscle-specific promoters, photoreceptor-specific promoters, etc. Neuron-specific spatially restricted promoters include, but are not limited to, a neuron-specific enolase (NSE) promoter (see, e.g., EMBL HSENO2, X51956); an aromatic amino acid decarboxylase (AADC) promoter, a neurofilament promoter (see, e.g., GenBank HUMNFL, L04147); a synapsin promoter (see, e.g., GenBank HUMSYNIB, M55301); a thy-1 promoter (see, e.g., Chen et al. (1987) Cell 51:7-19; and Llewellyn, et al. (2010) Nat. Med. 16 (10): 1161-1166); a serotonin receptor promoter (see, e.g., GenBank S62283); a tyrosine hydroxylase promoter (TH) (see, e.g., Oh et al. (2009) Gene Ther 16:437; Sasaoka et al. (1992) Mol. Brain Res. 16:274; Boundy et al. (1998) J. Neurosci. 18:9989; and Kaneda et al. (1991) Neuron 6:583-594); a GnRH promoter (sce, e.g., Radovick et al. (1991) Proc. Natl. Acad. Sci. USA 88:3402-3406); an L7 promoter (see, e.g., Oberdick et al. (1990) Science 248:223-226); a DNMT promoter (see, e.g., Bartge et al. (1988) Proc. Natl. Acad. Sci. USA 85:3648-3652): an enkephalin promoter (see, e.g., Comb et al. (1988) EMBO J. 17:3793-3805); a myelin basic protein (MBP) promoter; a Ca2+-calmodulin-dependent protein kinase II-alpha (CamKlla) promoter (see, e.g., Mayford et al. (1996) Proc. Natl. Acad. Sci. USA 93:13250; and Casanova et al. (2001) Genesis 31:37); a CMV enhancer/platelet-derived growth factor-β promoter (see, e.g., Liu et al. (2004) Gene Therapy 11:52-60); and the like.

Adipocyte-specific spatially restricted promoters include, but are not limited to, the aP2 gene promoter/enhancer, e.g., a region from −5.4 kb to +21 bp of a human aP2 gene (see, e.g., Tozzo et al. (1997) Endocrinol. 138:1604: Ross et al. (1990) Proc. Natl. Acad. Sci. USA 87:9590; and Pavjani et al. (2005) Nat. Med. 11:797); a glucose transporter-4 (GLUT4) promoter (see, e.g., Knight et al. (2003) Proc. Natl. Acad. Sci. USA 100:14725); a fatty acid translocase (FAT/CD36) promoter (see, e.g., Kuriki et al. (2002) Biol. Pharm. Bull. 25:1476; and Sato et al. (2002) J. Biol. Chem. 277:15703); a stearoyl-CoA desaturase-1 (SCD1) promoter (Tabor et al. (1999) J. Biol. Chem. 274:20603); a leptin promoter (see, e.g., Mason et al. (1998) Endocrinol. 139: 1013; and Chen et al. (1999) Biochem. Biophys. Res. Comm. 262:187); an adiponectin promoter (see. e.g., Kita et al. (2005) Biochem. Biophys. Res. Comm. 331:484; and Chakrabarti (2010) Endocrinol. 151:2408); an adipsin promoter (see, e.g., Platt et al. (1989) Proc. Natl. Acad, Sci. USA 86:7490); a resistin promoter (see, e.g., Seo et al. (2003) Molec. Endocrinol. 17:1522); and the like.

Cardiomyocyte-specific spatially restricted promoters include, but are not limited to, control sequences derived from the following genes: myosin light chain-2, α-myosin heavy chain, AE3, cardiac troponin C, cardiac actin, and the like. Franz et al. (1997) Cardiovasc. Res. 35:560-566: Robbins et al. (1995) Ann. N.Y. Acad. Sci. 752:492-505; Linn et al. (1995) Circ. Res. 76:584-591; Parmacek et al. (1994) Mol. Cell. Biol. 14:1870-1885; Hunter et al. (1993) Hypertension 22:608-617; and Sartorelli et al. (1992) Proc. Natl. Acad. Sci. USA 89:4047-4051.

Smooth muscle-specific spatially restricted promoters include, but are not limited to, an SM22a promoter (see, e.g., Akyürek et al. (2000) Mol. Med. 6:983; and U.S. Pat. No. 7,169,874); a smoothelin promoter (see. e.g., WO 2001/018048); an a-smooth muscle actin promoter; and the like. For example, a 0.4 kb region of the SM22a promoter, within which lie two CArG elements, has been shown to mediate vascular smooth muscle cell-specific expression (scc, e.g., Kim, et al. (1997) Mol. Cell. Biol. 17, 2266-2278: Li, et al., (1996) J. Cell Biol. 132, 849-859; and Moessler, et al. (1996) Development 122, 2415-2425).

Photoreceptor-specific spatially restricted promoters include, but are not limited to, a rhodopsin promoter; a rhodopsin kinase promoter (Young et al. (2003) Ophthalmol. Vis. Sci. 44:4076); a beta phosphodiesterase gene promoter (Nicoud et al. (2007) J. Gene Med. 9:1015); a retinitis pigmentosa gene promoter (Nicoud et al. (2007) supra); an interphotoreceptor retinoid-binding protein (IRBP) gene enhancer (Nicoud et al. (2007) supra); an IRBP gene promoter (Yokoyama et al. (1992) Exp Eye Res. 55:225); and the like.

Nonlimiting Exemplary Cells-Specific Promoters

Cell-specific promoters known in the art may be used to direct expression of a GENE WRITER™ protein, e.g . . . as described herein. Nonlimiting exemplary mammalian cell-specific promoters have been characterized and used in mice expressing Cre recombinase in a cell-specific manner. Certain nonlimiting exemplary mammalian cell-specific promoters are listed in Table 1 of U.S. Pat. No. 9,845,481, incorporated herein by reference.

In some embodiments, a cell-specific promoters is a promoter that is active in plants. Many exemplary cell-specific plant promoters are known in the art. See, e.g., U.S. Pat. Nos. 5,097,025; 5,783,393; 5,880,330; 5,981,727; 7,557,264; 6,291,666; 7,132,526; and 7,323,622; and U.S. Publication Nos. 2010/0269226; 2007/0180580; 2005/0034192; and 2005/0086712, which are incorporated by reference herein in their entireties for any purpose.

In some embodiments, a vector as described herein comprises an expression cassette. The term "expression cassette", as used herein, refers to a nucleic acid construct comprising nucleic acid elements sufficient for the expression of the nucleic acid molecule of the instant invention. Typically, an expression cassette comprises the nucleic acid molecule of the instant invention operatively linked to a promoter sequence. The term "operatively linked" refers to the association of two or more nucleic acid fragments on a single nucleic acid fragment so that the function of one is affected by the other. For example, a promoter is operatively linked with a coding sequence when it is capable of affecting the expression of that coding sequence (e.g., the coding sequence is under the transcriptional control of the promoter). Encoding sequences can be operatively linked to regulatory sequences in sense or antisense orientation. In certain embodiments, the promoter is a heterologous promoter. The term "heterologous promoter", as used herein, refers to a promoter that is not found to be operatively linked to a given encoding sequence in nature. In certain embodiments, an expression cassette may comprise additional elements, for example, an intron, an enhancer, a polyadenylation site, a woodchuck response element (WRE), and/or other elements known to affect expression levels of the encoding sequenceA "promoter" typically controls the expression of a coding sequence or functional RNA. In certain embodiments, a promoter sequence comprises proximal and more distal upstream elements and can further comprise an enhancer element. An "enhancer" can typically stimulate promoter activity and may be an innate element of the promoter or a heterologous element inserted to enhance the level or tissue-specificity of a promoter. In certain embodiments, the promoter is derived in its entirety from a native gene. In certain embodiments, the promoter is composed of different elements derived from different naturally occurring promoters. In certain embodiments, the promoter comprises a synthetic nucleotide sequence. It will be understood by those skilled in the art that different promoters will direct the expression of a gene in different tissues or cell types, or at different stages of development, or in response to different environmental conditions or to the presence or the absence of a drug or transcriptional co-factor. Ubiquitous, cell-type-specific, tissue-specific, developmental stage-specific, and conditional promoters, for example, drug-responsive promoters (e.g., tetracycline-responsive promoters) are well known to those of skill in the art. Examples of promoter include, but are not limited to, the phosphoglycerate kinase (PKG) promoter, CAG (composite of the CMV enhancer the chicken beta actin promoter (CBA) and the rabbit beta globin intron.), NSE (neuronal specific enolase), synapsin or NouN promoters, the SV40 early promoter, mouse mammary tumor virus LTR promoter: adenovirus major late promoter (Ad MLP); a herpes simplex virus (HSV) promoter, a cytomegalovirus (CMV) promoter such as the CMV immediate early promoter region (CMVIE), SFFV promoter, rous sarcoma virus (RSV) promoter, synthetic promoters, hybrid promoters, and the like. Other promoters can be of human origin or from other species, including from mice. Common promoters include, e.g., the human cytomegalovirus (CMV) immediate early gene promoter, the SV40 early promoter, the Rous sarcoma virus long terminal repeat. [beta]-actin, rat insulin promoter, the phosphoglycerate kinase promoter, the human alpha-1 antitrypsin (hAAT) promoter, the transthyretin promoter, the TBG promoter and other liver-specific promoters, the desmin promoter and similar muscle-specific promoters, the EF1-alpha promoter, the CAG promoter and other constitutive promoters, hybrid promoters with multi-tissue specificity, promoters specific for neurons like synapsin and glyceraldehyde-3-phosphate dehydrogenase promoter, all of which are promoters well known and readily available to those of skill in the art, can be used to obtain high-level expression of the coding sequence of interest. In addition, sequences derived from non-viral genes, such as the murine metallothionein gene, will also find use herein. Such promoter sequences are commercially available from, e.g., Stratagene (San Diego, CA). Additional exemplary promoter sequences are described, for example, in WO2018213786A1 (incorporated by reference herein in its entirety).

In some embodiments, the apolipoprotein E enhancer (ApoE) or a functional fragment thereof is used, e.g., to drive expression in the liver. In some embodiments, two copies of the ApoE enhancer or a functional fragment thereof is used. In some embodiments, the ApoE enhancer or functional fragment thereof is used in combination with a promoter, e.g., the human alpha-1 antitrypsin (hAAT) promoter.

In some embodiments, the regulatory sequences impart tissue-specific gene expression capabilities. In some cases, the tissue-specific regulatory sequences bind tissue-specific transcription factors that induce transcription in a tissue specific manner. Various tissue-specific regulatory sequences (e.g., promoters, enhancers, etc.) are known in the art. Exemplary tissue-specific regulatory sequences include, but are not limited to, the following tissue-specific promoters: a liver-specific thyroxin binding globulin (TBG) promoter, a insulin promoter, a glucagon promoter, a somatostatin promoter, a pancreatic polypeptide (PPY) promoter, a synapsin-1 (Syn) promoter, a creatine kinase (MCK) promoter, a mammalian desmin (DES) promote, a α-myosin heavy chain (a-MHC) promoter, or a cardiac Troponin T (cTnT) promoter. Other exemplary promoters include Beta-actin promoter, hepatitis B virus core promoter, Sandig et al., Gene Ther., 3:1002-9 (1996): alpha-fetoprotein (AFP) promoter. Arbuthnot et al., Hum. Gene Ther., 7: 1503-14 (1996)), bone osteocalcin promoter (Stein et al., Mol. Biol. Rep., 24:185, 96 (1997)): bone sialoprotein promoter (Chen et al., J. Bone Miner. Res., 11: 654-64 (1996)), CD2 promoter (Hansal et al., J. Immunol., 161:1063-8 (1998): immunoglobulin heavy chain promoter; T cell receptor α-chain promoter, neuronal such as neuron-specific enolase (NSE) promoter (Andersen et al., Cell. Mol. Neurobiol., 13:503-15 (1993)), neurofilament light-chain gene promoter (Piccioli et al., Proc. Natl. Acad. Sci. USA, 88:5611-5 (1991)), and the neuron-specific vgf gene promoter (Piccioli et al., Neuron, 15:373-84 (1995)), and others. Additional exemplary promoter sequences are described, for example, in U.S. Pat. No. 10,300,146 (incorporated herein by reference in its entirety). In some embodiments, a tissue-specific regulatory element, e.g., a tissue-specific promoter, is selected from one known to be operably linked to a gene that is highly expressed in a given tissue, e.g., as measured by RNA-seq or protein expression data, or a combination thereof. Methods for analyzing tissue specificity by expression are taught in Fagerberg et al. Mol Cell Proteomics 13 (2): 397-406 (2014), which is incorporated herein by reference in its entirety.

In some embodiments, a vector described herein is a multicistronic expression construct. Multicistronic expression constructs include, for example, constructs harboring a first expression cassette, e.g. comprising a first promoter and a first encoding nucleic acid sequence, and a second expression cassette, e.g. comprising a second promoter and a second encoding nucleic acid sequence. Such multicistronic expression constructs may, in some instances, be particularly useful in the delivery of non-translated gene products, such as hairpin RNAs, together with a polypeptide, for example, a GENE WRITER™ and GENE WRITER™ template. In some embodiments, multicistronic expression constructs may exhibit reduced expression levels of one or more of the included transgenes, for example, because of promoter interference or the presence of incompatible nucleic acid elements in close proximity. If a multicistronic expression construct is part of a viral vector, the presence of a self-complementary nucleic acid sequence may, in some instances, interfere with the formation of structures necessary for viral reproduction or packaging.

In some embodiments, the sequence encodes an RNA with a hairpin. In some embodiments, the hairpin RNA is an a guide RNA, a template RNA, shRNA, or a microRNA. In some embodiments, the first promoter is an RNA polymerase I promoter. In some embodiments, the first promoter is an RNA polymerase II promoter. In some embodiments, the second promoter is an RNA polymerase III promoter. In some embodiments, the second promoter is a U6 or H1 promoter. In some embodiments, the nucleic acid construct comprises the structure of AAV construct B1 or B2.

Without wishing to be bound by theory, multicistronic expression constructs may not achieve optimal expression levels as compared to expression systems containing only one cistron. One of the suggested causes of lower expression levels achieved with multicistronic expression constructs comprising two ore more promoter elements is the phenomenon of promoter interference (see, e.g., Curtin J A, Dane A P. Swanson A, Alexander I E, Ginn S L. *Bidirectional promoter interference between two widely used internal heterologous promoters in a late-generation lentiviral construct*. Gene Ther. 2008 March: 15 (5): 384-90; and Martin-Duque P, Jezzard S, Kaftansis L, Vassaux G. *Direct comparison of the insulating properties of two genetic elements in an adenoviral vector containing two different expression cassettes*. Hum Gene Ther. 2004 October: 15 (10): 995-1002; both references incorporated herein by reference for disclosure of promoter interference phenomenon). In some embodiments, the problem of promoter interference may be overcome, e.g., by producing multicistronic expression constructs comprising only one promoter driving transcription of multiple encoding nucleic acid sequences separated by internal ribosomal entry sites, or by separating cistrons comprising their own promoter with transcriptional insulator elements. In some embodiments, single-promoter driven expression of multiple cistrons may result in uneven expression levels of the cistrons. In some embodiments, a promoter cannot efficiently be isolated and isolation elements may not be compatible with some gene transfer vectors, for example, some retroviral vectors.

MicroRNAS miRNAs and other small interfering nucleic acids generally regulate gene expression via target RNA transcript cleavage/degradation or translational repression of the target messenger RNA (mRNA). miRNAs may, in some instances, be natively expressed, typically as final 19-25 non-translated RNA products. miRNAs generally exhibit their activity through sequence-specific interactions with the 3' untranslated regions (UTR) of target mRNAs. These endogenously expressed miRNAs may form hairpin precursors that are subsequently processed into an miRNA duplex, and further into a mature single stranded miRNA molecule. This mature miRNA generally guides a multiprotein complex, miRISC, which identifies target 3' UTR regions of target mRNAs based upon their complementarity to the mature miRNA. Useful transgene products may include, for example, miR-NAs or miRNA binding sites that regulate the expression of a linked polypeptide. A non-limiting list of miRNA genes; the products of these genes and their homologues are useful as transgenes or as targets for small interfering nucleic acids (e.g., miRNA sponges, antisense oligonucleotides), e.g., in methods such as those listed in U.S. Pat. No. 10,300,146, 22:25-25:48, incorporated by reference. In some embodiments, one or more binding sites for one or more of the foregoing miRNAs are incorporated in a transgene, e.g., a transgene delivered by a rAAV vector, e.g., to inhibit the expression of the transgene in one or more tissues of an animal harboring the transgene. In some embodiments, a binding site may be selected to control the expression of a trangene in a tissue specific manner. For example, binding sites for the liver-specific miR-122 may be incorporated into a transgene to inhibit expression of that transgene in the liver. Additional exemplary miRNA sequences are described, for example, in U.S. Pat. No. 10,300,146 (incorporated herein by reference in its entirety). For liver-specific GENE WRITING™, however, overexpression of miR-122 may be utilized instead of using binding sites to effect miR-122-specific degradation. This miRNA is positively associated with hepatic differentiation and maturation, as well as enhanced expression of liver specific genes. Thus, in some embodiments, the coding sequence for miR-122 may be added to a component of a GENE WRITING™ system to enhance a liver-directed therapy.

A miR inhibitor or miRNA inhibitor is generally an agent that blocks miRNA expression and/or processing. Examples of such agents include, but are not limited to, microRNA antagonists, microRNA specific antisense, microRNA sponges, and microRNA oligonucleotides (double stranded, hairpin, short oligonucleotides) that inhibit miRNA interaction with a Drosha complex. MicroRNA inhibitors, e.g., miRNA sponges, can be expressed in cells from transgenes (e.g., as described in Ebert, M. S. Nature Methods, Epub Aug. 12, 2007; incorporated by reference herein in its entirety). In some embodiments, microRNA sponges, or other miR inhibitors, are used with the AAVs. microRNA sponges generally specifically inhibit miRNAs through a complementary heptameric seed sequence. In some embodiments, an entire family of miRNAs can be silenced using a single sponge sequence. Other methods for silencing miRNA function (derepression of miRNA targets) in cells will be apparent to one of ordinary skill in the art.

In some embodiments, a miRNA as described herein comprises a sequence listed in Table 4 of PCT Publication No. WO2020014209, incorporated herein by reference. Also incorporated herein by reference are the listing of exemplary miRNA sequences from WO2020014209.

In some embodiments, it is advantageous to silence one or more components of a GENE WRITING™ system (e.g., mRNA encoding a GENE WRITER™ polypeptide, a GENE WRITER™ Template RNA, or a heterologous object sequence expressed from the genome after successful GENE WRITING™) in a portion of cells. In some embodiments, it is advantageous to restrict expression of a component of a GENE WRITING™ system to select cell types within a tissue of interest.

For example, it is known that in a given tissue, e.g., liver, macrophages and immune cells, e.g., Kupffer cells in the liver, may engage in uptake of a delivery vehicle for one or more components of a GENE WRITING™ system. In some embodiments, at least one binding site for at least one miRNA highly expressed in macrophages and immune cells, e.g., Kupffer cells, is included in at least one component of a GENE WRITING™ system, e.g., nucleic acid encoding a GENE WRITING™ polypeptide or a transgene. In some embodiments, a miRNA that targets the one or more binding sites is listed in a table referenced herein, e.g., miR-142, e.g., mature miRNA hsa-miR-142-5p or hsa-miR-142-3p.

In some embodiments, there may be a benefit to decreasing GENE WRITER™ levels and/or GENE WRITER™ activity in cells in which GENE WRITER™ expression or overexpression of a transgene may have a toxic effect. For example, it has been shown that delivery of a transgene overexpression cassette to dorsal root ganglion neurons may result in toxicity of a gene therapy (see Hordeaux et al Sci Transl Med 12 (569): caba9188 (2020), incorporated herein by reference in its entirety). In some embodiments, at least one miRNA binding site may be incorporated into a nucleic acid component of a GENE WRITING™ system to reduce expression of a system component in a neuron, e.g., a dorsal root ganglion neuron. In some embodiments, the at least one miRNA binding site incorporated into a nucleic acid component of a GENE WRITING™ system to reduce expression of a system component in a neuron is a binding site of miR-182, e.g., mature miRNA hsa-miR-182-5p or hsa-miR-182-3p. In some embodiments, the at least one miRNA binding site incorporated into a nucleic acid component of a GENE WRITING™ system to reduce expression of a system component in a neuron is a binding site of miR-183, e.g., mature miRNA hsa-miR-183-5p or hsa-miR-183-3p. In some embodiments, combinations of miRNA binding sites may be used to enhance the restriction of expression of one or more components of a GENE WRITING™ system to a tissue or cell type of interest.

Table 23 below below provides exemplary miRNAs and corresponding expressing cells, e.g., a miRNA for which one can, in some embodiments, incorporate binding sites (complementary sequences) in the transgene or polypeptide nucleic acid, e.g., to decrease expression in that off-target cell.

TABLE 23

Exemplary miRNA from off-target cells and tissues

| Silenced cell type | miRNA name | Mature miRNA | miRNA sequence | SEQ ID NO: |
|---|---|---|---|---|
| Kupffer cells | miR-142 | hsa-miR-142-5p | cauaaaguaga aagcacuacu | 3567 |
| Kupffer cells | miR-142 | hsa-miR-142-3p | uguaguguuuc cuacuuuaugga | 1684 |
| Dorsal root ganglion neurons | miR-182 | hsa-miR-182-5p | uuuggcaauggu agaacucacacu | 3568 |
| Dorsal root ganglion neurons | miR-182 | hsa-miR-182-3p | ugguucuagacu ugccaacua | 3569 |
| Dorsal root ganglion neurons | miR-183 | hsa-miR-183-5p | uauggcacuggu agaauucacu | 3570 |

TABLE 23-continued

Exemplary miRNA from off-target cells and tissues

| Silenced cell type | miRNA name | Mature miRNA | miRNA sequence | SEQ ID NO: |
|---|---|---|---|---|
| Dorsal root ganglion neurons | miR-183 | hsa-miR-183-3p | gugaauuaccga agggccauaa | 3571 |
| Hepatocytes | miR-122 | hsa-miR-122-5p | uggagugugaca augguguuug | 3572 |
| Hepatocytes | miR-122 | hsa-miR-122-3p | aacgccauuauc acacuaaaua | 3573 |

Anticrispr Systems for Regulating GeneWriter Activity

Various approaches for modulating Cas molecule activity may be used in conjunction with the systems and methods described herein. For instance, in some embodiments, a polypeptide described herein (e.g., a Cas molecule or a GeneWriter comprising a Cas domain) can be regulated using an anticrispr agent (e.g., an anticrispr protein or anticrispr small molecule). In some embodiments, the Cas molecule or Cas domain comprises a responsive intein such as, for example, a 4-hydroxytamoxifen (4-HT)-responsive intein, an iCas molecule (e.g., iCas9); a 4-HT-responsive Cas (e.g., allosterically regulated Cas9 (arC9) or dead Cas9 (dC9)). The systems and methods described herein can also utilize a chemically-induced dimerization system of split protein fragments (e.g., rapamycin-mediated dimerization of FK506 binding protein 12 (FKBP) and FKBP rapamycin binding domain (FRB), an abscisic acid-inducible ABI-PYLI and gibberellin-inducible GID1-GAI heterodimerization domains); a dimer of BCL-xL peptide and BH3 peptides, a A385358 (A3) small molecule, a degron system (e.g., a FKBP-Cas9 destabilized system, an auxin-inducible degron (AID) or an E.coliDHFR degron system), an aptamer or aptazyme fused with gRNA (e.g., tetracycline- and theophylline-responsive bioswitches), AcrIIA2 and AcrIIA4 proteins, and BRD0539.

In some embodiments, a small molecule-responsive intein (e.g., 4-hydroxytamoxifen (4-HT)-responsive intein) is inserted at specific sites within a Cas molecule (e.g., Cas9). In some embodiments, the insertion of a 4HT-responsive intein disrupts Cas9 enzymatic activity. In some embodiments, a Cas molecule (e.g., iCas9) is fused to the hormone binding domain of the estrogen receptor (ERT2). In some embodiments, the ligand binding domain of the human estrogen receptor-α can be inserted into a Cas molecule (e.g., Cas9 or dead Cas9 (dC9)), e.g., at position 231, yielding a 4HT-responsive anticrispr Cas9 (e.g., arC9 or dC9). In some embodiments, dCas9 can provide 4-HT dose-dependent repression of Cas9 function. In some embodiments, arC9 can provide 4-HT dose-dependent control of Cas9 function. In some embodiments, a Cas molecule (e.g., Cas9) is fused to split protein fragments. In some embodiments, chemically-induced dimerization of split protein fragments (e.g., rapamycin-mediated dimerization of FK506 binding protein 12 (FKBP) and FKBP rapamycin binding domain (FRB)) can induce low levels of Cas9 molecule activity. In some embodiments, a chemically-induced dimerization system (e.g., abscisic acid-inducible ABI-PYLI and gibberellin-inducible GID1-GAI heterodimerization domains) can induce a dose-dependent and reversible transcriptional activation/repression of Cas9. In some embodiments, a Cas9 inducible system (ciCas9) comprises the replacement of a Cas molecule (e.g., Cas9) REC2 domain with a BCL-x1 peptide and attachment of a BH3 peptide to the N- and C-termini of the modified Cas9.BCL. In some embodiments, the interaction between BCL-XL and BH3 peptides can keep Cas9 in an inactive state. In some embodiments, a small molecule (e.g., A-385358 (A3)) can disrupt the interaction between BLC-xl and BH3 peptides to activate Cas9. In some embodiments, a Cas9 inducible system can exhibit dose-dependent control of nuclease activity.

In some embodiments, a degron system can induce degradation of a Cas molecule (e.g., Cas9) upon activation or deactivation by an external factor (e.g., small-molecule ligand, light, temperature, or a protein). In some embodiments, a small molecule BRD0539 inhibits a Cas molecule (e.g., Cas9) reversibly. Additional information on anticrispr proteins or anticrispr small molecules can be found, for example, in Gangopadhyay, S. A. et al. Precision control of CRISPR-Cas9 using small molecules and light, Biochemistry, 2019, Maji, B. et al. A high-throughput platform to identify small molecule inhibitors of CRISPR-Cas9, and Pawluk Anti-*CRISPR: discovery, mechanism and function Nature Reviews Microbiology* volume 16, pages 12-17 (2018), each of which is incorporated by reference in its entirety.

Self-Inactivating Modules for Regulating GeneWriter Activity

In some embodiments the GENE WRITER™ systems described herein includes a self-inactivating module. The self-inactivating module leads to a decrease of expression of the GENE WRITER™ polypeptide, the GENE WRITER™ template, or both. Without wishing to be bound by the theory, the self-inactivating module provides for a temporary period of GENE WRITER™ expression prior to inactivation. Without wishing to be bound by theory, the activity of the GENE WRITER™ polypeptide at a target site introduces a mutation (e.g. a substitution, insertion, or deletion) into the DNA encoding the GENE WRITER™ polypeptide or GENE WRITER™ template which results in a decrease of GENE WRITER™ polypeptide or template expression. In some embodiments of the self-inactivating module, a target site for the GENE WRITER™ polypeptide is included in the DNA encoding the GENE WRITER™ polypeptide or GENE WRITER™ template. In some embodiments, one, two, three, four, five, or more copies of the target site are included in the DNA encoding the GENE WRITER™ polypeptide or GENE WRITER™ template. In some embodiments, the target site in the DNA encoding the GENE WRITER™ polypeptide or GENE WRITER™ template is the same target site as the target site on the genome. In some embodiments, the target site is a different target site than the target site on the genome. In some embodiments, the self-inactivation module target site uses the same or a different template RNA or guide RNA as the genome target site. In some embodiments, the target site is modified via target primed reverse transcription based upon a template RNA. In some embodiments the target side is nicked. The target site may be incorporated into an enhancer, a promoter, an untranslated region, an exon, an intron, an open reading frame, or a stuffer sequence.

In some embodiments, upon inactivation, the decrease of expression is 25%, 50%, 60%, 70%, 80%, 90%, 95%, 99%, 99.9%, or more lower than a GENE WRITING™ system that does not contain the self-inactivating module. In some embodiments, a GENE WRITER™ system that contains the self-inactivating module has a 5%, 10%, 15%, 20%, 25%, 30%, 40%, 50%, 60%, 70%, 80%, 90%, 95% 99%, or higher rate of integrations in target sites than off-target sites compared to a GENE WRITING™ system that does not contain the self-inactivation module, a GENE WRITER™ system that contains the self-inactivating module has a 10%, 15%, 20%, 25%, 30%, 40%, 50%, 60%, 70%, 80%, 90%, 95% 99%, or higher efficiency of target site modification compared to a GENE WRITING™ system that does not contain the self-inactivation module. In some embodiments, the self-inactivating module is included when the GENE WRITER™ polypeptide is delivered as DNA, e.g. via a viral vector.

Self-inactivating modules have been described for nucleases. See, e.g. in Li et al A Self-Deleting AAV-CRISPR System for In Vivo Genome Editing, *Mol Ther Methods Clin Dev.* 2019 Mar. 15; 12:111-122, P. Singhal, Self-Inactivating Cas9: a method for reducing exposure while maintaining efficacy in virally delivered Cas9 applications (available at www.editasmedicine.com/wp-content/uploads/2019/10/aef_asgct_poster_2017_final_-_present_5-11-17_515pm1_1494537387_1494558495_1497467403.pdf), and Epstein and Schaffer Engineering a Self-Inactivating CRISPR System for AAV Vectors Targeted Genome Editing I|Volume 24, SUPPLEMENT 1, S50, May 1, 2016, and WO2018106693A1.

Small Molecules

In some embodiments a polypeptide described herein (e.g., a GENE WRITER™ polypeptide) is controllable via a small molecule. In some embodiments the polypeptide is dimerized via a small molecule.

In some embodiment, the polypeptide is controllable via Chemical Induction of Dimerization (CID) with small molecules. CID is generally used to generate switches of protein function to alter cell physiology. An exemplary high specificity, efficient dimerizer is rimiducid (AP1903), which has two identical, protein-binding surfaces arranged tail-to-tail, each with high affinity and specificity for a mutant of FKBP12:FKBP12 (F36V) (FKBP12v36, $F_{V36}$ or $F_v$), Attachment of one or more $F_V$ domains onto one or more cell signaling molecules that normally rely on homodimerization can convert that protein to rimiducid control. Homodimerization with rimiducid is used in the context of an inducible caspase safety switch. This molecular switch that is controlled by a distinct dimerizer ligand, based on the heterodimerizing small molecule, rapamycin, or rapamycin analogs ("rapalogs"). Rapamycin binds to FKBP12, and its variants, and can induce heterodimerization of signaling domains that are fused to FKBP12 by binding to both FKBP12 and to polypeptides that contain the FKBP-rapamycin-binding (FRB) domain of mTOR. Provided in some embodiments of the present application are molecular switches that greatly augment the use of rapamycin, rapalogs and rimiducid as agents for therapeutic applications.

In some embodiments of the dual switch technology, a homodimerizer, such as AP1903 (rimiducid), directly induces dimerization or multimerization of polypeptides comprising an FKBP12 multimerizing region. In other embodiments, a polypeptide comprising an FKBP12 multimerization is multimerized, or aggregated by binding to a heterodimerizer, such as rapamycin or a rapalog, which also binds to an FRB or FRB variant multimerizing region on a chimeric polypeptide, also expressed in the modified cell, such as, for example, a chimeric antigen receptor. Rapamycin is a natural product macrolide that binds with high affinity (<1 nM) to FKBP12 and together initiates the high-affinity, inhibitory interaction with the FKBP-Rapamycin-Binding (FRB) domain of mTOR. FRB is small (89 amino acids) and can thereby be used as a protein "tag" or "handle" when appended to many proteins. Coexpression of a FRB-fused protein with a FKBP12-fused protein renders their approximation rapamycin-inducible (12-16). This can serve as the basis for a cell safety switch regulated by the orally available ligand, rapamycin, or derivatives of rapamycin (rapalogs) that do not inhibit mTOR at a low, therapeutic dose but instead bind with selected, Caspase-9-fused mutant FRB domains. (see Sabatini D M, et al., Cell. 1994; 78 (1): 35-43; Brown E J. et al., Nature. 1994; 369 (6483): 756-8; Chen J, et al., Proc Natl Acad Sci USA. 1995; 92 (11): 4947-51; and Choi J. Science. 1996; 273 (5272): 239-42).

In some embodiments, two levels of control are provided in the therapeutic cells. In embodiments, the first level of control may be tunable, i.e., the level of removal of the therapeutic cells may be controlled so that it results in partial removal of the therapeutic cells. In some embodiments, the chimeric antigen polypeptide comprises a binding site for rapamycin, or a rapamycin analog. In embodiments, also present in the therapeutic cell is a suicide gene, such as, for example, one encoding a caspase polypeptide. Using this controllable first level, the need for continued therapy may, in some embodiments, be balanced with the need to eliminate or reduce the level of negative side effects. In some embodiments, a rapamycin analog, a rapalog is administered to the patient, which then binds to both the caspase polypeptide and the chimeric antigen receptor, thus recruiting the caspase polypeptide to the location, and aggregating the caspase polypeptide. Upon aggregation, the caspase polypeptide induces apoptosis. The amount of rapamycin or rapamycin analog administered to the patient may vary; if the removal of a lower level of cells by apoptosis is desired, a lower level of rapamycin or rapamycin may be administered to the patient. In some embodiments, the second level of control may be designed to achieve the maximum level of cell elimination. This second level may be based, for example, on the use of rimiducid, or AP1903. If there is a need to rapidly eliminate up to 100% of the therapeutic cells, the AP1903 may be administered to the patient. The multimeric AP1903 binds to the caspase polypeptide, leading to multimerization of the caspase polypeptide and apoptosis. In certain examples, second level may also be tunable, or controlled, by the level of AP1903 administered to the subject.

In certain embodiments, small molecules can be used to control genes, as described in for example, U.S. Pat. No. 10,584,351 at 47:53-56:47 (incorporated by reference herein in its entirety), together suitable ligands for the control features, e.g., in U.S. Pat. No. 10,584,351 at 56:48, et seq. as well as U10046049 at 43:27-52:20, incorporated by reference as well as the description of ligands for such control systems at 52:21, et seq.

Resolution of GENE WRITING™ Events

After writing of the template nucleic acid into the target site, additional activities may be performed to increase the overall efficiency of incorporation. In some embodiments, a nick may be initiated in the genome on the non-written DNA strand to encourage copying of the newly written DNA onto the second strand. In some embodiments, the nick may be within at least 10, 20, 30, 40, 50, 60, 70 80, 90, or 100 bases of the target site. In some embodiments, this second nick is performed by the same polypeptide performing the writing. In other embodiments, the second nick may be performed by an additional polypeptide encoding nickase activity, e.g. a Cas9 nickase.

For some GENE WRITER™ systems, the writing process may leave a 3' flap containing the newly written DNA that must displace the flanking target sequence to anneal to the second genomic strand to complete the edit. In some embodiments, the 3' flap is designed to have enhanced strand invasion capability. In some embodiments, 5'-3' exonuclease activity is supplemented to chew back the exposed 5' end of the displaced strand. In some embodiments, DNA ligase activity is supplemented to complete the reaction. In some embodiments, the exonuclease and/or ligase activities are optionally provided on the GENE WRITER™ polypeptide. In some embodiments, the exonuclease and/or ligase activities are optionally provided separately from the GENE WRITER™ polypeptide.

Based on the published mechanism of non-LTR retrotransposons, GENE WRITING™ systems derived therefrom may not require supplementation of additional functions for resolution of the writing event. In some embodiments, the system may result in complete writing without requiring endogenous host factors. In some embodiments, the system may result in complete writing without the need for DNA repair. In some embodiments, the system may result in complete writing without eliciting a DNA damage response.

Chemically Modified Nucleic Acids and Nucleic Acid End Features

A nucleic acid described herein (e.g., a template nucleic acid, e.g., a template RNA; or a nucleic acid (e.g., mRNA) encoding a GENE WRITER™; or a gRNA) can comprise unmodified or modified nucleobases. Naturally occurring RNAs are synthesized from four basic ribonucleotides: ATP, CTP, UTP and GTP, but may contain post-transcriptionally modified nucleotides. Further, approximately one hundred different nucleoside modifications have been identified in RNA (Rozenski, J, Crain, P, and McCloskey, J. (1999). The RNA Modification Database: 1999 update. Nucl Acids Res 27:196-197). An RNA can also comprise wholly synthetic nucleotides that do not occur in nature.

In some embodiments, the chemically modification is one provided in PCT/US2016/032454, US Pat. Pub. No. 20090286852, of International Application No. WO/2012/019168, WO/2012/045075, WO/2012/135805, WO/2012/158736, WO/2013/039857, WO/2013/039861, WO/2013/052523, WO/2013/090648, WO/2013/096709, WO/2013/101690, WO/2013/106496, WO/2013/130161, WO/2013/151669, WO/2013/151736, WO/2013/151672, WO/2013/151664, WO/2013/151665, WO/2013/151668, WO/2013/151671, WO/2013/151667, WO/2013/151670, WO/2013/151666, WO/2013/151663, WO/2014/028429, WO/2014/081507, WO/2014/093924, WO/2014/093574, WO/2014/113089, WO/2014/144711, WO/2014/144767, WO/2014/144039, WO/2014/152540, WO/2014/152030, WO/2014/152031, WO/2014/152027, WO/2014/152211, WO/2014/158795, WO/2014/159813, WO/2014/164253, WO/2015/006747, WO/2015/034928, WO/2015/034925, WO/2015/038892, WO/2015/048744, WO/2015/051214, WO/2015/051173, WO/2015/051169, WO/2015/058069, WO/2015/085318, WO/2015/089511, WO/2015/105926, WO/2015/164674, WO/2015/196130, WO/2015/196128, WO/2015/196118, WO/2016/011226, WO/2016/011222, WO/2016/011306, WO/2016/014846, WO/2016/022914, WO/2016/036902, WO/2016/077125, or WO/2016/077123, each of which is herein incorporated by reference in its entirety. It is understood that incorporation of a chemically modified nucleotide into a polynucleotide can result in the modification being incorporated into a nucleobase, the backbone, or both, depending on the location of the modification in the nucleotide. In some embodiments, the backbone modification is one provided in EP 2813570, which is herein incorporated by reference in its entirety. In some embodiments, the modified cap is one provided in US Pat. Pub. No. 20050287539, which is herein incorporated by reference in its entirety.

In some embodiments, the chemically modified nucleic acid (e.g., RNA, e.g., mRNA) comprises one or more of ARCA: anti-reverse cap analog (m27.3'-OGP3G), GP3G (Unmethylated Cap Analog), m7GP3G (Monomethylated Cap Analog), m32.2.7GP3G (Trimethylated Cap Analog), m5CTP (5'-methyl-cytidine triphosphate), m6ATP (N6-methyl-adenosine-5'-triphosphate), s2UTP (2-thio-uridine triphosphate), and Ψ (pseudouridine triphosphate).

In some embodiments, the chemically modified nucleic acid comprises a 5' cap, e.g.: a 7-methylguanosine cap (e.g., a O-Me-m7G cap); a hypermethylated cap analog; an NAD+-derived cap analog (e.g., as described in Kiledjian, Trends in Cell Biology 28, 454-464 (2018)); or a modified, e.g., biotinylated, cap analog (e.g., as described in Bednarek et al., Phil Trans R Soc B 373, 20180167 (2018)).

In some embodiments, the chemically modified nucleic acid comprises a 3' feature selected from one or more of: a polyA tail; a 16-nucleotide long stem-loop structure flanked by unpaired 5 nucleotides (e.g., as described by Mannironi et al., Nucleic Acid Research 17, 9113-9126 (1989)); a triple-helical structure (e.g., as described by Brown et al., PNAS 109, 19202-19207 (2012)); a tRNA, Y RNA, or vault RNA structure (e.g., as described by Labno et al., Biochemica et Biophysica Acta 1863, 3125-3147 (2016)); incorporation of one or more deoxyribonucleotide triphosphates (dNTPs), 2'O-Methylated NTPs, or phosphorothioate-NTPs; a single nucleotide chemical modification (e.g., oxidation of the 3' terminal ribose to a reactive aldehyde followed by conjugation of the aldehyde-reactive modified nucleotide); or chemical ligation to another nucleic acid molecule.

In some embodiments, the the nucleic acid (e.g., template nucleic acid) comprises one or more modified nucleotides, e.g., selected from dihydrouridine, inosine, 7-methylguanosine, 5-methylcytidine (5mC), 5' Phosphate ribothymidine, 2'-O-methyl ribothymidine, 2'-O-ethyl ribothymidine, 2'-fluoro ribothymidine, C-5 propynyl-deoxycytidine (pdC), C-5 propynyl-deoxyuridine (pdU), C-5 propynyl-cytidine (pC), C-5 propynyl-uridine (PU), 5-methyl cytidine, 5-methyl uridine, 5-methyl deoxycytidine, 5-methyl deoxyuridine methoxy, 2,6-diaminopurine, 5'-Dimethoxytrityl-N4-ethyl-2'-deoxycytidine, C-5 propynyl-f-cytidine (pfC), C-5 propynyl-f-uridine (pfU), 5-methyl f-cytidine, 5-methyl f-uridine, C-5 propynyl-m-cytidine (pmC), C-5 propynyl-f-uridine (pmU), 5-methyl m-cytidine, 5-methyl m-uridine, LNA (locked nucleic acid), MGB (minor groove binder) pseudouridine (Y), 1-N-methylpseudouridine (1-Me-Ψ), or 5-methoxyuridine (5-MO-U).

In some embodiments, the nucleic acid comprises a backbone modification, e.g., a modification to a sugar or phosphate group in the backbone. In some embodiments, the nucleic acid comprises a nucleobase modification.

In some embodiments, the nucleic acid comprises one or more chemically modified nucleotides of Table 24, one or more chemical backbone modifications of Table 25, one or more chemically modified caps of Table 25. For instance, in some embodiments, the nucleic acid comprises two or more (e.g., 3, 4, 5, 6, 7, 8, 9, or 10 or more) different types of chemical modifications. As an example, the nucleic acid may comprise two or more (e.g., 3, 4, 5, 6, 7, 8, 9, or 10 or more) different types of modified nucleobases, e.g., as described herein, e.g., in Table 24. Alternatively or in combination, the nucleic acid may comprise two or more (e.g., 3, 4, 5, 6, 7, 8, 9, or 10 or more) different types of backbone modifications, e.g., as described herein, e.g., in Table 25. Alternatively or in combination, the nucleic acid may comprise one or more modified cap, e.g., as described herein, e.g., in Table 26. For instance, in some embodiments, the nucleic acid comprises one or more type of modified nucleobase and one or more type of backbone modification; one or more type of modified nucleobase and one or more modified cap; one or more type of modified cap and one or more type of backbone modification; or one or more type of modified nucleobase, one or more type of backbone modification, and one or more type of modified cap.

In some embodiments, the nucleic acid comprises one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) modified nucleobases. In some embodiments, all nucleobases of the nucleic acid are modified. In some embodiments, the nucleic acid is modified at one or more (e.g., 2, 3, 4, 5, 6, 7, 8, 9, 10, 20, 30, 40, 50, 60, 70, 80, 90, 100, 150, 200, 250, 300, 350, 400, 450, 500, 600, 700, 800, 900, 1000, or more) positions in the backbone. In some embodiments, all backbone positions of the nucleic acid are modified.

TABLE 24

| Modified nucleotides | |
|---|---|
| 5-aza-uridine | N2-methyl-6-thio-guanosine |
| 2-thio-5-aza-midine | N2,N2-dimethyl-6-thio-guanosine |
| 2-thiouridine | pyridin-4-one ribonucleoside |
| 4-thio-pseudouridine | 2-thio-5-aza-uridine |
| 2-thio-pseudouridine | 2-thiomidine |
| 5-hydroxyuridine | 4-thio-pseudomidine |
| 3-methyluridine | 2-thio-pseudowidine |
| 5-carboxymethyl-uridine | 3-methylmidine |
| 1-carboxymethyl-pseudouridine | 1-propynyl-pseudomidine |
| 5-propynyl-uridine | 1-methyl-1-deaza-pseudomidine |
| 1-propynyl-pseudouridine | 2-thio-1-methyl-1-deaza-pseudouridine |
| 5-taurinomethyluridine | |
| 1-taurinomethyl-pseudouridine | 4-methoxy-pseudomidine |
| 5-taurinomethyl-2-thio-uridine | 5'-O-(1-Thiophosphate)-Adenosine |
| 1-taurinomethyl-4-thio-uridine | 5'-O-(1-Thiophosphate)-Cytidine |
| 5-methyl-uridine | 5'-O-(1-thiophosphate)-Guanosine |
| 1-methyl-pseudouridine | 5'-O-(1-Thiophophate)-Uridine |
| 4-thio-1-methyl-pseudouridine | 5'-O-(1-Thiophosphate)-Pseudouridine |
| 2-thio-1-methyl-pseudouridine | |
| 1-methyl-1-deaza-pseudouridine | 2'-O-methyl-Adenosine |
| 2-thio-1-methyl-1-deaza-pseudomidine | 2'-O-methyl-Cytidine |
| dihydrouridine | 2'-O-methyl-Guanosine |
| dihydropseudouridine | 2'-O-methyl-Uridine |
| 2-thio-dihydromidine | 2'-O-methyl-Pseudouridine |
| 2-thio-dihydropseudouridine | 2'-O-methyl-Inosine |
| 2-methoxyuridine | 2-methyladenosine |
| 2-methoxy-4-thio-uridine | 2-methylthio-N6-methyladenosine |
| 4-methoxy-pseudouridine | 2-methylthio-N6 isopentenyladenosine |
| 4-methoxy-2-thio-pseudouridine | 2-methylthio-N6-(cis-hydroxyisopentenyl)adenosine |
| 5-aza-cytidine | |
| pseudoisocytidine | N6-methyl-N6-threonylcarbamoyladenosine |
| 3-methyl-cytidine | |
| N4-acetylcytidine | N6-hydroxynorvalylcarbamoyladenosine |
| 5-formylcytidine | |
| N4-methylcytidine | 2-methylthio-N6-hydroxynorvalyl carbamoyladenosine |
| 5-hydroxymethylcytidine | |
| 1-methyl-pseudoisocytidine | 2'-O-ribosyladenosine (phosphate) |
| pyrrolo-cytidine | 1,2'-O-dimethylinosine |
| pyrrolo-pseudoisocytidine | 5,2'-O-dimethylcytidine |
| 2-thio-cytidine | N4-acetyl-2'-O-methylcytidine |
| 2-thio-5-methyl-cytidine | Lysidine |
| 4-thio-pseudoisocytidine | 7-methylguanosine |
| 4-thio-1-methyl-pseudoisocytidine | N2,2'-O-dimethylguanosine |
| 4-thio-1-methyl-1-deaza- | N2,N2,2'-O-trimethylguanosine |

TABLE 24-continued

Modified nucleotides

| | |
|---|---|
| pseudoisocytidine | 2'-O-ribosylguanosine (phosphate) |
| 1-methyl-1-deaza-pseudoisocytidine | Wybutosine |
| zebularine | Peroxywybutosine |
| | Hydroxywybutosine |
| 5-aza-zebularine | undermodified hydroxywybutosine |
| 5-methyl-zebularine | methylwyosine |
| 5-aza-2-thio-zebularine | queuosine |
| 2-thio-zebularine | epoxyqueuosine |
| 2-methoxy-cytidine | galactosyl-queuosine |
| 2-methoxy-5-methyl-cytidine | mannosyl-queuosine |
| 4-methoxy-pseudoisocytidine | 7-cyano-7-deazaguanosine |
| 4-methoxy-l-methyl-pseudoisocytidine | 7-aminomethyl-7-deazaguanosine archaeosine |
| 2-aminopurine | 5,2'-O-dimethyluridine |
| 2,6-diaminopurine | 4-thiouridine |
| 7-deaza-adenine | 5-methyl-2-thiouridine |
| 7-deaza-8-aza-adenine | 2-thio-2'-O-methyluridine |
| 7-deaza-2-aminopurine | 3-(3-amino-3-carboxypropyl)uridine |
| 7-deaza-8-aza-2-aminopurine | 5-methoxyuridine |
| 7-deaza-2,6-diaminopurine | uridine 5-oxyacetic acid |
| 7-deaza-8-aza-2,6-diaminopurine | uridine 5-oxyacetic acid methyl ester |
| 1-methyladenosine | |
| N6-isopentenyladenosine | 5-(carboxyhydroxymethyl)uridine) |
| N6-(cis-)adenosine hydroxyisopentenyl | 5-(carboxyhydroxymethyl)uridine methyl ester |
| 2-methylthio-N6-(cis-hydroxyisopentenyl) adenosine | 5-methoxycarbonylmethyluridine |
| | 5-methoxycarbonylmethyl-2'-O-methyluridine |
| N6-glycinylcarbamoyladenosine | 5-methoxycarbonylmethyl-2-thiouridine |
| N6-threonylcarbamoyladenosine | |
| 2-methylthio-N6-threonyl carbamoyladenosine | 5-aminomethyl-2-thiouridine |
| | 5-methylaminomethyluridine |
| N6,N6-dimethyladenosine | 5-methylaminomethyl-2-thiouridine |
| 7-methyladenine | 5-methylaminomethyl-2-selenouridine |
| 2-methylthio-adenine | |
| 2-methoxy-adenine | 5-carbamoylmethyluridine |
| inosine | 5-carbamoylmethyl-2'-O-methyluridine |
| 1-methyl-inosine | |
| wyosine | 5-carboxymethylaminomethyluridine |
| wybutosine | |
| 7-deaza-guanosine | 5-carboxymethylaminomethyl-2'-O-methyluridine |
| 7-deaza-8-aza-guanosine | |
| 6-thio-guanosine | 5-carboxymethylaminomethyl-2-thiouridine |
| 6-thio-7-deaza-guanosine | |
| 6-thio-7-deaza-8-aza-guanosine | N4,2'-O-dimethylcytidine |
| 7-methyl-guanosine | 5-carboxymethyluridine |
| 6-thio-7-methyl-guanosine | N6,2'-O-dimethyladenosine |
| 7-methylinosine | N,N6,O-2'-trimethyladenosine |
| 6-methoxy-guanosine | N2,7-dimethylguanosine |
| 1-methylguanosine | N2,N2,7-trimethylguanosine |
| N2-methylguanosine | 3,2'-O-dimethyluridine |
| N2,N2-dimethylguanosine | 5-methyldihydrouridine |
| 8-oxo-guanosine | 5-formyl-2'-O-methylcytidine |
| 7-methyl-8-oxo-guanosine | 1,2'-O-dimethylguanosine |
| 1-methyl-6-thio-guanosine | 4-demethylwyosine |
| | Isowyosine |
| | N6-acetyladenosine |

TABLE 25

Backbone modifications

| |
|---|
| 2'-O-Methyl backbone |
| Peptide Nucleic Acid (PNA) backbone |
| phosphorothioate backbone |
| morpholino backbone |
| carbamate backbone |
| siloxane backbone |
| sulfide backbone |
| sulfoxide backbone |
| sulfone backbone |
| formacetyl backbone |
| thioformacetyl backbone |
| methyleneformacetyl backbone |
| riboacetyl backbone |

TABLE 25-continued

Backbone modifications

| |
|---|
| alkene containing backbone |
| sulfamate backbone |
| sulfonate backbone |
| sulfonamide backbone |
| methyleneimino backbone |
| methylenehydrazino backbone |
| amide backbone |

TABLE 26

Modified caps

| |
|---|
| m7GpppA |
| m7GpppC |
| m2,7GpppG |
| m2,2,7GpppG |
| m7Gpppm7G |
| m7,2'OmeGpppG |
| m72'dGpppG |
| m7,3'OmeGpppG |
| m7,3'dGpppG |
| GppppG |
| m7GppppG |
| m7GppppA |
| m7GppppC |
| m2,7GppppG |
| m2,2,7GppppG |
| m7Gppppm7G |
| m7,2'OmeGppppG |
| m72'dGppppG |
| m7,3'OmeGppppG |
| m7,3'dGppppG |

Production of Compositions and Systems

As will be appreciated by one of skill, methods of designing and constructing nucleic acid constructs and proteins or polypeptides (such as the systems, constructs and polypeptides described herein) are routine in the art. Generally, recombinant methods may be used. Sec, in general, Smales & James (Eds.), *Therapeutic Proteins: Methods and Protocols* (Methods in Molecular Biology), Humana Press (2005); and Crommelin, Sindelar & Meibohm (Eds.), *Pharmaceutical Biotechnology: Fundamentals and Applications*, Springer (2013). Methods of designing, preparing, evaluating, purifying and manipulating nucleic acid compositions are described in Green and Sambrook (Eds.), *Molecular Cloning: A Laboratory Manual* (Fourth Edition), Cold Spring Harbor Laboratory Press (2012).

The disclosure provides, in part, a nucleic acid, e.g., vector, encoding a GENE WRITER™ polypeptide described herein, a template nucleic acid described herein, or both. In some embodiments, a vector comprises a selective marker, e.g., an antibiotic resistance marker. In some embodiments, the antibiotic resistance marker is a kanamycin resistance marker. In some embodiments, the antibiotic resistance marker does not confer resistance to beta-lactam antibiotics. In some embodiments, the vector does not comprise an ampicillin resistance marker. In some embodiments, the vector comprises a kanamycin resistance marker and does not comprise an ampicillin resistance marker. In some embodiments, a vector encoding a GENE WRITER™ polypeptide is integrated into a target cell genome (e.g., upon administration to a target cell, tissue, organ, or subject). In some embodiments, a vector encoding a GENE WRITER™ polypeptide is not integrated into a target cell genome (e.g., upon administration to a target cell, tissue, organ, or subject). In some embodiments, a vector encoding a template nucleic acid (e.g., template RNA) is not integrated into a target cell genome (e.g., upon administration to a target cell, tissue, organ, or subject). In some embodiments, if a vector is integrated into a target site in a target cell genome, the selective marker is not integrated into the genome. In some embodiments, if a vector is integrated into a target site in a target cell genome, genes or sequences involved in vector maintenance (e.g., plasmid maintenance genes) are not integrated into the genome. In some embodiments, if a vector is integrated into a target site in a target cell genome, transfer regulating sequences (e.g., inverted terminal repeats, e.g., from an AAV) are not integrated into the genome. In some embodiments, administration of a vector (e.g., encoding a GENE WRITER™ polypeptide described herein, a template nucleic acid described herein, or both) to a target cell, tissue, organ, or subject results in integration of a portion of the vector into one or more target sites in the genome(s) of said target cell, tissue, organ, or subject. In some embodiments, less than 99, 95, 90, 80, 70, 60, 50, 40, 30, 20, 10, 5, 4, 3, 2, or 1% of target sites (e.g., no target sites) comprising integrated material comprise a selective marker (e.g., an antibiotic resistance gene), a transfer regulating sequence (e.g., an inverted terminal repeat, e.g., from an AAV), or both from the vector.

Exemplary methods for producing a therapeutic pharmaceutical protein or polypeptide described herein involve expression in mammalian cells, although recombinant proteins can also be produced using insect cells, yeast, bacteria, or other cells under control of appropriate promoters. Mammalian expression vectors may comprise non-transcribed elements such as an origin of replication, a suitable promoter, and other 5' or 3' flanking non-transcribed sequences, and 5' or 3' non-translated sequences such as necessary ribosome binding sites, a polyadenylation site, splice donor and acceptor sites, and termination sequences. DNA sequences derived from the SV40 viral genome, for example, SV40 origin, early promoter, splice, and polyadenylation sites may be used to provide other genetic elements required for expression of a heterologous DNA sequence. Appropriate cloning and expression vectors for use with bacterial, fungal, yeast, and mammalian cellular hosts are described in Green & Sambrook, *Molecular Cloning: A Laboratory Manual* (Fourth Edition), Cold Spring Harbor Laboratory Press (2012).

Various mammalian cell culture systems can be employed to express and manufacture recombinant protein. Examples of mammalian expression systems include CHO, COS, HEK293, HeLa, and BHK cell lines. Processes of host cell culture for production of protein therapeutics are described in Zhou and Kantardjieff (Eds.), *Mammalian Cell Cultures for Biologics Manufacturing (Advances in Biochemical Engineering/Biotechnology)*, Springer (2014). Compositions described herein may include a vector, such as a viral vector, e.g., a lentiviral vector, encoding a recombinant protein. In some embodiments, a vector, e.g., a viral vector, may comprise a nucleic acid encoding a recombinant protein.

Purification of protein therapeutics is described in Franks, Protein Biotechnology: *Isolation, Characterization, and Stabilization*, Humana Press (2013); and in Cutler, *Protein Purification Protocols (Methods in Molecular Biology)*, Humana Press (2010).

In some embodiments, a GENE WRITER™ system, polypeptide, and/or template nucleic acid (e.g., template RNA) conforms to certain quality standards. In some embodiments, a GENE WRITER™ system, polypeptide, and/or template nucleic acid (e.g., template RNA) produced by a method described herein conforms to certain quality standards. Accordingly, the disclosure is directed in part to methods of manufacturing a GENE WRITER™ system, polypeptide, and/or template nucleic acid (e.g., template RNA) that conforms to certain quality standards, e.g., in which said quality standards are assayed. The disclosure is further directed to methods of assaying said quality standards in a GENE WRITER™ system, polypeptide, and/or template nucleic acid (e.g., template RNA). In some embodiments, quality standards include, but are not limited to:

(i) the length of the template RNA, e.g., whether the template RNA has a length that is above a reference length or within a reference length range, e.g., whether at least 80, 85, 90, 95, 96, 97, 98, or 99% of the template RNA present is greater than 100, 125, 150, 175, or 200 nucleotides long;

(ii) the presence, absence, and/or length of a polyA tail on the template RNA, e.g., whether at least 80, 85, 90, 95, 96, 97, 98, or 99% of the template RNA present contains a polyA tail (e.g., a polyA tail that is at least 5, 10, 20, 30, 50, 70, 100 nucleotides in length (SEQ ID NO: 3665));

(iii) the presence, absence, and/or type of a 5' cap on the template RNA, e.g., whether at least 80, 85, 90, 95, 96, 97, 98, or 99% of the template RNA present contains a 5' cap, e.g., whether that cap is a 7-methylguanosine cap, e.g., a O-Me-m7G cap;

(iv) the presence, absence, and/or type of one or more modified nucleotides (e.g., selected from pseudouridine, dihydrouridine, inosine, 7-methylguanosine, 1-N-methylpseudouridine (1-Me-Ψ), 5-methoxyuridine (5-MO-U), 5-methylcytidine (5mC), or a locked nucleotide) in the template RNA, e.g., whether at least 80, 85, 90, 95, 96, 97, 98, or 99% of the template RNA present contains one or more modified nucleotides;

(v) the stability of the template RNA (e.g., over time and/or under a pre-selected condition), e.g., whether at least 80, 85, 90, 95, 96, 97, 98, or 99% of the template RNA remains intact (e.g., greater than 100, 125, 150, 175, or 200 nucleotides long) after a stability test;

(vi) the potency of the template RNA in a system for modifying DNA, e.g., whether at least 1% of target sites are modified after a system comprising the template RNA is assayed for potency;

(vii) the length of the polypeptide, first polypeptide, or second polypeptide, e.g., whether the polypeptide, first polypeptide, or second polypeptide has a length that is above a reference length or within a reference length range, e.g., whether at least 80, 85, 90, 95, 96, 97, 98, or 99% of the polypeptide, first polypeptide, or second polypeptide present is greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long);

(viii) the presence, absence, and/or type of post-translational modification on the polypeptide, first polypeptide, or second polypeptide, e.g., whether at least 80, 85, 90, 95, 96, 97, 98, or 99% of the polypeptide, first polypeptide, or second polypeptide contains phosphorylation, methylation, acetylation, myristoylation, palmitoylation, isoprenylation, glipyatyon, or lipoylation, or any combination thereof;

(ix) the presence, absence, and/or type of one or more artificial, synthetic, or non-canonical amino acids (e.g., selected from ornithine, β-alanine, GABA, δ-Aminolevulinic acid, PABA, a D-amino acid (e.g., D-alanine or D-glutamate), aminoisobutyric acid, dehydroalanine, cystathionine, lanthionine, Djenkolic acid, Diaminopimelic acid, Homoalanine, Norvaline, Norleucine, Homonorleucine, homoserine, O-methyl-homoserine and O-ethyl-homoserine, ethionine, selenocysteine, selenohomocysteine, selenomethionine, selenocthionine, tellurocysteine, or telluromethionine) in the polypeptide, first polypeptide, or second polypeptide, e.g., whether at least 80, 85, 90, 95, 96, 97, 98, or 99% of the polypeptide, first polypeptide, or second polypeptide present contains one or more artificial, synthetic, or non-canonical amino acids;

(x) the stability of the polypeptide, first polypeptide, or second polypeptide (e.g., over time and/or under a pre-selected condition), e.g., whether at least 80, 85, 90, 95, 96, 97, 98, or 99% of the polypeptide, first polypeptide, or second polypeptide remains intact (e.g., greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long)) after a stability test;

(xi) the potency of the polypeptide, first polypeptide, or second polypeptide in a system for modifying DNA, e.g., whether at least 1% of target sites are modified after a system comprising the polypeptide, first polypeptide, or second polypeptide is assayed for potency; or (xii) the presence, absence, and/or level of one or more of a pyrogen, virus, fungus, bacterial pathogen, or host cell protein, e.g., whether the system is free or substantially free of pyrogen, virus, fungus, bacterial pathogen, or host cell protein contamination.

In some embodiments, quality standards include, but are not limited to:

(i) the length of mRNA encoding the GeneWriter polypeptide, e.g., whether the mRNA has a length that is above a reference length or within a reference length range, e.g., whether at least 80, 85, 90, 95, 96, 97, 98, or 99% of the mRNA present is greater than 3000, 4000, or 5000 nucleotides long;

(ii) the presence, absence, and/or length of a polyA tail on the mRNA, e.g., whether at least 80, 85, 90, 95, 96, 97, 98, or 99% of the mRNA present contains a polyA tail (e.g., a polyA tail that is at least 5, 10, 20, 30, 50, 70, 100 nucleotides in length (SEQ ID NO: 3665));

(iii) the presence, absence, and/or type of a 5' cap on the mRNA, e.g., whether at least 80, 85, 90, 95, 96, 97, 98, or 99% of the mRNA present contains a 5' cap, e.g., whether that cap is a 7-methylguanosine cap, e.g., a O-Me-m7G cap;

(iv) the presence, absence, and/or type of one or more modified nucleotides (e.g., selected from pseudouridine, dihydrouridine, inosine, 7-methylguanosine, 1-N-methylpseudouridine (1-Me-Ψ), 5-methoxyuridine (5-MO-U), 5-methylcytidine (5mC), or a locked nucleotide) in the mRNA, e.g., whether at least 80, 85, 90, 95, 96, 97, 98, or 99% of the mRNA present contains one or more modified nucleotides;

(v) the stability of the mRNA (e.g., over time and/or under a pre-selected condition), e.g., whether at least 80, 85, 90, 95, 96, 97, 98, or 99% of the mRNA remains intact (e.g., greater than 100, 125, 150, 175, or 200 nucleotides long) after a stability test; or (vi) the potency of the mRNA in a system for modifying DNA, e.g., whether at least 1% of target sites are modified after a system comprising the mRNA is assayed for potency.

Circular RNAs in GENE WRITING™ System

Circular RNAs (circRNA) have been found to occur naturally in cells and have been found to have diverse functions, including both non-coding and protein coding roles in human cells. It has been shown that a circRNA can be engineered by incorporating a self-splicing intron into an RNA molecule (or DNA encoding the RNA molecule) that results in circularization of the RNA, and that an engineered circRNA can have enhanced protein production and stability (Wesselhoeft et al. *Nature Communications* 2018). It is contemplated that it may be useful to employ circular and/or linear RNA states during the formulation, delivery, or GENE WRITING™ reaction within the target cell. Thus, in some embodiments of any of the aspects described herein, a GENE WRITING™ system comprises one or more circular RNAs (circRNAs). In some embodiments of any of the aspects described herein, a GENE WRITING™ system comprises one or more linear RNAs. In some embodiments, a nucleic acid as described herein (e.g., a nucleic acid molecule encoding a GENE WRITER™ polypeptide, or both) is a circRNA. In some embodiments, a circular RNA molecule encodes the GENE WRITER™ polypeptide. In some embodiments, the circRNA molecule encoding the GENE WRITER™ polypeptide is delivered to a host cell. In some embodiments, a circular RNA molecule encodes a recombinase, e.g., as described herein. In some embodiments, the circRNA molecule encoding the recombinase is delivered to a host cell. In some embodiments, the circRNA molecule encoding the GENE WRITER™ polypeptide is linearized (e.g., in the host cell) prior to translation. Circular RNAs (circRNA) have been found to occur naturally in cells and have been found to have diverse functions, including both non-coding and protein coding roles in human cells. It has been shown that a circRNA can be engineered by incorporating a self-splicing intron into an RNA molecule (or DNA encoding the RNA molecule) that results in circularization of the RNA, and that an engineered circRNA can have enhanced protein production and stability (Wesselhoeft et al. Nature Communications 2018). In some embodiments, the GENE WRITER™ polypeptide is encoded as circRNA.

In some embodiments, the GENE WRITER™ polypeptide is encoded as circRNA. While in certain embodiments the template nucleic acid is a DNA, such as a ssDNA, in some embodiments it can be provided as an RNA, e.g., with a reverse transcriptase.

In some embodiments, the circRNA comprises one or more ribozyme sequences. In some embodiments, the ribozyme sequence is activated for autocleavage, e.g., in a host cell, e.g., thereby resulting in linearization of the circRNA. In some embodiments, the ribozyme is activated when the concentration of magnesium reaches a sufficient level for cleavage, e.g., in a host cell. In some embodiments the circRNA is maintained in a low magnesium environment prior to delivery to the host cell. In some embodiments, the ribozyme is a protein-responsive ribozyme. In some embodiments, the ribozyme is a nucleic acid-responsive ribozyme.

In some embodiments, the circRNA is linearized in the nucleus of a target cell. In some embodiments, linearization of a circRNA in the nucleus of a cell involves components present in the nucleus of the cell, e.g., to activate a cleavage event. For example, the B2 and ALU retrotransposons contain self-cleaving ribozymes whose activity is enhanced by interaction with the Polycomb protein, EZH2 (Hernandez et al. PNAS 117 (1): 415-425 (2020)). Thus, in some embodiments, a ribozyme, e.g., a ribozyme from a B2 or ALU element, that is responsive to a nuclear element, e.g., a nuclear protein, e.g., a genome-interacting protein, e.g., an epigenetic modifier, e.g., EZH2, is incorporated into a circRNA, e.g., of a GENE WRITING™ system. In some embodiments, nuclear localization of the circRNA results in an increase in autocatalytic activity of the ribozyme and linearization of the circRNA.

In some embodiments, an inducible ribozyme (e.g., in a circRNA as described herein) is created synthetically, for example, by utilizing a protein ligand-responsive aptamer design. A system for utilizing the satellite RNA of tobacco ringspot virus hammerhead ribozyme with an MS2 coat protein aptamer has been described (Kennedy et al. Nucleic Acids Res 42 (19): 12306-12321 (2014), incorporated herein by reference in its entirety) that results in activation of the ribozyme activity in the presence of the MS2 coat protein. In embodiments, such a system responds to protein ligand localized to the cytoplasm or the nucleus. In some embodiments the protein ligand is not MS2. Methods for generating RNA aptamers to target ligands have been described, for example, based on the systematic evolution of ligands by exponential enrichment (SELEX) (Tuerk and Gold, Science 249 (4968): 505-510 (1990); Ellington and Szostak, Nature 346 (6287): 818-822 (1990); the methods of each of which are incorporated herein by reference) and have, in some instances, been aided by in silico design (Bell et al. PNAS 117 (15): 8486-8493, the methods of which are incorporated herein by reference). Thus, in some embodiments, an aptamer for a target ligand is generated and incorporated into a synthetic ribozyme system, e.g., to trigger ribozyme-mediated cleavage and circRNA linearization, e.g., in the presence of the protein ligand. In some embodiments, circRNA linearization is triggered in the cytoplasm, e.g., using an aptamer that associates with a ligand in the cytoplasm. In some embodiments, circRNA linearization is triggered in the nucleus, e.g., using an aptamer that associates with a ligand in the nucleus. In embodiments, the ligand in to the nucleus comprises an epigenetic modifier or a transcription factor. In some embodiments the ligand that triggers linearization is present at higher levels in on-target cells than off-target cells.

It is further contemplated that a nucleic acid-responsive ribozyme system can be employed for circRNA linearization. For example, biosensors that sense defined target nucleic acid molecules to trigger ribozyme activation are described, e.g., in Penchovsky (Biotechnology Advances 32 (5): 1015-1027 (2014), incorporated herein by reference). By these methods, a ribozyme naturally folds into an inactive state and is only activated in the presence of a defined target nucleic acid molecule (e.g., an RNA molecule). In some embodiments, a circRNA of a GENE WRITING™ system comprises a nucleic acid-responsive ribozyme that is activated in the presence of a defined target nucleic acid, e.g., an RNA, e.g., an mRNA, miRNA, guide RNA, gRNA, sgRNA, ncRNA, lncRNA, tRNA, snRNA, or mtRNA. In some embodiments the nucleic acid that triggers linearization is present at higher levels in on-target cells than off-target cells.

In some embodiments of any of the aspects herein, a GENE WRITING™ system incorporates one or more ribozymes with inducible specificity to a target tissue or target cell of interest, e.g., a ribozyme that is activated by a ligand or nucleic acid present at higher levels in a target tissue or target cell of interest. In some embodiments, the GENE WRITING™ system incorporates a ribozyme with inducible specificity to a subcellular compartment, e.g., the nucleus, nucleolus, cytoplasm, or mitochondria. In some embodiments, the ribozyme that is activated by a ligand or nucleic acid present at higher levels in the target subcellular compartment. In some embodiments, an RNA component of a GENE WRITING™ system is provided as circRNA, e.g., that is activated by linearization. In some embodiments, linearization of a circRNA encoding a GENE WRITING™ polypeptide activates the molecule for translation. In some embodiments, a signal that activates a circRNA component of a GENE WRITING™ system is present at higher levels in on-target cells or tissues, e.g., such that the system is specifically activated in these cells.

In some embodiments, an RNA component of a GENE WRITING™ system is provided as a circRNA that is inactivated by linearization. In some embodiments, a circRNA encoding the GENE WRITER™ polypeptide is inactivated by cleavage and degradation. In some embodiments, a circRNA encoding the GENE WRITING™ polypeptide is inactivated by cleavage that separates a translation signal from the coding sequence of the polypeptide. In some embodiments, a signal that inactivates a circRNA component of a GENE WRITING™ system is present at higher levels in off-target cells or tissues, such that the system is specifically inactivated in these cells.

In some embodiments, nucleic acid (e.g., encoding a polypeptide, or a template DNA, or both) delivered to cells is covalently closed linear DNA, or so-called "doggybone" DNA. During its lifecycle, the bacteriophage N15 employs protelomerase to convert its genome from circular plasmid DNA to a linear plasmid DNA (Ravin et al. J Mol Biol 2001). This process has been adapted for the production of covalently closed linear DNA in vitro (see, for example, WO2010086626A1). In some embodiments, a protelomerase is contacted with a DNA containing one or more protelomerase recognition sites, wherein protelomerase results in a cut at the one or more sites and subsequent ligation of the complementary strands of DNA, resulting in the covalent linkage between the complementary strands. In some embodiments, nucleic acid (e.g., encoding a transposase, or a template DNA, or both) is first generated as circular plasmid DNA containing a single protelomerase recognition site that is then contacted with protelomerase to yield a covalently closed linear DNA. In some embodiments, nucleic acid (e.g., encoding a transposase, or a template DNA, or both) flanked by protelomerase recognition sites on plasmid or linear DNA is contacted with protelomerase to generate a covalently closed linear DNA containing only the DNA contained between the protelomerase recognition sites. In some embodiments, the approach of flanking the desired nucleic acid sequence by protelomerase recognition sites results in covalently closed circular DNA lacking plasmid elements used for bacterial cloning and maintenance. In some embodiments, the plasmid or linear DNA containing the nucleic acid and one or more protelomerase recognition sites is optionally amplified prior to the protelomerase reaction, e.g., by rolling circle amplification or PCR.

In some embodiments, nucleic acid (e.g., encoding a polypeptide, or a template nucleic acid, or both) delivered to cells is designed as minicircles, where plasmid backbone sequences not pertaining to GENE WRITING™ are removed before administration to cells. For example, a minicircle may lack a bacterial origin of replication and a selectable marker. In some embodiments, the mnicircle does not comprise any bacterial sequence. Minicircles have been shown to result in higher transfection efficiencies and gene expression as compared to plasmids with backbones containing bacterial parts (e.g., bacterial origin of replication, antibiotic selection cassette) and have been used to improve the efficiency of transposition (Sharma et al *Mol Ther Nucleic Acids* 2013). In some embodiments, the DNA vector encoding the GENE WRITER™ polypeptide is delivered as a minicircle. In some embodiments, the DNA vector containing the GENE WRITER™ template nucleic acid (e.g., template RNA) is delivered as a minicircle. In some embodiments, the bacterial parts are flanked by recombination sites, e.g., attP/attB, loxP, FRT sites. In some embodiments, the addition of a cognate recombinase results in intramolecular recombination and excision of the bacterial parts. In some embodiments, the recombinase sites are recognized by phiC31 recombinase. In some embodiments, the recombinase sites are recognized by Cre recombinase. In some embodiments, the recombinase sites are recognized by FLP recombinase. In addition to plasmid DNA, minicircles can be generated by excising the desired construct, e.g., transposase expression cassettes or therapeutic expression cassette, from a viral backbone. Previously, it has been shown that excision and circularization of the donor sequence from a viral backbone may be important for transposase-mediated integration efficiency (Yant et al *Nat Biotechnol* 2002). In some embodiments, minicircles are first formulated and then delivered to target cells. In other embodiments, minicircles are formed from a DNA vector (e.g., plasmid DNA, rAAV, scAAV, ceDNA, doggybone DNA) intracellularly by co-delivery of a recombinase, resulting in excision and circularization of the recombinase recognition site-flanked nucleic acid, e.g., a nucleic acid encoding the GENE WRITER™ polypeptide, template nucleic acid (e.g., template RNA) or nucleic acid encoding same, or both.

For optimizing protein expression, it can be helpful to provide tunable controls that can be used to modulate protein activity. In some embodiments, a tunable system may comprise at least one effector module that is responsive to at least one stimulus. The system may be, but is not limited to, a destabilizing domain (DD) system. This system is further taught in PCT/US2018/020704, as well as U.S. Provisional Patent Application No. 62/320,864 filed Apr. 11, 2016, 62/466,596 filed Mar. 3, 2017 and the International Publication WO2017/180587 (the contents each of which are herein incorporated by reference in their entirety). In some embodiments, the tunable system may comprise a first effector module. In some embodiments, the effector module may comprise a first stimulus response element (SRE) operably linked to at least one payload. In one aspect, the payload may be an immunotherapeutic agent. In one aspect, the first SRE of the composition may be responsive to or interact with at least one stimulus. In some embodiments, the first SRE may comprise a destabilizing domain (DD). The DD may be derived from a parent protein or from a mutant protein having one, two, three, or more amino acid mutations compared to the parent protein. In some embodiments, the parent protein may be selected from, but is not limited to, human protein FKBP, comprising the amino acid sequence of PCT/US2018/020704 SEQ. ID NO. 3; human DHFR (hDHFR), comprising the amino acid sequence of PCT/US2018/020704 SEQ. ID NO. 2; *E. coli* DHFR, comprising the amino acid sequence of PCT/US2018/020704 SEQ. ID NO. 1; PDE5, comprising the amino acid sequence of PCT/US2018/020704 SEQ. ID NO. 4; PPAR, gamma comprising the amino acid sequence of PCT/US2018/020704 SEQ. ID NO. 5; CA2, comprising the amino acid sequence of PCT/US2018/020704 SEQ. ID NO. 6; or NQO2, comprising the amino acid sequence of PCT/US2018/020704 SEQ. ID NO. 7. In some embodiments, the tunable controls are applied to the GENE WRITER™ polypeptide, such that, e.g., a DD and stimulus can be used to modulate template integration efficiency. In some embodiments, the tunable controls are applied to one or more peptides encoded within the heterologous object sequence of the template, such that, e.g., a DD and stimulus can be used to modulate activity of a genomically integrated payload. In certain embodiments, the payload comprising the DD may be a therapeutic protein, e.g., a functional copy of an endogenously mutated gene. In certain embodiments, the payload comprising the DD may be a heterologous protein, e.g., a CAR.

Kits, Articles of Manufacture, and Pharmaceutical Compositions

In an aspect the disclosure provides a kit comprising a GENE WRITER™ or a GENE WRITING™ system, e.g., as described herein. In some embodiments, the kit comprises a GENE WRITER™ polypeptide (or a nucleic acid encoding the polypeptide) and a template RNA (or DNA encoding the template RNA). In some embodiments, the kit further comprises a reagent for introducing the system into a cell, e.g., transfection reagent, LNP, and the like. In some embodiments, the kit is suitable for any of the methods described herein. In some embodiments, the kit comprises one or more elements, compositions (e.g., pharmaceutical compositions), GENE WRITER™ genome editor polypeptides, and/or GENE WRITER™ systems, or a functional fragment or component thereof, e.g., disposed in an article of manufacture. In some embodiments, the kit comprises instructions for use thereof.

In an aspect, the disclosure provides an article of manufacture, e.g., in which a kit as described herein, or a component thereof, is disposed.

In an aspect, the disclosure provides a pharmaceutical composition comprising a GENE WRITER™ or a GENE WRITING™ system, e.g., as described herein. In some embodiments, the pharmaceutical composition further comprises a pharmaceutically acceptable carrier or excipient. In some embodiments, the pharmaceutical composition comprises a template RNA and/or an RNA encoding the polypeptide. In embodiments, the pharmaceutical composition has one or more (e.g., 1, 2, 3, or 4) of the following characteristics:

(a) less than 1% (e.g., less than 0.5%, 0.4%, 0.3%, 0.2%, or 0.1%) DNA template relative to the template RNA and/or the RNA encoding the polypeptide, e.g., on a molar basis;

(b) less than 1% (e.g., less than 0.5%, 0.4%, 0.3%, 0.2%, or 0.1%) uncapped RNA relative to the template RNA and/or the RNA encoding the polypeptide, e.g., on a molar basis;

(c) less than 1% (e.g., less than 0.5%, 0.4%, 0.3%, 0.2%, or 0.1%) partial length RNAs relative to the template RNA and/or the RNA encoding the polypeptide, e.g., on a molar basis;

(d) substantially lacks unreacted cap dinucleotides.

Chemistry, Manufacturing, and Controls (CMC)

Purification of protein therapeutics is described, for example, in Franks, Protein Biotechnology: *Isolation, Characterization, and Stabilization*, Humana Press (2013); and in Cutler, *Protein Purification Protocols* (*Methods in Molecular Biology*), Humana Press (2010).

In some embodiments, a GENE WRITER™ system, polypeptide, and/or template nucleic acid (e.g., template RNA) conforms to certain quality standards. In some embodiments, a GENE WRITER™ system, polypeptide, and/or template nucleic acid (e.g., template RNA) produced by a method described herein conforms to certain quality standards. Accordingly, the disclosure is directed, in some aspects, to methods of manufacturing a GENE WRITER™ system, polypeptide, and/or template nucleic acid (e.g., template RNA) that conforms to certain quality standards, e.g., in which said quality standards are assayed. The disclosure is also directed, in some aspects, to methods of assaying said quality standards in a GENE WRITER™ system, polypeptide, and/or template nucleic acid (e.g., template RNA). In some embodiments, quality standards include, but are not limited to, one or more (e.g., 1, 2, 3, 4, 5, 6, 7, 8, 9, 10, 11, or 12) of the following:
  (i) the length of the template RNA, e.g., whether the template RNA has a length that is above a reference length or within a reference length range, e.g., whether at least 80, 85, 90, 95, 96, 97, 98, or 99% of the template RNA present is greater than 100, 125, 150, 175, or 200 nucleotides long;
  (ii) the presence, absence, and/or length of a polyA tail on the template RNA, e.g., whether at least 80, 85, 90, 95, 96, 97, 98, or 99% of the template RNA present contains a polyA tail (e.g., a polyA tail that is at least 5, 10, 20, 30, 50, 70, 100 nucleotides in length (SEQ ID NO: 3665));
  (iii) the presence, absence, and/or type of a 5' cap on the template RNA, e.g., whether at least 80, 85, 90, 95, 96, 97, 98, or 99% of the template RNA present contains a 5' cap, e.g., whether that cap is a 7-methylguanosine cap, e.g., a O-Me-m7G cap;
  (iv) the presence, absence, and/or type of one or more modified nucleotides (e.g., selected from pseudouridine, dihydrouridine, inosine, 7-methylguanosine, 1-N-methylpseudouridine (1-Me-Ψ), 5-methoxyuridine (5-MO-U), 5-methylcytidine (5mC), or a locked nucleotide) in the template RNA, e.g., whether at least 80, 85, 90, 95, 96, 97, 98, or 99% of the template RNA present contains one or more modified nucleotides;
  (v) the stability of the template RNA (e.g., over time and/or under a pre-selected condition), e.g., whether at least 80, 85, 90, 95, 96, 97, 98, or 99% of the template RNA remains intact (e.g., greater than 100, 125, 150, 175, or 200 nucleotides long) after a stability test;
  (vi) the potency of the template RNA in a system for modifying DNA, e.g., whether at least 1% of target sites are modified after a system comprising the template RNA is assayed for potency;
  (vii) the length of the polypeptide, first polypeptide, or second polypeptide, e.g., whether the polypeptide, first polypeptide, or second polypeptide has a length that is above a reference length or within a reference length range, e.g., whether at least 80, 85, 90, 95, 96, 97, 98, or 99% of the polypeptide, first polypeptide, or second polypeptide present is greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long);
  (viii) the presence, absence, and/or type of post-translational modification on the polypeptide, first polypeptide, or second polypeptide, e.g., whether at least 80, 85, 90, 95, 96, 97, 98, or 99% of the polypeptide, first polypeptide, or second polypeptide contains phosphorylation, methylation, acetylation, myristoylation, palmitoylation, isoprenylation, glipyatyon, or lipoylation, or any combination thereof;
  (ix) the presence, absence, and/or type of one or more artificial, synthetic, or non-canonical amino acids (e.g., selected from ornithine, β-alanine, GABA, δ-Aminolevulinic acid, PABA, a D-amino acid (e.g., D-alanine or D-glutamate), aminoisobutyric acid, dehydroalanine, cystathionine, lanthionine, Djenkolic acid, Diaminopimelic acid, Homoalanine, Norvaline, Norleucine, Homonorleucine, homoserine, O-methyl-homoserine and O-ethyl-homoserine, ethionine, selenocysteine, selenohomocysteine, selenomethionine, selenoethionine, tellurocysteine, or telluromethionine) in the polypeptide, first polypeptide, or second polypeptide, e.g., whether at least 80, 85, 90, 95, 96, 97, 98, or 99% of the polypeptide, first polypeptide, or second polypeptide present contains one or more artificial, synthetic, or non-canonical amino acids;
  (x) the stability of the polypeptide, first polypeptide, or second polypeptide (e.g., over time and/or under a pre-selected condition), e.g., whether at least 80, 85, 90, 95, 96, 97, 98, or 99% of the polypeptide, first polypeptide, or second polypeptide remains intact (e.g., greater than 600, 650, 700, 750, 800, 850, 900, 950, 1000, 1050, 1100, 1150, 1200, 1250, 1300, 1350, 1400, 1450, 1500, 1600, 1700, 1800, 1900, or 2000 amino acids long (and optionally, no larger than 2500, 2000, 1500, 1400, 1300, 1200, 1100, 1000, 900, 800, 700, or 600 amino acids long)) after a stability test;
  (xi) the potency of the polypeptide, first polypeptide, or second polypeptide in a system for modifying DNA, e.g., whether at least 1% of target sites are modified after a system comprising the polypeptide, first polypeptide, or second polypeptide is assayed for potency; or
  (xii) the presence, absence, and/or level of one or more of a pyrogen, virus, fungus, bacterial pathogen, or host cell protein, e.g., whether the system is free or substantially free of pyrogen, virus, fungus, bacterial pathogen, or host cell protein contamination.

In some embodiments, a system or pharmaceutical composition described herein is endotoxin free.

In some embodiments, the presence, absence, and/or level of one or more of a pyrogen, virus, fungus, bacterial pathogen, and/or host cell protein is determined. In embodiments, whether the system is free or substantially free of pyrogen, virus, fungus, bacterial pathogen, and/or host cell protein contamination is determined.

In some embodiments, a pharmaceutical composition or system as described herein has one or more (e.g., 1, 2, 3, or 4) of the following characteristics:
  (a) less than 1% (e.g., less than 0.5%, 0.4%, 0.3%, 0.2%, or 0.1%) DNA template relative to the template RNA and/or the RNA encoding the polypeptide, e.g., on a molar basis;
  (b) less than 1% (e.g., less than 0.5%, 0.4%, 0.3%, 0.2%, or 0.1%) uncapped RNA relative to the template RNA and/or the RNA encoding the polypeptide, e.g., on a molar basis;
  (c) less than 1% (e.g., less than 0.5%, 0.4%, 0.3%, 0.2%, or 0.1%) partial length RNAs relative to the template RNA and/or the RNA encoding the polypeptide, e.g., on a molar basis;
  (d) substantially lacks unreacted cap dinucleotides.

Applications

By integrating coding genes into a RNA sequence template, the GENE WRITER™ system can address therapeutic needs, for example, by providing expression of a therapeutic transgene in individuals with loss-of-function mutations, by replacing gain-of-function mutations with normal transgenes, by providing regulatory sequences to eliminate gainof-function mutation expression, and/or by controlling the expression of operably linked genes, transgenes and systems thereof. In certain embodiments, the RNA sequence template encodes a promotor region specific to the therapeutic needs of the host cell, for example a tissue specific promotor or enhancer. In still other embodiments, a promotor can be operably linked to a coding sequence. In embodiments, the GENE WRITER™ gene editor system can provide therapeutic transgenes expressing, e.g., replacement blood factors or replacement enzymes, e.g., lysosomal enzymes. For example, the compositions, systems and methods described herein are useful to express, in a target human genome, agalsidase alpha or beta for treatment of Fabry Disease; imiglucerase, taliglucerase alfa, velaglucerase alfa, or alglucerase for Gaucher Disease; sebelipase alpha for lysosomal acid lipase deficiency (Wolman disease/CESD); laronidase, idursulfase, closulfase alpha, or galsulfase for mucopolysaccharidoses; alglucosidase alpha for Pompe disease. For example, the compositions, systems and methods described herein are useful to express, in a target human genome factor I, II, V, VII, X, XI, XII or XIII for blood factor deficiencies.

In some embodiments, the heterologous object sequence encodes an intracellular protein (e.g., a cytoplasmic protein, a nuclear protein, an organellar protein such as a mitochondrial protein or lysosomal protein, or a membrane protein). In some embodiments, the heterologous object sequence encodes a membrane protein, e.g., a membrane protein other than a CAR, and/or an endogenous human membrane protein. In some embodiments, the heterologous object sequence encodes an extracellular protein. In some embodiments, the heterologous object sequence encodes an enzyme, a structural protein, a signaling protein, a regulatory protein, a transport protein, a sensory protein, a motor protein, a defense protein, or a storage protein. Other proteins include an immune receptor protein, e.g. a synthetic immune receptor protein such as a chimeric antigen receptor protein (CAR), a T cell receptor, a B cell receptor, or an antibody.

A GENE WRITING™ system may be used to modify immune cells. In some embodiments, a GENE WRITING™ system may be used to modify T cells. In some embodiments, T-cells may include any subpopulation of T-cells, e.g., CD4+, CD8+, gamma-delta, naïve T cells, stem cell memory T cells, central memory T cells, or a mixture of subpopulations. In some embodiments, a GENE WRITING™ system may be used to deliver or modify a T-cell receptor (TCR) in a T cell. In some embodiments, a GENE WRITING™ system may be used to deliver at least one chimeric antigen receptor (CAR) to T-cells. In some embodiments, a GENE WRITING™ system may be used to deliver at least one CAR to natural killer (NK) cells. In some embodiments, a GENE WRITING™ system may be used to deliver at least one CAR to natural killer T (NKT) cells. In some embodiments, a GENE WRITING™ system may be used to deliver at least one CAR to a progenitor cell, e.g., a progenitor cell of T, NK, or NKT cells. In some embodiments, cells modified with at least one CAR (e.g., CAR-T cells, CAR-NK cells, CAR-NKT cells), or a combination of cells modified with at least one CAR (e.g., a mixture of CAR-NK/T cells) are used to treat a condition as identified in the targetable landscape of CAR therapies in MacKay, et al. Nat Biotechnol 38, 233-244 (2020), incorporated by reference herein in its entirety. In some embodiments, the immune cells comprise a CAR specific to a tumor or a pathogen antigen selected from a group consisting of AChR (fetal acetylcholine receptor), ADGRE2, AFP (alpha fetoprotein), BAFF-R, BCMA, CAIX (carbonic anhydrase IX), CCR1, CCR4, CEA (carcinoembryonic antigen), CD3, CD5, CD8, CD7, CD10, CD13, CD14, CD15, CD19, CD20, CD22, CD30, CD33, CLLI, CD34, CD38, CD41, CD44, CD49f, CD56, CD61, CD64, CD68, CD70, CD74, CD99, CD117, CD123, CD133, CD138, CD44v6, CD267, CD269, CDS, CLEC12A, CS1, EGP-2 (epithelial glycoprotein-2), EGP-40 (epithelial glycoprotein-40), EGFR (HER1), EGFR-VIII, EpCAM (epithelial cell adhesion molecule), EphA2, ERBB2 (HER2, human epidermal growth factor receptor 2), ERBB3, ERBB4, FBP (folate-binding protein), Flt3 receptor, folate receptor-a, GD2 (ganglioside G2), GD3 (ganglioside G3), GPC3 (glypican-3), GPI00, hTERT (human telomerase reverse transcriptase), ICAM-1, integrin B7, interleukin 6 receptor, IL13Ra2 (interleukin-13 receptor 30 subunit alpha-2), kappa-light chain, KDR (kinase insert domain receptor), LeY (Lewis Y), LICAM (LI cell adhesion molecule), LILRB2 (leukocyte immunoglobulin like receptor B2), MARTI, MAGE-A1 (melanoma associated antigen A1), MAGE-A3, MSLN (mesothelin), MUC16 (mucin 16), MUCI (mucin I), KG2D ligands, NY-ESO-1 (cancer-testis antigen), PRI (proteinase 3), TRBCI, TRBC2, TFM-3, TACI, tyrosinase, survivin, hTERT, oncofetal antigen (h5T4), p53, PSCA (prostate stem cell antigen), PSMA (prostate-specific membrane antigen), hRORI, TAG-72 (tumor-associated glycoprotein 72), VEGF-R2 (vascular endothelial growth factor R2), WT-1 (Wilms tumor protein), and antigens of HIV (human immunodeficiency virus), hepatitis B, hepatitis C, CMV (cytomegalovirus), EBV (Epstein-Barr virus), HPV (human papilloma virus).

In some embodiments, immune cells, e.g., T-cells, NK cells, NKT cells, or progenitor cells are modified ex vivo and then delivered to a patient. In some embodiments, a GENE WRITER™ system is delivered by one of the methods mentioned herein, and immune cells, e.g., T-cells, NK cells, NKT cells, or progenitor cells are modified in vivo in the patient.

In some embodiments, a GENE WRITER™ system described herein is delivered to a tissue or cell from the cerebrum, cerebellum, adrenal gland, ovary, pancreas, parathyroid gland, hypophysis, testis, thyroid gland, breast, spleen, tonsil, thymus, lymph node, bone marrow, lung, cardiac muscle, esophagus, stomach, small intestine, colon, liver, salivary gland, kidney, prostate, blood, or other cell or tissue type. In some embodiments, a GENE WRITER™ system described herein is used to treat a disease, such as a cancer, inflammatory disease, infectious disease, genetic defect, or other disease. A cancer can be cancer of the cerebrum, cerebellum, adrenal gland, ovary, pancreas, parathyroid gland, hypophysis, testis, thyroid gland, breast, spleen, tonsil, thymus, lymph node, bone marrow, lung, cardiac muscle, esophagus, stomach, small intestine, colon, liver, salivary gland, kidney, prostate, blood, or other cell or tissue type, and can include multiple cancers.

In some embodiments, a GENE WRITER™ system described herein described herein is administered by enteral administration (e.g, oral, rectal, gastrointestinal, sublingual, sublabial, or buccal administration). In some embodiments, a GENE WRITER™ system described herein is administered by parenteral administration (e.g., intravenous, intramuscular, subcutaneous, intradermal, epidural, intracerebral, intracerebroventricular, epicutaneous, nasal, intra-arterial, intra-articular, intracavernous, intraocular, intraosscous infusion, intraperitoneal, intrathecal, intrauterine, intravaginal, intravesical, perivascular, or transmucosal administration). In some embodiments, a GENE WRITER™ system described herein is administered by topical administration (e.g., transdermal administration).

In some embodiments, a GENE WRITING™ system can be used to make an insertion, deletion, substitution, or combination thereof in a cell, tissue, or subject. In some embodiments, an insertion, deletion, substitution, or combination thereof, increases or decreases expression (e.g. transcription or translation) of a gene. In some embodiments, an insertion, deletion, substitution, or combination thereof, increases or decreases expression (e.g. transcription or translation) of a gene by altering, adding, or deleting sequences in a promoter or enhancer, e.g. sequences that bind transcription factors. In some embodiments, an insertion, deletion, substitution, or combination thereof alters translation of a gene (e.g. alters an amino acid sequence), inserts or deletes a start or stop codon, alters or fixes the translation frame of a gene. In some embodiments, an insertion, deletion, substitution, or combination thereof alters splicing of a gene, e.g. by inserting, deleting, or altering a splice acceptor or donor site. In some embodiments, an insertion, deletion, substitution, or combination thereof alters transcript or protein half-life. In some embodiments, an insertion, deletion, substitution, or combination thereof alters protein localization in the cell (e.g. from the cytoplasm to a mitochondria, from the cytoplasm into the extracellular space (e.g. adds a secretion tag)). In some embodiments, an insertion, deletion, substitution, or combination thereof alters (e.g. improves) protein folding (e.g. to prevent accumulation of misfolded proteins). In some embodiments, an insertion, deletion, substitution, or combination thereof, alters, increases, decreases the activity of a gene, e.g. a protein encoded by the gene.

In some embodiments, a GENE WRITING™ system can be used to make multiple modifications (e.g., multiple insertions, deletions, or substitutions, and all combinations thereof) to a target cell, either simultaneously or sequentially. In some embodiments, a GENE WRITING™ system can be used to further modify an already modified cell. In some embodiments, a GENE WRITING™ system can be use to modify a cell edited by a complementary technology, e.g., a gene edited cell, e.g., a cell with one or more CRISPR knockouts. In some embodiments, the previously edited cell is a T-cell. In some embodiments, the previous modifications comprise gene knockouts in a T-cell, e.g., endogenous TCR (e.g., TRAC, TRBC), HLA Class I (B2M), PD1, CD52, CTLA-4, TIM-3, LAG-3, DGK. In some embodiments, a GENE WRITING™ system is used to insert a TCR or CAR into a T-cell that has been previously modified.

In some embodiments, a GENE WRITER™ system as described herein can be used to modify an animal cell, plant cell, or fungal cell. In some embodiments, a GENE WRITER™ system as described herein can be used to modify a mammalian cell (e.g., a human cell). In some embodiments, a GENE WRITER™ system as described herein can be used to modify a cell from a livestock animal (e.g., a cow, horse, sheep, goat, pig, llama, alpaca, camel, yak, chicken, duck, goose, or ostrich). In some embodiments, a GENE WRITER™ system as described herein can be used as a laboratory tool or a research tool, or used in a laboratory method or research method, e.g., to modify an animal cell, e.g., a mammalian cell (e.g., a human cell), a plant cell, or a fungal cell.

In some embodiments, a GENE WRITER™ system as described herein can be used to express a protein, template, or heterologous object sequence (e.g., in an animal cell, e.g., a mammalian cell (e.g., a human cell), a plant cell, or a fungal cell). In some embodiments, a GENE WRITER™ system as described herein can be used to express a protein, template, or heterologous object sequence under the control of an inducible promoter (e.g., a small molecule inducible promoter). In some embodiments, a GENE WRITING™ system or payload thereof is designed for tunable control, e.g., by the use of an inducible promoter. For example, a promoter, e.g., Tet, driving a gene of interest may be silent at integration, but may, in some instances, activated upon exposure to a small molecule inducer, e.g., doxycycline. In some embodiments, the tunable expression allows post-treatment control of a gene (e.g., a therapeutic gene), e.g., permitting a small molecule-dependent dosing effect. In embodiments, the small molecule-dependent dosing effect comprises altering levels of the gene product temporally and/or spatially, e.g., by local administration. In some embodiments, a promoter used in a system described herein may be inducible, e.g., responsive to an endogenous molecule of the host and/or an exogenous small molecule administered thereto.

In some embodiments, a GENE WRITING™ system is used to make changes to non-coding and/or regulatory control regions, e.g., to tune the expression of endogenous genes. In some embodiments, a GENE WRITING™ system is used to induce upregulation or downregulation of gene expression. In some embodiments, a regulatory control region comprises one or more of a promoter, enhancer, UTR, CTCF site, and/or a gene expression control region.

In some embodiments, a GENE WRITING™ system may be used to treat or prevent a repeat expansion disease (e.g., a disease of Table 44), or to reduce the severity or a symptom thereof. In some embodiments, the repeat expansion disease comprises expansion of a trinucleotide repeat. In some embodiments, the subject has at least 10, 20, 30, 40, or 50 copies of the repeat. In embodiments, the repeat expansion disease is an inherited disease. Non-limiting examples of repeat expansion diseases include Huntington's disease (HD) and myotonic dystrophy. For example, healthy individuals may possess between 10 and 35 tandem copies of the CAG trinucleotide repeat, while Huntington's patients frequently possess >40 copies, which can result, e.g., in an elongated and dysfunctional Huntingtin protein. In some embodiments, a GENE WRITER™ corrects a repeat expansion, e.g., by recognizing DNA at the terminus of the repeat region and nicking one strand (FIG. 30). In some embodiments, the template RNA component of the GENE WRITER™ comprises a region with a number of repeats characteristic of a healthy subject, e.g., about 20 repeats (e.g., between 5-10, 10-15, 15-20, 20-25, 25-30, 30-35, or 35-40 repeats). In some embodiments, the template RNA component of the GENE WRITER™ is copied by TPRT into the target site. In some embodiments, a second strand nick and second strand synthesis then results in the integration of the newly copied DNA comprising a correct number of repeats (e.g., as described herein). In some embodiments, the system recognizes DNA at the terminus of the repeat region and the template carries the information for the new number of repeats. In embodiments, a GENE WRITER™ can be used in this way regardless of the number of repeats present in an individual and/or in an individual cell. Owing to the presence of multiple repeats, an alternative non-GeneWriter therapeutic (e.g., a CRISPR-based homologous recombination therapeutic) might, in some embodiments, result in unpredictable repair behavior. Further non-limiting examples of repeat expansion diseases and the causative repeats can be found, for example, in La Spada and Taylor Nat Rev Genet 11 (4): 247-258 (2010), which is incorporated herein by reference in its entirety.

In some embodiments, a GENE WRITING™ system may be used to treat a healthy individual, e.g., as a preventative therapy. GENE WRITING™ systems can, in some embodiments, be targeted to generate mutations, e.g., that have been shown to be protective towards a disease of interest. An exemplary list of such diseases and protective mutation targets can be found in Table 40.

In some embodiments, a GENE WRITER™ system described herein is used to treat an indication of any of Tables 27-30. For instance, in some embodiments the GENE WRITER™ system modifies a target site in genomic DNA in a cell, wherein the target site is in a gene of any of Tables 27-30, e.g., in a subject having the corresponding indication listed in any of Tables 27-30. In some embodiments, the cell is a liver cell and the target site is in a gene of Table 27, e.g., in a subject having the corresponding indication listed in Table 27. In some embodiments, the cell is an HSC and the target site is in a gene of Table 28, e.g., in a subject having the corresponding indication listed in Table 28. In some embodiments, the cell is a CNS cell and the target site is in a gene of Table 29, e.g., in a subject having the corresponding indication listed in Table 29. In some embodiments, the cell is a cell of the eye and the target site is in a gene of Table 30, e.g., in a subject having the corresponding indication listed in Table 30. In some embodiments, the target site is in a coding region in the gene. In some embodiments, the target site is in a promoter. In some embodiments, the target site is in a 5' UTR or a 3' UTR of the gene of any of Tables 27-30. In some embodiments, the target site is in an intron or exon of the gene. In some embodiments, the GeneWriter corrects a mutation in the gene. In some embodiments, the GeneWriter inserts a sequence that had been deleted from the gene (e.g., through a disease-causing mutation). In some embodiments, the GeneWriter deletes a sequence that had been duplicated in the gene (e.g., through a disease-causing mutation). In some embodiments, the GeneWriter replaces a mutation (e.g., a disease-causing mutation) with the corresponding wild-type sequence. In some embodiments, the mutation is a substitution, insertion, deletion, or inversion.

TABLE 27

Indications and genetic targets, e.g., in the liver

| Disease | Gene Affected |
| --- | --- |
| Acute intermittent porphyria | HMBS |
| Alpha-1-antitrypsin deficiency (AAT) | SERPINA1 |
| Arginase deficiency | ARG1 |
| Argininosuccinate lyase deficiency | ASL |
| Carbamoyl phosphate synthetase I deficiency | CPS1 |
| Citrin deficiency | SLC25A13 |
| Citrullinemia type I | ASS1 |
| Crigler-Najjar syndrome (Hyperbilirubinemia) | UGT1A1 |
| Fabry disease | GLA |
| Familial hypercholesterolemia 4 (homozygous familial cholesterolemia) | LDLRAP1 |
| Glutaric aciduria I | GCDH |
| Glutaric aciduria II (multiple acyl-CoA dehydrogenase deficiency) | GA IIA: ETFA<br>GA IIB: ETFB<br>GA IIC: ETFDH |
| Glycogen storage disease type IV | GBE1 |
| Hemophilia A | F8 |
| Hemophilia B | F9 |
| Hereditary hemochromatosis | HFE |
| Homocystinuria | CBS |
| Maple syrup urine disease (MSUD) | Type Ia: BCKDHA<br>Type Ib: BCKDHB<br>Type II: DBT |

TABLE 27-continued

Indications and genetic targets, e.g., in the liver

| Disease | Gene Affected |
| --- | --- |
| Methylmalonic acidemia (methylmalonyl-CoA mutase deficiency) | MMUT |
| MPS 1S (Scheie syndrome) | IDUA |
| MPS2 | IDS |
| MPS3 (San Filippo Syndrome) | Type IIIa: SGSH<br>Type IIIb: NAGLU<br>Type IIIc: HGSNAT<br>Type IIId: GNS |
| MPS4 | Type IVA: GALNS<br>Type IVB: GLB1 |
| MPS6 | ARSB |
| MPS7 | GUSB |
| Ornithine transcarbamylase deficiency | OTC |
| Phenylketonuria (phenylalanine hydroxylase deficiency) | PAH |
| Polycystic Liver Disease | PCLD1: PRKCSH<br>PCLD2: SEC63<br>PLCD3: ALG8<br>PCLD4: LRP5 |
| Pompe disease | GAA |
| Primary Hyperoxaluria 1 (oxalosis) | AGXT |
| Progressive familial intrahepatic cholestasis type 1 | ATP8B1 |
| Progressive familial intrahepatic cholestasis type 2 | ABCB11 |
| Progressive familial intrahepatic cholestasis type 3 | ABCB4 |
| Propionic acidemia | PCCB; PCCA |
| Pyruvate carboxylase deficiency | PC |
| Tyrosinemia type I | FAH |
| Wilson's disease | ATP7B |

TABLE 28

Indications and genetic targets for HSCs

| Disease | Gene Affected |
| --- | --- |
| Adrenoleukodystrophy (CALD) | ABCD1 |
| Alpha-mannosidosis | MAN2B1 |
| Blackfan-Diamond Anemia | |
| Congenital amegakaryocytic thrombocytopenia | MPL |
| Dyskeratosis Congenita | TERC |
| Fanconi anemia | FANC |
| Gaucher disease | GBA |
| Globoid cell leukodystrophy (Krabbe disease) | GALC |
| Hemophagocytic lymphohistiocytosis | PRF1; STX11; STXBP2; UNC13D |
| Malignant infantile osteopetrosis-autosomal recessive osteopetrosis | Many genes implicated |
| Metachromatic leukodystrophy | PSAP |
| MPS 1S (Scheie syndrome) | IDUA |
| MPS2 | IDS |
| MPS7 | GUSB |
| Mucolipidosis II | GNPTAB |
| Niemann-Pick disease A and B | SMPD1 |
| Niemann-Pick disease C | NPC1 |
| Pompe disease | GAA |
| Pyruvate kinase deficiency (PKD) | PKLR |
| Sickle cell disease (SCD) | HBB |
| Tay Sachs | HEXA |
| Thalassemia | HBB |

TABLE 29

Indications and genetic targets for the CNS

| Disease | Gene Affected |
| --- | --- |
| Alpha-mannosidosis | MAN2B1 |
| Ataxia-telangiectasia | ATM |
| CADASIL | NOTCH3 |
| Canavan disease | ASPA |
| Carbamoyl-phosphate synthetase 1 deficiency | CPS1 |

TABLE 29-continued

Indications and genetic targets for the CNS

| Disease | Gene Affected |
|---|---|
| CLN1 disease | PPT1 |
| CLN2 Disease | TPP1 |
| CLN3 Disease (Juvenile neuronal ceroid lipofuscinosis, Batten Disease) | CLN3 |
| Coffin-Lowry syndrome | RPS6KA3 |
| Congenital myasthenic syndrome 5 | COLQ |
| Cornelia de Lange syndrome (NIPBL) | NIPBL |
| Cornelia de Lange syndrome (SMC1A) | SMC1A |
| Dravet syndrome (SCN1A) | SCN1A |
| Glycine encephalopathy (GLDC) | GLDC |
| GM1 gangliosidosis | GLB1 |
| Huntington's Disease | HTT |
| Hydrocephalus with stenosis of the aqueduct of Sylvius | L1CAM |
| Leigh Syndrome | SURF1 |
| Metachromatic leukodystrophy (ARSA) | ARSA |
| MPS type 2 | IDS |
| MPS type 3 | Type 3a: SGSH Type 3b: NAGLU |
| Mucolipidosis IV | MCOLN1 |
| Neurofibromatosis Type 1 | NF1 |
| Neurofibromatosis type 2 | NF2 |
| Pantothenate kinase-associated neurodegeneration | PANK2 |
| Pyridoxine-dependent epilepsy | ALDH7A1 |
| Rett syndrome (MECP2) | MECP2 |
| Sandhoff disease | HEXB |
| Semantic dementia (Frontotemporal dementia) | MAPT |
| Spinocerebellar ataxia with axonal neuropathy (Ataxia with Oculomotor Apraxia) | SETX |
| Tay-Sachs disease | HEXA |
| X-linked Adrenoleukodystrophy | ABCD1 |

TABLE 30

Indications and genetic targets for the eye

| Disease | Gene Affected |
|---|---|
| Achromatopsia | CNGB3 |
| Amaurosis Congenita (LCA1) | GUCY2D |
| Amaurosis Congenita (LCA10) | CEP290 |
| Amaurosis Congenita (LCA2) | RPE65 |
| Amaurosis Congenita (LCA8) | CRB1 |
| Choroideremia | CHM |
| Cone Rod Dystrophy (ABCA4) | ABCA4 |
| Cone Rod Dystrophy (GUCY2D) | GUCY2D |
| Cystinosis, Ocular Nonnephropathic | CTNS |
| Doyne Honeycomb Retinal Dystrophy (DHRD) | EFEMP1 |
| Familial Oculoleptomeningeal Amyloidosis | TTR |
| Keratitis-ichthyosis-deafness (KID) | GJB2 |
| Lattice corneal dystrophy type I | TGFBI |
| Macular Corneal Dystrophy (MCD) | CHST6 |
| Meesmann Corneal Dystrophy | KRT12; KRT3 |
| Optic Atrophy | OPA1 |
| Retinitis Pigmentosa (AR) | USH2A |
| Retinitis Rigmentosa (AD) | RHO |
| Sorsby Fundus Dystrophy | TIMP3 |
| Stargardt Disease | ABCA4 |

Additional Suitable Indications

Exemplary suitable diseases and disorders that can be treated by the systems or methods provided herein, for example, those comprising GENE WRITER™ genome editor polypeptides, include, without limitation: Baraitser-Winter syndromes 1 and 2; Diabetes mellitus and insipidus with optic atrophy and deafness; Alpha-1-antitrypsin deficiency; Heparin cofactor II deficiency: Adrenoleukodystrophy; Keppen-Lubinsky syndrome; Treacher collins syndrome 1; Mitochondrial complex I, II, III, III (nuclear type 2, 4, or 8) deficiency; Hypermanganesemia with dystonia, polycythemia and cirrhosis; Carcinoid tumor of intestine; Rhabdoid tumor predisposition syndrome 2; Wilson disease: Hyperphenylalaninemia, bh4-deficient, a, due to partial pts deficiency. BH4-deficient, D, and non-pku; Hyperinsulinemic hypoglycemia familial 3, 4, and 5; Keratosis follicularis; Oral-facial-digital syndrome; SeSAME syndrome; Deafness, nonsyndromic sensorineural, mitochondrial: Proteinuria; Insulin-dependent diabetes mellitus secretory diarrhea syndrome; Moyamoya disease 5; Diamond-Blackfan anemia 1, 5, 8, and 10; Pseudoachondroplastic spondyloepiphyseal dysplasia syndrome; Brittle cornea syndrome 2; Methylmalonic acidemia with homocystinuria; Adams-Oliver syndrome 5 and 6; autosomal recessive Agammaglobulinemia 2; Cortical malformations, occipital; Febrile seizures, familial, 11; Mucopolysaccharidosis type VI, type VI (severe), and type VII; Marden Walker like syndrome; Pseudoneonatal adrenoleukodystrophy; Spheroid body myopathy; Cleidocranial dysostosis; Multiple Cutaneous and Mucosal Venous Malformations; Liver failure acute infantile; Neonatal intrahepatic cholestasis caused by citrin deficiency; Ventricular septal defect 1; Oculodentodigital dysplasia; Wilms tumor 1; Weill-Marchesani-like syndrome; Renal adysplasia; Cataract 1, 4, autosomal dominant, autosomal dominant, multiple types, with microcornea, coppock-like, juvenile, with microcornea and glucosuria, and nuclear diffuse nonprogressive; Odontohypophosphatasia; Cerebrooculo-facio-skeletal syndrome; Schizophrenia 15; Cerebral amyloid angiopathy, APP-related; Hemophagocytic lymphohistiocytosis, familial. 3; Porphobilinogen synthase deficiency: Episodic ataxia type 2; Trichorhinophalangeal syndrome type 3; Progressive familial heart block type IB; Glioma susceptibility 1; Lichtenstein-Knorr Syndrome: Hypohidrotie X-linked ectodermal dysplasia; Bartter syndrome types 3, 3 with hypocalciuria, and 4; Carbonic anhydrase VA deficiency, hyperammonemia due to; Cardiomyopathy; Poikiloderma, hereditary fibrosing, with tendon contractures, myopathy, and pulmonary fibrosis: Combined d-2- and 1-2-hydroxyglutaric aciduria; Arginase deficiency; Cone-rod dystrophy 2 and 6; Smith-Lemli-Opitz syndrome; Mucolipidosis III Gamma; Blau syndrome; Wemer syndrome; Meningioma: Iodotyrosyl coupling defect; Dubin-Johnson syndrome; 3-Oxo-5 alpha-steroid delta 4-dehydrogenase deficiency: Boucher Neuhauser syndrome; Iron accumulation in brain: Mental Retardation, X-Linked 102 and syndromic 13: familial, Pituitary adenoma predisposition; Hypoplasia of the corpus callosum; Hyperalphalipoproteinemia 2; Deficiency of ferroxidase; Growth hormone insensitivity with immunodeficiency: Marinesco-Sjwxc3\xb6gren syndrome; Martsolf syndrome; Gaze palsy, familial horizontal, with progressive scoliosis; Mitchell-Riley syndrome; Hypocalciuric hypercalcemia, familial, types 1 and 3; Rubinstein-Taybi syndrome; Epstein syndrome; Juvenile retinoschisis; Becker muscular dystrophy; Loeys-Dietz syndrome 1, 2, 3; Congenital muscular hypertrophy-cerebral syndrome; Familial juvenile gout: Spermatogenic failure 11, 3, and 8; Orofacial cleft 11 and 7, Cleft lip/palate-ectodermal dysplasia syndrome; Mental retardation, X-linked, nonspecific, syndromic, Hedera type, and syndromic, wu type; Combined oxidative phosphorylation deficiencies 1, 3, 4, 12, 15, and 25; Frontotemporal dementia; Kniest dysplasia; Familial cardiomyopathy: Benigo familial hematuria; Pheochromocytoma: Aminoglycoside-induced deafness; Gamma-aminobutyric acid transaminase deficiency: Oculocutaneous albinism type IB, type 3, and type 4; Renal coloboma syndrome; CNS hypomyelination; Hennekam lymphangiectasia-lymphedema syndrome 2; Migraine, familial basilar; Distal spinal muscular atrophy, X-linked 3; X-linked periventricular heterotopia; Microcephaly; Mucopolysaccharidosis, MPS-I-H/S, MPS-II, MPS-III-A, MPS-III-B, MPS-III-C, MPS-IV-A, MPS-IV-B; Infantile Parkinsonism-dystonia; Frontotemporal dementia with TDP43 inclusions, TARDBP-related; Hereditary diffuse gastric cancer; Sialidosis type I and II; Microcephaly-capillary malformation syndrome; Hereditary breast and ovarian cancer syndrome; Brain small vessel disease with hemorrhage; Non-ketotic hyperglycinemia; Navajo neurohepatopathy; Auriculocondylar syndrome 2; Spastic paraplegia 15, 2, 3, 35, 39, 4, autosomal dominant, 55, autosomal recessive, and 5A; Autosomal recessive cutis laxa type IA and IB; Hemolytic anemia, nonspherocytic, due to glucose phosphate isomerase deficiency; Hutchinson-Gilford syndrome: Familial amyloid nephropathy with urticaria and deafness; Supravalvar aortic stenosis; Diffuse palmoplantar keratoderma, Bothnian type; Holt-Oram syndrome; Coffin Siris/Intellectual Disability; Left-right axis malformations; Rapadilino syndrome; Nanophthalmos 2; Craniosynostosis and dental anomalies; Paragangliomas 1; Snyder Robinson syndrome; Ventricular fibrillation; Activated PI3K-delta syndrome; Howel-Evans syndrome; Larsen syndrome, dominant type; Van Maldergem syndrome 2; MYH-associated polyposis: 6-pymvoyl-tetrahydropterin synthase deficiency; Alagille syndromes 1 and 2; Lymphangiomyomatosis; Muscle eye brain disease; WFSI-Related Disorders: Primary hypertrophic osteoarthropathy, autosomal recessive 2: Infertility; Nestor-Guillermo progeria syndrome; Mitochondrial trifunctional protein deficiency; Hypoplastic left heart syndrome 2; Primary dilated cardiomyopathy; Retinitis pigmentosa; Hirschsprung disease 3; Upshaw-Schulman syndrome; Desbuquois dysplasia 2; Diarrhea 3 (secretory sodium, congenital, syndromic) and 5 (with tufting enteropathy, congenital); Pachyonychia congenita 4 and type 2; Cerebral autosomal dominant and recessive arteriopathy with subcortical infarcts and leukoencephalopathy; Vi tel li form dystrophy; type II, type IV, IV (combined hepatic and myopathic), type V, and type VI; Atypical Rett syndrome; Atrioventricular septal defect 4; Papillon-Lef\xc3\xa8vre syndrome; Leber amaurosis; X-linked hereditary motor and sensory neuropathy; Progressive sclerosing poliodystrophy; Goldmann-Favre syndrome; Renal-hepatic-pancreatic dysplasia; Pallister-Hall syndrome; Amyloidogenic transthyretin amyloidosis; Melnick-Needles syndrome; Hyperimmunoglobulin E syndrome; Posterior column ataxia with retinitis pigmentosa: Chondrodysplasia punctata 1, X-linked recessive and 2 X-linked dominant: Ectopia lentis, isolated autosomal recessive and dominant; Familial cold urticarial; Familial adenomatous polyposis 1 and 3; Porokeratosis 8, disseminated superficial actinic type; PIK3CA Related Overgrowth Spectrum; Cerebral cavernous malformations 2; Exudative vitreoretinopathy 6; Megalencephaly cutis marmorata telangiectatica congenital; TARP syndrome: Diabetes mellitus, permanent neonatal, with neurologic features; Short-rib thoracic dysplasia 11 or 3 with or without polydactyly: Hypertrichotic osteochondrodysplasia; beta Thalassemia; Niemann-Pick disease type C1. C2, type A, and type C1, adult form; Charcot-Marie-Tooth disease types IB, 2B2, 2C, 2F, 2I, 2U (axonal), IC (demyelinating), dominant intermediate C, recessive intermediate A, 2A2, 4C, 4D, 4H, 1F, 1VF, and X; Tyrosinemia type I; Paroxysmal atrial fibrillation; UV-sensitive syndrome; Tooth agenesis, selective, 3 and 4; Merosin deficient congenital muscular dystrophy; Long-chain 3-hydroxyacyl-CoA dehydrogenase deficiency: Congenital aniridia; Left ventricular noncompaction 5; Deficiency of aromatic-L-amino-acid decarboxylase; Coronary heart disease; Leukonychia totalis; Distal arthrogryposis type 2B: Retinitis pigmentosa 10, 11, 12, 14, 15, 17, and 19; Robinow Sorauf syndrome; Tenorio Syndrome; Prolactinoma: Neurofibromatosis, type land type 2; Congenital muscular dystrophy-dystroglycanopathy with brain and eye anomalies, types A2, A7. A8, All, and A14; Heterotaxy, visceral, 2, 4, and 6, autosomal; Jankovic Rivera syndrome; Lipodystrophy, familial partial, type 2 and 3; Hemoglobin H disease, nondeletional; Multicentric osteolysis, nodulosis and arthropathy: Thyroid agenesis; deficiency of Acyl-CoA dehydrogenase family, member 9; Alexander disease; Phytanic acid storage disease; Breast-ovarian cancer, familial 1, 2, and 4; Proline dehydrogenase deficiency; Childhood hypophosphatasia: Pancreatic agenesis and congenital heart disease; Vitamin D-dependent rickets, types land 2; Iridogoniodysgenesis dominant type and type 1; Autosomal recessive hypohidrotic ectodermal dysplasia syndrome; Mental retardation, X-linked, 3, 21, 30, and 72; Hereditary hemorrhagic telangiectasia type 2; Blepharophimosis, ptosis, and epicanthus inversus; Adenine phosphoribosyltransferase deficiency; Seizures, benign familial infantile, 2: Acrodysostosis 2, with or without hormone resistance; Tetralogy of Fallot; Retinitis pigmentosa 2, 20, 25, 35, 36, 38, 39, 4, 40, 43, 45, 48, 66, 7, 70, 72; Lysosomal acid lipase deficiency; Eichsfeld type congenital muscular dystrophy; Walker-Warburg congenital muscular dystrophy; TNF receptor-associated periodic fever syndrome (TRAPS); Progressive myoclonus epilepsy with ataxia; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Long QT syndrome; Dicarboxylic aminoaciduria; Brachydactyly types A1 and A2; Pseudoxanthoma elasticum-like disorder with multiple coagulation factor deficiency; Multisystemic smooth muscle dysfunction syndrome; Syndactyly Cenani Lenz type; Joubert syndrome 1, 6, 7, 9/15 (digenic), 14, 16, and 17, and Orofaciodigital syndrome xiv; Digitorenocerebral syndrome; Retinoblastoma; Dyskinesia, familial, with facial myokymia; Hereditary sensory and autonomic neuropathy type IIB amd IIA; familial hyperinsulinism; Megalencephalic leukoencephalopathy with subcortical cysts 1 land 2a; Aase syndrome; Wiedemann-Steiner syndrome; Ichthyosis exfoliativa; Myotonia congenital; Granulomatous disease, chronic, X-linked, variant; Deficiency of 2-methylbutyryl-CoA dehydrogenase; Sarcoidosis, early-onset; Glaucoma, congenital and Glaucoma, congenital. Coloborna; Breast cancer, susceptibility to; Ceroid lipofuscinosis neuronal 2, 6, 7, and 10; Congenital generalized lipodystrophy type 2; Fructose-biphosphatase deficiency; Congenital contractural arachnodactyly: Lynch syndrome I and II; Phosphoglycerate dehydrogenase deficiency; Burn-Mckeown syndrome; Myocardial infarction 1; Achromatopsia 2 and 7: Retinitis Pigmentosa 73; Protan defect; Polymicrogyria, asymmetric, bilateral frontoparietal; Spinal muscular atrophy, distal, autosomal recessive, 5; Methylmalonic aciduria due to methylmalonyl-CoA mutase deficiency: Familial porencephaly; Hurler syndrome; Oto-palato-digital syndrome, types I and II; Sotos syndrome 1 or 2; Cardioencephalomyopathy, fatal infantile, due to cytochrome c oxidase deficiency; Parastremmatie dwarfism; Thyrotropin releasing hormone resistance, generalized; Diabetes mellitus, type 2, and insulin-dependent, 20; Thoracic aortic aneurysms and aortic dissections; Estrogen resistance; Maple syrup urine disease type IA and type 3; Hypospadias 1 and 2. X-linked; Metachromatic leukodystrophy juvenile, late infantile, and adult types; Early T cell progenitor acute lymphoblastic leukemia; Neuropathy, Hereditary Sensory, Type IC; Mental retardation, autosomal dominant 31; Retinitis pigmentosa 39; Breast cancer, early-onset; May-Hegglin anomaly; Gaucher disease type 1 and Subacute neuronopathic; Temtamy syndrome; Spinal muscular atrophy, lower extremity predominant 2, autosomal dominant; Fanconi anemia, complementation group E, I, N, and O; Alkaptonuria; Hirschsprung disease; Combined malonic and methylmalonic acidaria; Arrhythmogenie right ventricular cardiomyopathy types 5, 8, and 10; Congenital lipomatous overgrowth, vascular malformations, and epidermal nevi; Timothy syndrome; Deficiency of guanidinoacetate methyltransferase; Myoclonic dystonia; Kanzaki disease; Neutral 1 amino acid transport defect; Neurohypophyseal diabetes insipidus; Thyroid hormone metabolism, abnormal; Benigo scapuloperoneal muscular dystrophy with cardiomyopathy; Hypoglycemia with deficiency of glycogen synthetase in the liver; Hypertrophic cardiomyopathy; Myasthenic Syndrome, Congenital, 11, associated with acetylcholine receptor deficiency; Mental retardation X-linked syndromic 5; Stormorken syndrome; Aplastic anemia; Intellectual disability; Normokalemic periodic paralysis, potassium-sensitive; Danon disease; Nephronophthisis 13, 15 and 4; Thyrotoxic periodic paralysis and Thyrotoxic periodic paralysis 2; Infertility associated with multi-tailed spermatozoa and excessive DNA; Glaucoma, primary open angle, juvenile-onset; Afibrinogenemia and congenital Afibrinogenemia; Polycystic kidney disease 2, adult type, and infantile type; Familial porphyria cutanea tarda; Cerebello-oculo-renal syndrome (nephronophthisis, oculomotor apraxia and cerebellar abnormalities); Frontotemporal Dementia Chromosome 3-Linked and Frontotemporal dementia ubiquitin-positive; Metatrophic dysplasia; Immunodeficiency-centromeric instability-facial anomalies syndrome 2; Anemia, nonspherocytic hemolytic, due to G6PD deficiency; Bronchicctasis with or without elevated sweat chloride 3; Congenital myopathy with fiber type disproportion; Carney complex, type 1; Cryptorchidism, unilateral or bilateral; Ichthyosis bullosa of Siemens; Isolated lutropin deficiency; DFNA 2 Nonsyndromic Hearing Loss; Klein-Waardenberg syndrome; Gray platelet syndrome; Bile acid synthesis defect, congenital, 2; 46, XY sex reversal, type 1, 3, and 5; Acute intermittent porphyria; Cornelia de Fange syndromes I and 5; Hyperglycinuria; Cone-rod dystrophy 3; Dysfibrinogenemia; Karak syndrome; Congenital muscular dystrophy-dystroglycanopathy without mental retardation, type B5; Infantile nystagmus, X-linked; Dyskeratosis congenita, autosomal recessive, 1, 3, 4, and 5; Microcephaly with or without chorioretinopathy, lymphedema, or mental retardation; Hyperlysinemia; Bardet-Biedl syndromes 1, 11, 16, and 19; Autosomal recessive centronuclear myopathy; Frasier syndrome; Caudal regression syndrome; Fibrosis of extraocular muscles, congenital, 1, 2, 3a (with or without extraocular involvement), 3b; Prader-Willi-like syndrome; Malignant melanoma; Bloom syndrome; Darier disease, segmental; Multicentric osteolysis nephropathy; Hemochromatosis type 1, 2B, and 3; Cerebellar ataxia infantile with progressive external ophthalmoplegi and Cerebellar ataxia, mental retardation, and dysequilibrium syndrome 2; Hypoplastic left heart syndrome; Epilepsy, Hearing Loss, And Mental Retardation Syndrome; Transferrin serum level quantitative trait locus 2; Ocular albinism, type I; Marfan syndrome; Congenital muscular dystrophy-dystroglycanopathy with brain and eye anomalies, type A14 and B14; Hyperammonemia, type III; Cryptophthalmos syndrome; Alopecia universalis congenital; Adult hypophosphatasia; Mannose-binding protein deficiency; Bull eye macular dystrophy; Autosomal dominant torsion dystonia 4; Nephrotic syndrome, type 3, type 5, with or without ocular abnormalities, type 7, and type 9; Seizures, Early infantile epileptic encephalopathy 7; Persistent hyperinsulinemic hypoglycemia of infancy; Thrombocytopenia, X-linked; Neonatal hypotonia; Orstavik Lindemann Solberg syndrome; Pulmonary hypertension, primary, 1, with hereditary hemorrhagic telangiectasia; Pituitary dependent hypercortisolism; Epidermodysplasia verruciformis; Epidermolysis bullosa, junctional, localisata variant; Cytochrome c oxidase i deficiency; Kindler syndrome; Myosclerosis, autosomal recessive; Truncus arteriosus; Duane syndrome type 2; ADULT syndrome; Zellweger syndrome spectrum; Leukoencephalopathy with ataxia, with Brainstem and Spinal Cord Involvement and Lactate Elevation, with vanishing white matter, and progressive, with ovarian failure; Antithrombin III deficiency; Holoprosencephaly 7; Roberts-SC phocomelia syndrome; Mitochondrial DNA-depletion syndrome 3 and 7, hepatocerebral types, and 13 (encephalomyopathic type); Porencephaly 2: Microcephaly, normal intelligence and immunodeficiency; Giant axonal neuropathy; Sturge-Weber syndrome, Capillary malformations, congenital. 1; Fabry disease and Fabry disease, cardiac variant; Glutamate formiminotransferase deficiency; Fanconi-Bickel syndrome; Acromicric dysplasia; Epilepsy, idiopathic generalized, susceptibility to, 12; Basal ganglia calcification, idiopathic, 4; Polyglucosan body myopathy 1 with or without immunodeficiency; Malignant tumor of prostate; Congenital ectodermal dysplasia of face; Congenital heart disease; Age-related macular degeneration 3, 6, 11, and 12; Congenital myotonia, autosomal dominant and recessive forms; Hypomagnesemia 1, intestinal; Sulfite oxidase deficiency, isolated; Pick disease; Plasminogen deficiency, type I; Syndactyly type 3; Cone-rod dystrophy amelogenesis imperfecta; Pseudoprimary hyperaldosteronism; Terminal osseous dysplasia; Bartter syndrome antenatal type 2; Congenital muscular dystrophy-dystroglycanopathy with mental retardation, types B2, B3, B5, and B15; Familial infantile myasthenia; Lymphoproliferative syndrome 1, 1 (X-linked), and 2; Hypercholesterolaemia and Hypercholesterolemia, autosomal recessive; Neoplasm of ovary; Infantile GMI gangliosidosis; Syndromic X-linked mental retardation 16; Deficiency of ribose-5-phosphate isomerase; Alzheimer disease, types, 1, 3, and 4; Andersen Tawil syndrome; Multiple synostoses syndrome 3; Chilbain lupus 1; Hemophagocytic lymphohistiocytosis, familial, 2; Axenfeld-Rieger syndrome type 3; Myopathy, congenital with cores; Osteoarthritis with mild chondrodysplasia; Peroxisome biogenesis disorders; Severe congenital neutropenia; Hereditary neuralgic amyotrophy; Palmoplantar keratoderma, nonepidermolytie, focal or diffuse; Dysplasminogenemia; Familial colorectal cancer; Spastic ataxia 5, autosomal recessive, Charlevoix-Saguenay type, 1, 10, or 11, autosomal recessive; Frontometaphyseal dysplasia land 3; Hereditary factors II, IX, VIII deficiency disease; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Ichthyosis prematurity syndrome; Stickler syndrome type 1; Focal segmental glomerulosclerosis 5; 5-Oxoprolinase deficiency; Microphthalmia syndromic 5, 7, and 9; Juvenile polyposis/hereditary hemorrhagic telangiectasia syndrome; Deficiency of butyryl-CoA dehydrogenase; Maturity-onset diabetes of the young, type 2; Mental retardation, syndromic, Claes-Jensen type, X-linked: Deafness, cochlear, with myopia and intellectual impairment, without vestibular involvement, autosomal dominant, X-linked 2; Spondylocarpotarsal synostosis syndrome; Sting-associated vasculopathy, infantile-onset; Neutral lipid storage disease with myopathy: Immune dysfunction with T-cell inactivation due to calcium entry defect 2; Cardiofaciocutaneous syndrome; Corticosterone methyloxidase type 2 deficiency; Hereditary myopathy with early respiratory failure; Interstitial nephritis, karyomegalie; Trimethylaminuria; Hyperimmunoglobulin D with periodic fever; Malignant hyperthermia susceptibility type 1; Trichomegaly with mental retardation, dwarfism and pigmentary degeneration of retina; Breast adenocarcinoma; Complement factor B deficiency; Ullrich congenital muscular dystrophy: Left ventricular noncompaction cardiomyopathy; Fish-eye disease; Finnish congenital nephrotie syndrome; Limb-girdle muscular dystrophy, type IB, 2A, 2B, 2D, C1, C5, C9, C14; Idiopathic fibrosing alveolitis, chronic form; Primary familial hypertrophic cardiomyopathy; Angiotensin i-converting enzyme, benign serum increase; Cd8 deficiency, familial; Proteus syndrome; Glucose-6-phosphate transport defect; Borjeson-Forssman-Lehmann syndrome; Zellweger syndrome; Spinal muscular atrophy, type II; Prostate cancer, hereditary, 2; Thrombocytopenia, platelet dysfunction, hemolysis, and imbalanced globin synthesis; Congenital disorder of glycosylation types 1B, 1D, 1G, 1H, 1J, 1K, 1N, 1P, 2C, 2J, 2K, Ilm; Junctional epidermolysis bullosa gravis of Herlitz; Generalized epilepsy with febrile seizures plus 3, type 1, type 2: Schizophrenia 4; Coronary artery disease, autosomal dominant 2; Dyskeratosis congenita, autosomal dominant. 2 and 5; Subcortical laminar heterotopia, X-linked: Adenylate kinase deficiency; X-linked severe combined immunodeficiency; Coproporphyria; Amyloid Cardiomyopathy, Transthyretin-related; Hypocalcemia, autosomal dominant 1; Brugada syndrome: Congenital myasthenic syndrome, acetazolamide-responsive; Primary hypomagnesemia: Sclerosteosis: Frontotemporal dementia and/or amyotrophic lateral sclerosis 3 and 4; Mevalonic aciduria; Schwannomatosis 2; Hereditary motor and sensory neuropathy with optic atrophy; Porphyria cutanea tarda; Osteochondritis dissecans; Seizures, benign familial neonatal, 1, and/or myokymia; Long QT syndrome, LQT1 subtype; Mental retardation, anterior maxillary protrusion, and strabismus; Idiopathic hypercalcemia of infancy; Hypogonadotropic hypogonadism 11 with or without anosmia; Polycystic lipomembranous osteodysplasia with sclerosing leukoencephalopathy; Primary autosomal recessive microcephaly 10, 2, 3, and 5; Interrupted aortic arch; Congenital amegakaryocytic thrombocytopenia; Hermansky-Pudlak syndrome 1, 3, 4, and 6; Long QT syndrome 1, 2, 2/9, 2/5. (digenic), 3, 5 and 5, acquired, susceptibility to; Andermann syndrome; Retinal cone dystrophy 3B; Erythropoietic protoporphyria; Sepiapterin reductase deficiency; Very long chain acyl-CoA dehydrogenase deficiency; Hyperferritinemia cataract syndrome; Silver spastic paraplegia syndrome; Charcot-Marie-Tooth disease; Atrial septal defect 2; Carnevale syndrome; Hereditary insensitivity to pain with anhidrosis; Catecholaminergic polymorphic ventricular tachycardia; Hypokalemic periodic paralysis 1 and 2; Sudden infant death syndrome; Hypochromic microcytic anemia with iron overload; GLUT1 deficiency syndrome 2; Leukodystrophy, Hypomyelinating, 11 and 6; Cone monochromatism; Osteopetrosis autosomal dominant type 1 and 2, recessive 4, recessive 1, recessive 6; Severe congenital neutropenia 3, autosomal recessive or dominant; Methionine adenosyltransferase deficiency, autosomal dominant; Paroxysmal familial ventricular fibrillation; Pyruvate kinase deficiency of red cells; Schneckenbecken dysplasia; Torsades de pointes; Distal myopathy Markesbery-Griggs type; Deficiency of UDPglucose-hexose-1-phosphate uridylyltransferase; Sudden cardiac death; Neu-Laxova syndrome 1; Atransferrinemia; Hyperparathyroidism 1 and 2; Cutaneous malignant melanoma 1; Symphalangism, proximal, 1b; Progressive pseudorheumatoid dysplasia; Werdnig-Hoffmann disease; Achondrogenesis type 2; Holoprosencephaly 2, 3, 7, and 9; Schindler disease, type 1; Cerebroretinal microangiopathy with calcifications and cysts; Heterotaxy, visceral, X-linked; Tuberous sclerosis syndrome; Kartagener syndrome; Thyroid hormone resistance, generalized, autosomal dominant; Bestrophinopathy, autosomal recessive; Nail disorder, nonsyndromic congenital, 8; Mohr-Tranebjaerg syndrome; Cone-rod dystrophy 12; Hearing impairment; Ovarioleukodystrophy; Renal tubular acidosis, proximal, with ocular abnormalities and mental retardation; Dihydropteridine reductase deficiency; Focal epilepsy with speech disorder with or without mental retardation; Ataxia-telangiectasia syndrome; Brown-Vialetto-Van laere syndrome and Brown-Vialetto-Van Laere syndrome 2; Cardiomyopathy; Peripheral demyelinating neuropathy, central dysmyelination; Comeal dystrophy, Fuchs endothelial, 4; Cowden syndrome 3; Dystonia 2 (torsion, autosomal recessive), 3 (torsion, X-linked), 5 (Dopa-responsive type), 10, 12, 16, 25, 26 (Myoclonic); Epiphyseal dysplasia, multiple, with myopia and conductive deafness; Cardiac conduction defect, nonspecific; Branchiootic syndromes 2 and 3; Peroxisome biogenesis disorder 14B, 2A, 4A, 5B, 6A, 7A, and 7B; Familial renal glucosuria; Candidiasis, familial, 2, 5, 6, and 8; Autoimmune disease, multisystem, infantile-onset; Early infantile epileptic encephalopathy 2, 4, 7, 9, 10, 11, 13, and 14; Segawa syndrome, autosomal recessive; Deafness, autosomal dominant 33, 4, 12, 13, 15, autosomal dominant nonsyndromic sensorineural 17, 20, and 65; Congenital dyserythropoietic anemia, type I and II; Enhanced s-cone syndrome; Adult neuronal ceroid lipofuscinosis; Atrial fibrillation, familial, 11, 12, 13, and 16; Norum disease; Osteosarcoma; Partial albinism; Biotinidase deficiency; Combined cellular and humoral immune defects with granulomas; Alpers encephalopathy; Holocarboxylase synthetase deficiency; Maturity-onset diabetes of the young, type 1, type 2, type 11, type 3, and type 9; Variegate porphyria; Infantile cortical hyperostosis; Testosterone 17-beta-dehydrogenase deficiency; L-2-hydroxyglutaric aciduria; Tyrosinase-negative oculocutaneous albinism; Primary ciliary dyskinesia 24; Pontocerebellar hypoplasia type 4; Ciliary dyskinesia, primary, 7, 11, 15, 20 and 22; Idiopathic basal ganglia calcification 5; Brain atrophy; Craniosynostosis 1 and 4; Keratoconus 1; Rasopathy; Congenital adrenal hyperplasia and Congenital adrenal hypoplasia, X-linked; Mitochondrial DNA depletion syndrome 11, 12 (cardiomyopathie type). 2, 4B (MNGIE type), 8B (MNGIE type); Brachydactyly with hypertension; Cornea plana 2; Aarskog syndrome; Multiple epiphyseal dysplasia 5 or Dominant; Comeal endothelial dystrophy type 2; Aminoacylase I deficiency; Delayed speech and language development; Nicolaides-Baraitser syndrome; Enterokinase deficiency; Ectrodactyly, ectodermal dysplasia, and cleft lip/palate syndrome 3; Arthrogryposis multiplex congenita, distal, X-linked; Perrault syndrome 4; Jervell and Lange-Nielsen syndrome 2; Hereditary Nonpolyposis Colorectal Neoplasms; Robinow syndrome, autosomal recessive, autosomal recessive, with brachy-syn-polydactyly; Neurofibrosarcoma; Cytochrome-c oxidase deficiency; Vesicoureteral reflux 8; Dopamine beta hydroxylase deficiency; Carbohydrate-deficient glycoprotein syndrome type I and II; Progressive familial intrahepatic cholestasis 3; Benign familial neonatal-infantile seizures; Pancreatitis, chronic, susceptibility to; Rhizomelic chondrodysplasia punctata type 2 and type 3; Disordered steroidogenesis due to cytochrome p450 oxidoreductase deficiency;

Deafness with labyrinthine aplasia microtia and microdontia (FAMM); Rothmund-Thomson syndrome; Cortical dysplasia, complex, with other brain malformations 5 and 6; Myasthenia, familial infantile, 1; Trichorhinophalangeal dysplasia type I; Worth disease; Splenic hypoplasia; Molybdenum cofactor deficiency, complementation group A; Sebastian syndrome; Progressive familial intrahepatic cholestasis 2 and 3; Weill-Marchesani syndrome 1 and 3; Microcephalic osteodysplastic primordial dwarfism type 2; Surfactant metabolism dysfunction, pulmonary, 2 and 3; Severe X-linked myotubular myopathy; Pancreatic cancer 3; Platelet-type bleeding disorder 15 and 8; Tyrosinase-positive oculocutaneous albinism; Borrone Di Rocco Crovato syndrome; ATR-X syndrome; Sucrase-isomaltase deficiency; Complement component 4, partial deficiency of, due to dysfunctional c1 inhibitor; Congenital central hypoventilation; Infantile hypophosphatasia; Plasminogen activator inhibitor type 1 deficiency; Malignant lymphoma, non-Hodgkin; Hyperornithinemia-hyperammonemia-homocitrullinuria syndrome; Schwartz Jampel syndrome type 1; Fetal hemoglobin quantitative trait locus 1; Myopathy, distal, with anterior tibial onset; Noonan syndrome 1 and 4, LEOPARD syndrome 1; Glaucoma 1, open angle, e, F, and G; Kenny-Caffey syndrome type 2; PTEN hamartoma tumor syndrome; Duchenne muscular dystrophy; Insulin-resistant diabetes mellitus and acanthosis nigricans; Microphthalmia, isolated 3, 5, 6, 8, and with coloboma 6; Raine syndrome; Premature ovarian failure 4, 5, 7, and 9; Allan-Hemdon-Dudley syndrome; Citrullinemia type I; Alzheimer disease, familial, 3, with spastic paraparesis and apraxia; Familial hemiplegic migraine types 1 and 2; Ventriculomegaly with cystic kidney disease; Pseudoxanthoma elasticum; Homocysteinemia due to MTHFR deficiency, CBS deficiency, and Homocystinuria, pyridoxine-responsive; Dilated cardiomyopathy 1A, 1AA, 1C, 1G, 1BB, 1DD, 1FF, 1HH, 1I, 1KK, 1N, 1S, 1Y, and 3B; Muscle AMP guanine oxidase deficiency; Familial cancer of breast; Hereditary sideroblastic anemia; Myoglobinuria, acute recurrent, autosomal recessive; Neuroferritinopathy; Cardiac arrhythmia; Glucose transporter type 1 deficiency syndrome; Holoprosencephaly sequence; Angiopathy, hereditary, with nephropathy, aneurysms, and muscle cramps; Isovaleryl-CoA dehydrogenase deficiency; Kallmann syndrome 1, 2, and 6; Permanent neonatal diabetes mellitus; Acrocallosal syndrome, Schinzel type; Gordon syndrome; MYH9 related disorders; Donnai Barrow syndrome; Severe congenital neutropenia and 6, autosomal recessive; Charcot-Marie-Tooth disease, types ID and IVF; Coffin-Lowry syndrome; mitochondrial 3-hydroxy-3-methylglutaryl-CoA synthase deficiency; Hypomagnesemia, seizures, and mental retardation; Ischiopatellar dysplasia; Multiple congenital anomalies-hypotonia-seizures syndrome 3; Spastic paraplegia 50, autosomal recessive; Short stature with nonspecific skeletal abnormalities; Severe myoclonic epilepsy in infancy; Propionic academia; Adolescent nephronophthisis; Macrocephaly, macrosomia, facial dysmorphism syndrome; Stargardt disease 4; Ehlers-Danlos syndrome type 7 (autosomal recessive), classic type, type 2 (progeroid), hydroxylysine-deficient, type 4, type 4 variant, and due to tenascin-X deficiency; Myopia 6; Coxa plana; Familial cold autoinflammatory syndrome 2; Malformation of the heart and great vessels; von Willebrand disease type 2M and type 3; Deficiency of galactokinase; Brugada syndrome 1; X-linked ichthyosis with steryl sulfatase deficiency; Congenital ocular coloboma; Histiocytosis-lymphadenopathy plus syndrome; Aniridia, cerebellar ataxia, and mental retardation; Left ventricular noncompaction 3; Amyotrophic lateral sclerosis types 1, 6, 15 (with or without frontotemporal dementia), 22 (with or without frontotemporal dementia), and 10; Osteogenesis imperfecta type 12, type 5, type 7, type 8, type I, type III, with normal sclerae, dominant form, recessive perinatal lethal; Hematologic neoplasm; Favism, susceptibility to; Pulmonary Fibrosis And/Or Bone Marrow Failure, Telomere-Related, 1 and 3; Dominant hereditary optic atrophy; Dominant dystrophic epidermolysis bullosa with absence of skin; Muscular dystrophy, congenital, megaconial type; Multiple gastrointestinal atresias; McCune-Albright syndrome; Nail-patella syndrome; McLeod neuroacanthocytosis syndrome; Common variable immunodeficiency 9; Partial hypoxanthine-guanine phosphoribosyltransferase deficiency; Pseudohypoaldosteronism type 1 autosomal dominant and recessive and type 2; Urocanate hydratase deficiency; Heterotopia; Meckel syndrome type 7; Ch\xc3\xa9diak-Higashi syndrome, Chediak-Higashi syndrome, adult type; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Insulin resistance; Deficiency of steroid 11-beta-monooxygenase; Popliteal pterygium syndrome; Pulmonary arterial hypertension related to hereditary hemorrhagic telangiectasia; Deafness, autosomal recessive IA, 2, 3, 6, 8, 9, 12, 15, 16, 18b, 22, 28, 31, 44, 49, 63, 77, 86, and 89; Primary hyperoxaluria, type I, type, and type III; Paramyotonia congenita of von Eulenburg; Desbuquois syndrome; Carnitine palmitoyltransferase I, II, II (late onset), and II (infantile) deficiency; Secondary hypothyroidism; Mandibulofacial dysostosis, Treacher Collins type, autosomal recessive; Cowden syndrome 1; Li-Fraumeni syndrome 1; Asparagine synthetase deficiency; Malattia leventinese; Optic atrophy 9; Infantile convulsions and paroxysmal choreoathetosis, familial; Ataxia with vitamin E deficiency; Islet cell hyperplasia; Miyoshi muscular dystrophy 1; Thrombophilia, hereditary, due to protein C deficiency, autosomal dominant and recessive; Fechter syndrome; Properdin deficiency, X-linked; Mental retardation, stereotypic movements, epilepsy, and/or cerebral malformations; Creatine deficiency. X-linked; Pilomatrixoma; Cyanosis, transient neonatal and atypical nephropathic; Adult onset ataxia with oculomotor apraxia; Hemangioma, capillary infantile; PC-K6a; Generalized dominant dystrophic epidermolysis bullosa; Pelizaeus-Merzbacher disease; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Benign familial neonatal seizures 1 and 2; Primary pulmonary hypertension; Lymphedema, primary, with myelodysplasia; Congenital long QT syndrome; Familial exudative vitreoretinopathy, X-linked; Autosomal dominant hypohidrotie ectodermal dysplasia; Primordial dwarfism; Familial pulmonary capillary hemangiomatosis; Carnitine acylcamitine translocase deficiency; Visceral myopathy; Familial Mediterranean fever and Familial mediterranean fever, autosomal dominant; Combined partial and complete 17-alpha-hydroxylase/17, 20-lyase deficiency; Oto-palato-digital syndrome, type I; Nephrolithiasis/osteoporosis, bypophosphatemic, 2; Familial type 1 and 3 hyperlipoproteinemia; Phenotypes; CHARGE association; Fuhrmann syndrome; Hypotrichosis-lymphedema-telangiectasia syndrome; Chondrodysplasia Blomstrand type; Acroerythrokeratoderma; Slowed nerve conduction velocity, autosomal dominant; Hereditary cancer-predisposing syndrome; Craniodiaphyseal dysplasia, autosomal dominant; Spinocerebellar ataxia autosomal recessive 1 and 16; Proprotein convertase 1/3 deficiency; D-2-hydroxyglutaric aciduria 2; Hyperekplexia 2 and Hyperekplexia hereditary; Central core disease; Opitz G/BBB syndrome; Cystic fibrosis; Thiel-Behnke comeal dystrophy; Deficiency of bisphosphoglycerate mutase; Mitochondrial short-chain Enoyl-CoA Hydratase 1 deficiency; Ectodermal dysplasia skin fragility syndrome; Wolfram-like syndrome, autosomal dominant; Microcytic anemia; Pyruvate carboxylase deficiency; Leukocyte adhesion deficiency type I and III; Multiple endocrine neoplasia, types land 4; Transient bullous dermolysis of the newborn; Primrose syndrome; Non-small cell lung cancer; Congenital muscular dystrophy; Lipase deficiency combined; COLE-CARPENTER SYNDROME 2; Atrioventricular septal defect and common atrioventricular junction; Deficiency of xanthine oxidase; Waardenburg syndrome type 1, 4C, and 2E (with neurologic involvement); Stickler syndrome, types I (nonsyndromic ocular) and 4; Comeal fragility keratoglobus, blue sclerae and joint hypermobility; Microspherophakia; Chudley-McCullough syndrome; Epidermolysa bullosa simplex and limb girdle muscular dystrophy, simplex with mottled pigmentation, simplex with pyloric atresia, simplex, autosomal recessive, and with pyloric atresia; Rett disorder; Abnormality of neuronal migration; Growth hormone deficiency with pituitary anomalies; Leigh disease; Keratosis palmoplantaris striata 1; Weissenbacher-Zweymuller syndrome; Medium-chain acyl-coenzyme A dehydrogenase deficiency; UDPglucose-4-epimerase deficiency; susceptibility to Autism, X-linked 3; Rhegmatogenous retinal detachment, autosomal dominant; Familial febrile seizures 8; Ulna and fibula absence of with severe limb deficiency; Left ventricular noncompaction 6; Centromeric instability of chromosomes 1, 9 and 16 and immunodeficiency; Hereditary diffuse leukoencephalopathy with spheroids; Cushing syndrome; Dopamine receptor d2, reduced brain density of; C-like syndrome; Renal dysplasia, retinal pigmentary dystrophy, cerebellar ataxia and skeletal dysplasia; Ovarian dysgenesis 1; Pierson syndrome; Polyneuropathy, hearing loss, ataxia, retinitis pigmentosa, and cataract; Progressive intrahepatic cholestasis; autosomal dominant, autosomal recessive, and X-linked recessive Alport syndromes; Angelman syndrome; Amish infantile epilepsy syndrome; Autoimmune lymphoproliferative syndrome, type 1a; Hydrocephalus; Marfanoid habitus; Bare lymphocyte syndrome type 2, complementation group E; Recessive dystrophic epidermolysis bullosa; Factor H, VII, X, v and factor viii, combined deficiency of 2, xiii, a subunit, deficiency; Zonular pulverulent cataract 3; Warts, hypogammaglobulinemia, infections, and myelokathexis; Benign hereditary chorea; Deficiency of hyaluronoglucosaminidase; Microcephaly, hiatal hernia and nephrotic syndrome; Growth and mental retardation, mandibulofacial dysostosis, microcephaly, and cleft palate; Lymphedema, hereditary, id; Delayed puberty; Apparent mineralocorticoid excess; Generalized arterial calcification of infancy 2; METHYLMALONIC ACIDURIA, mut (0) TYPE; Congenital heart disease, multiple types, 2; Familial hypoplastic, glomerulocystic kidney; Cerebrooculofacioskeletal syndrome 2; Stargardt disease 1; Mental retardation, autosomal recessive 15, 44, 46, and 5; Prolidase deficiency; Methylmalonic aciduria cblB type; Oguchi disease; Endocrine-cerebroosteodysplasia; Lissencephaly 1, 2 (X-linked). 3, 6 (with microcephaly), X-linked; Somatotroph adenoma; Gamstorp-Wohlfart syndrome; Lipid proteinosis; Inclusion body myopathy 2 and 3; Enlarged vestibular aqueduct syndrome; Osteoporosis with pseudoglioma; Acquired long QT syndrome; Phenylketonuria; CHOPS syndrome; Global developmental delay; Bietti crystalline corneoretinal dystrophy; Noonan syndrome-like disorder with or without juvenile myelomonocytic leukemia; Congenital erythropoietic porphyria; Atrophia bulborum hereditaria; Paragangliomas 3; Van der Woude syndrome; Aromatase deficiency; Birk Barel mental retardation dysmorphism syndrome; Amyotrophic lateral sclerosis type 5; Methemoglobinemia types I 1 and 2; Congenital stationary night blindness, type 1A, 1B, 1C, 1E, 1F, and 2A; Seizures; Thyroid cancer, follicular; Lethal congenital contracture syndrome 6; Distal hereditary motor neuronopathy type 2B; Sex cord-stromal tumor; Epileptic encephalopathy, childhood-onset, early infantile, 1, 19, 23, 25, 30, and 32; Myofibrillar myopathy 1 and ZASP-related; Cerebellar ataxia infantile with progressive external ophthalmoplegia; Purine-nucleoside phosphorylase deficiency; Forebrain defects; Epileptic encephalopathy Lennox-Gastaut type; Obesity; 4, Left ventricular noncompaction 10; Verheij syndrome; Mowat-Wilson syndrome; Odontotrichomelic syndrome; Patterned dystrophy of retinal pigment epithelium; Lig4 syndrome; Barakat syndrome; IRAK4 deficiency; Somatotroph adenoma; Branched-chain ketoacid dehydrogenase kinase deficiency; Cystinuria; Familial aplasia of the vermis; Succinyl-CoA acetoacetate transferase deficiency; Scapuloperoneal spinal muscular atrophy; Pigmentary retinal dystrophy; Glanzmann thrombasthenia; Primary open angle glaucoma juvenile onset 1; Aicardi Goutieres syndromes 1, 4, and 5; Renal dysplasia; Intrauterine growth retardation, metaphyseal dysplasia, adrenal hypoplasia congenita, and genital anomalies; Beaded hair; Short stature, onychodysplasia, facial dysmorphism, and hypotrichosis; Metachromatic leukodystrophy; Cholestanol storage disease; Three M syndrome 2; Leber congenital amaurosis 11, 12, 13, 16, 4, 7, and 9; Mandibuloacral dysplasia with type A or B lipodystrophy, atypical; Meier-Gorlin syndromes land 4; Hypotrichosis 8 and 12; Short QT syndrome 3; Ectodermal dysplasia 1 ib; Anonychia; Pseudohypoparathyroidism type 1A, Pseudopseudohypoparathyroidism; Leber optic atrophy; Bainbridge-Ropers syndrome; Weaver syndrome; Short stature, auditory canal atresia, mandibular hypoplasia, skeletal abnormalities; Deficiency of alpha-mannosidase; Macular dystrophy, vitelliform, adult-onset; Glutaric aciduria, type 1; Gangliosidosis GMI type1 (with cardiac involvement) 3; Mandibuloacral dysostosis; Hereditary lymphedema type I; Atrial standstill 2; Kabuki make-up syndrome; Bethlem myopathy and Bethlem myopathy 2; Myeloperoxidase deficiency; Fleck comeal dystrophy; Hereditary acrodermatitis enteropathica; Hypobetalipoproteinemia, familial, associated with apob32; Cockayne syndrome type A; Hyperparathyroidism, neonatal severe; Ataxia-telangiectasia-like disorder; Pendred syndrome; I blood group system; Familial benign pemphigus; Visceral heterotaxy 5, autosomal; Nephrogenic diabetes insipidus, Nephrogenic diabetes insipidus, X-linked; Minicore myopathy with external ophthalmoplegia; Perry syndrome; bypohidrotic/hair/tooth type, autosomal recessive; Hereditary pancreatitis; Mental retardation and microcephaly with pontine and cerebellar hypoplasia; Glycogen storage disease 0 (muscle), II (adult form), IXa2, IXe, type 1A; Osteopathia striata with cranial sclerosis; Gluthathione synthetase deficiency; Brugada syndrome and Brugada syndrome 4; Endometrial carcinoma; Hypohidrotie ectodermal dysplasia with immune deficiency; Cholestasis, intrahepatic, of pregnancy 3; Bemard-Soulier syndrome, types A1 and A2 (autosomal dominant); Salla disease; Ornithine aminotransferase deficiency; PTEN hamartoma tumor syndrome; Distichiasis-lymphedema syndrome; Corticosteroid-binding globulin deficiency; Adult neuronal ceroid lipofuscinosis; Dejerine-Sottas disease; Tetraamelia, autosomal recessive; Senior-Loken syndrome 4 and 5; Glutarie acidemia IIA and IIB; Aortic ancurysm, familial thoracic 4, 6, and 9; Hyperphosphatasia with mental retardation syndrome 2, 3, and 4; Dyskeratosis congenita X-linked; Arthrogryposis, renal dysfunction, and cholestasis 2; Bannayan-Riley-Ruvalcaba syndrome; 3-Methylglutaconic aciduria; Isolated 17,20-lyase deficiency; Gorlin syndrome; Hand foot uterus syndrome; Tay-Sachs disease, B1 variant, Gm2-gangliosidosis (adult), Gm2-gangliosidosis (adult-onset); Dowling-degos disease 4; Parkinson disease 14, 15, 19 (juvenile-onset), 2, 20 (early-onset), 6, (autosomal recessive early-onset, and 9; Ataxia, sensory, autosomal dominant; Congenital microvillous atrophy; Myoclonic-Atonic Epilepsy; Tangier disease; 2-methyl-3-hydroxybutyric aciduria; Familial renal hypouricemia; Schizencephaly; Mitochondrial DNA depletion syndrome 4B, MNGIE type; Feingold syndrome 1; Renal carnitine transport defect; Familial hypercholesterolemia; Townes-Brocks-branchiootorenal-like syndrome; Griscelli syndrome type 3; Meckel-Gruber syndrome; Bullous ichthyosiform erythroderma; Neutrophil immunodeficiency syndrome; Myasthenic Syndrome. Congenital, 17, 2A (slow-channel), 4B (fast-channel), and without tubular aggregates; Microvascular complications of diabetes 7; McKusick Kaufman syndrome; Chronic granulomatous disease, autosomal recessive cytochrome b-positive, types 1 and 2; Arginino succinate lyase deficiency; Mitochondrial phosphate carrier and pyruvate carrier deficiency; Lattice corneal dystrophy Type III; Ectodermal dysplasia-syndactyly syndrome 1; Hypomyelinating leukodystrophy 7; Mental retardation, autosomal dominant 12, 13, 15, 24, 3, 30, 4, 5, 6, and 9; Generalized epilepsy with febrile seizures plus, types 1 and 2; Psoriasis susceptibility 2; Frank Ter Haar syndrome; Thoracic aortic aneurysms and aortic dissections; Crouzon syndrome; Granulosa cell tumor of the ovary; Epidermolytic palmoplantar keratoderma; Leri Weill dyschondrosteosis; 3 beta-Hydroxysteroid dehydrogenase deficiency; Familial restrictive cardiomyopathy 1; Autosomal dominant progressive external ophthalmoplegia with mitochondrial DNA deletions 1 and 3; Antley-Bixler syndrome with genital anomalies and disordered steroidogenesis; Hajdu-Cheney syndrome; Pigmented nodular adrenocortical disease, primary. 1; Episodic pain syndrome, familial, 3; Dejerine-Sottas syndrome, autosomal dominant; FG syndrome and FG syndrome 4; Dendritic cell, monocyte, B lymphocyte, and natural killer lymphocyte deficiency; Hypothyroidism, congenital, nongoitrous, 1; Miller syndrome; Nemaline myopathy 3 and 9; Oligodontia-colorectal cancer syndrome; Cold-induced sweating syndrome 1; Van Buchem disease type 2; Glaucoma 3, primary congenital, d; Citrullinemia type I and II; Nonaka myopathy; Congenital muscular dystrophy due to partial LAMA2 deficiency; Myoneural gastrointestinal encephalopathy syndrome; Leigh syndrome due to mitochondrial complex I deficiency; Medulloblastoma; Pyruvate dehydrogenase El-alpha deficiency; Carcinoma of colon; Nance-Horan syndrome; Sandhoff disease, adult and infantil types; Arthrogryposis renal dysfunction cholestasis syndrome; Autosomal recessive hypophosphatemic bone disease; Doyne honeycomb retinal dystrophy; Spinocerebellar ataxia 14, 21, 35, 40, and 6; Lewy body dementia; RRM2B-related mitochondrial disease; Brody myopathy; Megalencephaly-polymicrogyria-polydactyly-hydrocephalus syndrome 2; Usher syndrome, types 1, 1B, 1D, 1G, 2A, 2C, and 2D; hypocalcification type and hypomaturation type, IIA1 Amelogenesis imperfecta; Pituitary hormone deficiency, combined 1, 2, 3, and 4; Cushing symphalangism; Renal tubular acidosis, distal, autosomal recessive, with late-onset sensorineural hearing loss, or with hemolytic anemia; Infantile nephronophthisis; Juvenile polyposis syndrome; Sensory ataxie neuropathy, dysarthria, and ophthalmoparesis; Deficiency of 3-hydroxyacyl-CoA dehydrogenase; Parathyroid carcinoma; X-linked agammaglobulinemia; Megaloblastie anemia, thiamine-responsive, with diabetes mellitus and sensorineural deafness; Multiple sulfatase deficiency; Neurodegeneration with brain iron accumulation 4 and 6; Cholesterol monooxygenase (side-chain cleaving) deficiency; hemolytic anemia due to Adenylosuccinate lyase deficiency; Myoclonus with epilepsy with ragged red fibers; Pitt-Hopkins syndrome; Multiple pterygium syndrome Escobar type; Homocystinuria-Megaloblastic anemia due to defect in cobalamin metabolism, cblE complementation type; Cholecystitis; Spherocytosis types 4 and 5; Multiple congenital anomalies; Xeroderma pigmentosum, complementation group b, group D, group E, and group G; Leiner disease; Groenouw comeal dystrophy type I; Coenzyme Q10 deficiency, primary 1, 4, and 7; Distal spinal muscular atrophy, congenital nonprogressive; Warburg micro syndrome 2 and 4; Bile acid synthesis defect, congenital, 3; Acth-independent macronodular adrenal hyperplasia 2; Acrocapitofemoral dysplasia; Paget disease of bone, familial; Severe neonatal-onset encephalopathy with microcephaly; Zimmermann-Laband syndrome and Zimmermann-Laband syndrome 2; Reifenstein syndrome; Familial hypokalemia-hypomagnesemia; Photosensitive trichothiodystrophy; Adult junctional epidermolysis bullosa; Lung cancer; Freeman-Sheldon syndrome; Hyperinsulinism-hyperammonemia syndrome; Posterior polar cataract type 2; Sclerocornea, autosomal recessive; Juvenile GM>1<gangliosidosis; Cohen syndrome; Hereditary Paraganglioma-Pheochromocytoma Syndromes; Neonatal insulin-dependent diabetes mellitus; Hypochondrogenesis; Floating-Harbor syndrome; Cutis laxa with osteodystrophy and with severe pulmonary, gastrointestinal, and urinary abnormalities; Congenital contractures of the limbs and face, hypotonia, and developmental delay; Dyskeratosis congenita autosomal dominant and autosomal dominant, 3; Histiocytic medullary reticulosis; Costello syndrome; Immunodeficiency 15, 16, 19, 30, 31C, 38, 40, 8, due to defect in cd3-zeta, with hyper IgM type 1 and 2, and X-Linked, with magnesium defect. Epstein-Barr vims infection, and neoplasia; Atrial septal defects 2, 4, and 7 (with or without atrioventricular conduction defects); GTP cyclohydrolase I deficiency; Talipes equinovarus; Phosphoglycerate kinase 1 deficiency; Tuberous sclerosis 1 and 2; Autosomal recessive congenital ichthyosis 1, 2, 3, 4A, and 4B; and Familial hypertrophic cardiomyopathy 1, 2, 3, 4, 7, 10, 23 and 24.

Indications by Tissue

Additional suitable diseases and disorders that can be treated by the systems and methods provided herein include, without limitation, diseases of the central nervous system (CNS) (see exemplary diseases and affected genes in Table 31), diseases of the eye (see exemplary diseases and affected genes in Table 32), diseases of the heart (see exemplary diseases and affected genes in Table 33), diseases of the hematopoietic stem cells (HSC) (see exemplary diseases and affected genes in Table 34), diseases of the kidney (see exemplary diseases and affected genes in Table 35), diseases of the liver (see exemplary diseases and affected genes in Table 36), diseases of the lung (see exemplary diseases and affected genes in Table 37), diseases of the skeletal muscle (see exemplary diseases and affected genes in Table 38), and diseases of the skin (see exemplary diseases and affected genes in Table 39). Table 40 provides exemplary protective mutations that reduce risks of the indicated diseases. In some embodiments, a GENE WRITER™ system described herein is used to treat an indication of any of Tables 31-39. In some embodiments, the GENE WRITER™ system modifies a target site in genomic DNA in a cell, wherein the target site is in a gene of any of Tables 31-39, e.g., in a subject having the corresponding indication listed in any of Tables 31-39. In some embodiments, the Gene Writer corrects a mutation in the gene. In some embodiments, the Gene Writer inserts a sequence that had been deleted from the gene (e.g., through a disease-causing mutation). In some embodiments, the GeneWriter deletes a sequence that had been duplicated in the gene (e.g., through a disease-causing mutation). In some embodiments, the GeneWriter replaces a mutation (e.g., a disease-causing mutation) with the corresponding wild-type sequence. In some embodiments, the mutation is a substitution, insertion, deletion, or inversion.

TABLE 31

CNS diseases and genes affected.

| Disease | Gene Affected |
|---|---|
| Alpha-mannosidosis | MAN2B1 |
| Ataxia-telangiectasia | ATM |
| CADASIL | NOTCH3 |
| Canavan disease | ASPA |
| Carbamoyl-phosphate synthetase 1 deficiency | CPS1 |
| CLN1 disease | PPT1 |
| CLN2 Disease | TPP1 |
| CLN3 Disease (Juvenile neuronal ceroid lipofuscinosis, Batten Disease) | CLN3 |
| Coffin-Lowry syndrome | RPS6KA3 |
| Congenital myasthenic syndrome 5 | COLQ |
| Cornelia de Lange syndrome (NIPBL) | NIPBL |
| Cornelia de Lange syndrome (SMC1A) | SMC1A |
| Dravet syndrome (SCN1A) | SCN1A |
| Glycine encephalopathy (GLDC) | GLDC |
| GM1 gangliosidosis | GLB1 |
| Huntington's Disease | HTT |
| Hydrocephalus with stenosis of the aqueduct of Sylvius | L1CAM |
| Leigh Syndrome | SURF1 |
| Metachromatic leukodystrophy (ARSA) | ARSA |
| MPS type 2 | IDS |
| MPS type 3 | SGSH |
| Mucolipidosis IV | MCOLN1 |
| Neurofibromatosis Type 1 | NF1 |
| Neurofibromatosis type 2 | NF2 |
| Pantothenate kinase-associated neurodegeneration | PANK2 |
| Pyridoxine-dependent epilepsy | ALDH7A1 |
| Rett syndrome (MECP2) | MECP2 |
| Sandhoff disease | HEXB |
| Semantic dementia (Frontotemporal dementia) | MAPT |
| Spinocerebellar ataxia with axonal neuropathy (Ataxia with Oculomotor Apraxia) | SETX |
| Tay-Sachs disease | HEXA |
| X-linked Adrenoleukodystrophy | ABCD1 |

TABLE 32

Eye diseases and genes affected.

| Disease | Gene Affected |
|---|---|
| Achromatopsia | CNGB3 |
| Amaurosis Congenita (LCA1) | GUCY2D |
| Amaurosis Congenita (LCA10) | CEP290 |
| Amaurosis Congenita (LCA2) | RPE65 |
| Amaurosis Congenita (LCA8) | CRB1 |
| Choroideremia | CHM |
| Cone Rod Dystrophy (ABCA4) | ABCA4 |
| Cone Rod Dystrophy (CRX) | CRX |
| Cone Rod Dystrophy (GUCY2D) | GUCY2D |
| Cystinosis, Ocular Nonnephropathic | CTNS |
| Lattice corneal dystrophy type I | TGFBI |
| Macular Corneal Dystrophy (MCD) | CHST6 |
| Optic Atrophy | OPA1 |
| Retinitis Pigmentosa (AR) | USH2A |
| Retinitis Rigmentosa (AD) | RHO |
| Stargardt Disease | ABCA4 |
| Vitelliform Macular Dystrophy | BEST1; PRPH2 |

TABLE 33

Heart diseases and genes affected.

| Disease | Gene Affected |
|---|---|
| Arrhythmogenic right ventricular cardiomyopathy (ARVC) | PKP2 |
| Barth syndrome | TAZ |
| Becker muscular dystrophy | DMD |
| Brugada syndrome | SCN5A |
| Catecholaminergic polymorphic ventricular tachycardia (RYR2) | RYR2 |
| Dilated cardiomyopathy (LMNA) | LMNA |
| Dilated cardiomyopathy (TTN) | TTN |
| Duchenne muscular dystrophy | DMD |
| Emery-Dreifuss Muscular Dystrophy Type I | EMD |
| Familial hypertrophic cardiomyopathy | MYH7 |
| Familial hypertrophic cardiomyopathy | MYBPC3 |
| Jervell Lange-Nielsen syndrome | KCNQ1 |
| LCHAD deficiency | HADHA |
| Limb-girdle muscular dystrophy type IB (Emery-Dreifuss EDMD2) | LMNA |
| Limb-girdle muscular dystrophy, type 2D | SGCA |
| Long QT syndrome 1 (Romano Ward) | KCNQ1 |

TABLE 34

HSC diseases and genes affected.

| Disease | Gene Affected |
|---|---|
| ADA-SCID | ADA |
| Adrenoleukodystrophy (CALD) | ABCD1 |
| Alpha-mannosidosis | MAN2B1 |
| Chronic granulomatous disease | CYBB; CYBA; NCF1; NCF2; NCF4 |
| Common variable immunodeficiency | TNFRSF13B |
| Fanconi anemia | FANCA; FANCC; FANCG |
| Gaucher disease | GBA |
| Globoid cell leukodystrophy (Krabbe disease) | GALC |
| Hemophagocytic lymphohistiocytosis | PRF1; STX11; STXBP2; UNC13D |
| IL-7R SCID | IL7R |
| JAK-3 SCID | JAK3 |
| Malignant infantile osteopetrosis—autosomal recessive osteopetrosis | TCIRG1; Many genes implicated |
| Metachromatic leukodystrophy | ARSA; PSAP |
| MPS 1S (Scheie syndrome) | IDUA |
| MPS2 | IDS |
| MPS7 | GUSB |
| Mucolipidosis II | GNPTAB |
| Niemann-Pick disease A and B | SMPD1 |
| Niemann-Pick disease C | NPC1 |
| Paroxysmal Nocturnal Hemoglobinuria | PIGA |
| Pompe disease | GAA |
| Pyruvate kinase deficiency (PKD) | PKLR |

TABLE 34-continued

HSC diseases and genes affected.

| Disease | Gene Affected |
|---|---|
| RAG 1/2 Deficiency (SCID with granulomas) | RAG1/RAG2 |
| Severe Congenital Neutropenia | ELANE; HAX1 |
| Sickle cell disease (SCD) | HBB |
| Tay Sachs | HEXA |
| Thalassemia | HBB |
| Wiskott-Aldrich Syndrome | WAS |
| X-linked agammaglobulinemia | BTK |
| X-linked SCID | IL2RG |

TABLE 35

Kidney diseases and genes affected.

| Disease | Gene Affected |
|---|---|
| Alport syndrome | COL4A5 |
| Autosomal dominant polycystic kidney disease (PKD1) | PKD1 |
| Autosomal dominant polycystic kidney disease (PKD2) | PDK2 |
| Autosomal dominant tubulointerstitial kidney disease (MUC1) | MUC1 |
| Autosomal dominant tubulointerstitial kidney disease (UMOD) | UMOD |
| Autosomal recessive polycystic kidney disease | PKHD1 |
| Congenital nephrotic syndrome | NPHS2 |
| Cystinosis | CTNS |

TABLE 36

Liver diseases and genes affected.

| Disease | Gene Affected |
|---|---|
| Acute intermittent porphyria | HMBS |
| Alagille syndrome | JAG1 |
| Alpha-1-antitrypsin deficiency | SERPINA1 |
| Carbamoyl phosphate synthetase I deficiency | CPS1 |
| Citrullinemia I | ASS1 |
| Crigler-Najjar | UGT1A1 |
| Fabry | LPL |
| Familial chylomicronemia syndrome | GLA |
| Gaucher | GBE1 |
| GSD IV | GBA |
| Heme A | F8 |
| Heme B | F9 |
| Hereditary amyloidosis (hTTR) | TTR |
| Hereditary angioedema | SERPING1 (KLKB1 for CRISPR) |
| HoFH | LDLRAP1 |
| Hypercholesterolemia | PCSK9 |
| Methylmalonic acidemia | MMUT |
| MPS II | IDS |
| MPS III | Type IIIa: SGSH<br>Type IIIb: NAGLU<br>Type IIIc: HGSNAT<br>Type IIId: GNS |
| MPS IV | Type IVA: GALNS<br>Type IVB: GLB1 |
| MPS VI | ARSB |
| MSUD | Type Ia: BCKDHA<br>Type Ib: BCKDHB<br>Type II: DBT |
| OTC Deficiency | OTC |
| Polycystic Liver Disease | PRKCSH |
| Pompe | GAA |
| Primary Hyperoxaluria 1 | AGXT (HAO1 or LDHA for CRISPR) |

TABLE 36-continued

Liver diseases and genes affected.

| Disease | Gene Affected |
|---|---|
| Progressive familial intrahepatic cholestasis type 1 | ATP8B1 |
| Progressive familial intrahepatic cholestasis type 2 | ABCB11 |
| Progressive familial intrahepatic cholestasis type 3 | ABCB4 |
| Propionic acidemia | PCCB; PCCA |
| Wilson's Disease | ATP7B |
| Glycogen storage disease, Type 1a | G6PC |
| Glycogen storage disease, Type IIIb | AGL |
| Isovaleric acidemia | IVD |
| Wolman disease | LIPA |

TABLE 37

Lung diseases and genes affected.

| Disease | Gene Affected |
|---|---|
| Alpha-1 antitrypsin deficiency | SERPINA1 |
| Cystic fibrosis | CFTR |
| Primary ciliary dyskinesia | DNAI1 |
| Primary ciliary dyskinesia | DNAH5 |
| Primary pulmonary hypertension I | BMPR2 |
| Surfactant Protein B (SP-B) Deficiency (pulmonary surfactant metabolism dysfunction 1) | SFTPB |

TABLE 38

Skeletal muscle diseases and genes affected.

| Disease | Gene Affected |
|---|---|
| Becker muscular dystrophy | DMD |
| Becker myotonia | CLCN1 |
| Bethlem myopathy | COL6A2 |
| Centronuclear myopathy, X-linked (myotubular) | MTM1 |
| Congenital myasthenic syndrome | CHRNE |
| Duchenne muscular dystrophy | DMD |
| Emery-Dreifuss muscular dystrophy, AD | LMNA |
| Facioscapulohumeral Muscular Dystrophy | DUX4-D4Z4 chromosomal region |
| Hyperkalemic periodic paralysis | SCN4A |
| Hypokalemic periodic paralysis | CACNA1S |
| Limb-girdle muscular dystrophy 2A | CAPN3 |
| Limb-girdle muscular dystrophy 2B | DYSF |
| Limb-girdle muscular dystrophy, type 2D | SGCA |
| Miyoshi muscular dystrophy 1 | DYSF |
| Paramyotonia congenita | SCN4A |
| Thomsen myotonia | CLCN1 |
| VCP myopathy (IBMPFD) 1 | VCP |

TABLE 39

Skin diseases and genes affected.

| Disease | Gene Affected |
|---|---|
| Epidermolysis Bullosa Dystrophica Dominant | COL7A1 |
| Epidermolysis Bullosa Dystrophica Recessive (Hallopeau-Siemens) | COL7A1 |
| Epidermolysis Bullosa Junctional | LAMB3 |
| Epidermolysis Bullosa Simplex | KRT5; KRT14 |
| Epidermolytic Ichthyosis | KRT1; KRT10 |

TABLE 39-continued

Skin diseases and genes affected.

| Disease | Gene Affected |
|---|---|
| Hailey-Hailey Disease | ATP2C1 |
| Lamellar Ichthyosis/Nonbullous Congenital Ichthyosiform Erythroderma (ARCI) | TGM1 |
| Netherton Syndrome | SPINK5 |

TABLE 40

Exemplary protective mutations that reduce disease risk.

| Disease | Gene | Exemplary Protective Mutation |
|---|---|---|
| Alzheimer's | APP | A673T |
| Parkinson's | SGK1 | |
| Diabetes (Type II) | SLC30A8 | p.Arg138X; p.Lys34SerfsX50 |
| Cardiovascular Disease | PCSK9 | R46L |
| Cardiovascular Disease | ASGR1 | NM_001671.4, c.284-36_283 + 33delCTGGGGCTGGGG (SEQ ID NO: 1605); NP_001662.1, p.W158X |
| Cardiovascular Disease | NPC1L1 | p.Arg406X |
| Cardiovascular Disease | APOC3 | R19X; IVS2 + 1G→A; A43T |
| Cardiovascular Disease | LPA | |
| Cardiovascular Disease | ANGPTL4 | E40K |
| Cardiovascular Disease | ANGPTL3 | p.Ser17Ter; p.Asn121fs; p.Asn147fs; c.495 + 6T→C |
| HIV infection | CCR5 | CCR5-delta32 |

Pathogenic Mutations

In some embodiments, the systems or methods provided herein can be used to correct a pathogenic mutation. The pathogenic mutation can be a genetic mutation that increases an individual's susceptibility or predisposition to a certain disease or disorder. In some embodiments, the pathogenic mutation is a disease-causing mutation in a gene associated with a disease or disorder. In some embodiments, the systems or methods provided herein can be used to revert the pathogenic mutation to its wild-type counterpart. In some embodiments, the systems or methods provided herein can be used to change the pathogenic mutation to a sequence not causing the disease or disorder.

Table 41 provides exemplary indications (column 1), underlying genes (column 2), and pathogenic mutations that can be corrected using the systems or methods described herein (column 3).

TABLE 41

Indications, genes, and causitive pathogenic mutations.

| Disease | Gene | Pathogenic Mutation[#] |
|---|---|---|
| Achromatopsia | CNGB3 | 1148delC |
| Alpha-1 Antitrypsin Deficiency | SERPINA1 | E342K |
| Alpha-1 Antitrypsin Deficiency | SERPINA1 | E342K |
| Alpha-1 Antitrypsin Deficiency | SERPINA1 | R48C (R79C) |
| Amaurosis Congenita (LCA10) | CEP290 | 2991 + 1655A > G |
| Andersen-Tawil syndrome | KCNJ2 | R218W |
| Arrhythmogenic right ventricular cardiomyopathy (ARVC) | PKP2 | c.235C > T |
| associated with congenital factor XI deficiency | F11 | E117* |
| associated with congenital factor XI deficiency | F11 | F283L |
| ATTR amyloidosis | TTR | V50M/N30M |
| autosomal dominant deafness | COCH | G88E |
| autosomal dominant deafness | TECTA | Y1870C |
| autosomal dominant Parkinson's disease | SNCA | A53T |
| autosomal dominant Parkinson's disease | SNCA | A30P |
| Autosomal dominant rickets | FGF23 | R176Q |
| autosomal recessive deafness | CX30 | T5M |
| autosomal recessive deafness | DFNB59 | R183W |
| autosomal recessive deafness | TMC1 | Y182C |
| autosomal recessive hypercholesterolemia | ARH | Q136* |
| Blackfan-Diamond anemia | RPS19 | R62Q |
| blue-cone monochromatism | OPN.ILW | C203R |
| Brugada syndrome | SCN5A | E1784K |
| CADASIL syndrome | NOTCH3 gene | R90C |
| CADASIL syndrome | NOTCH3 gene | R141C |
| Canavan disease | ASPA | E285A |
| Canavan disease | ASPA | Y231X |
| Canavan disease | ASPA | A305E |
| carnitine palmitoyltransferase II deficiency | CPT2 | S113L |
| choroideremia | CHM | R293* |
| choroideremia | CHM | R270* |
| choroideremia | CHM | A117A |
| Citrullinemia Type I | ASS | G390R |
| classic galactosemia | GALT | Q188R |
| classic horoocystoinuria | CBS | T191M |
| classic homocystemuria | CBS | G307S |
| CLN2 Disease | TPP1 | c.509 − 1 G > C |
| CLN2 Disease | TPP1 | c.622 C < T |
| CLN2 Disease | TPP1 | c.851 G > T |
| cone-rod dystrophy | GUCY2D | R838C |
| congenital factor V deficiency | F5 | R506Q |
| congenital factor V deficiency | F5 | R534Q |
| congenital factor VII deficiency | F7 | A294V |
| congenital factor VII deficiency | F7 | C310F |
| congenital factor VII deficiency | F7 | R304Q |
| congenital factor VII deficiency | F7 | QI00R |
| Creutzfeldt-Jakob disease (CJD) | PRNP | E200K |
| Creutzfeldt-Jakob disease (CJD) | PRNP | M129V |
| Creutzfeldt-Jakob disease (CJD) | PRNP | P102L |
| Creutzfeldt-Jakob disease (CJD) | PRNP | D178N |
| cystic fibrosis | CFTR | G551D |
| cystic fibrosis | CFTR | W1282* |
| cystic fibrosis | CFTR | R553* |
| cystic fibrosis | CFTR | R117H |
| cystic fibrosis | CFTR | delta F508 |
| eystinosis | CTNS | W138* |
| Darier disease | ATP2A2 | N767S |
| Darier disease | ATP2A2 | N767S |
| Darier disease | ATP2A2 | N767S |
| Epidermolysis Bullosa Junctional | LAMB3 | R42X |
| Epidermolysis Bullosa Junctional | LAMB3 | R635X |
| familial amyotrophic lateral sclerosis (ALS) | SOD1 | A4V |
| familial amyotrophic lateral sclerosis (ALS) | SOD1 | H46R |
| familial amyotrophic lateral sclerosis (ALS) | SOD1 | G37R |
| Gaucher disease | GBA | N370S |
| Gaucher disease | GBA | N370S |
| Gaucher disease | GBA | L444P |
| Gaucher disease | GBA | L444P |

TABLE 41-continued

Indications, genes, and causitive pathogenic mutations.

| Disease | Gene | Pathogenic Mutation# |
|---|---|---|
| Gaucher disease | GBA | L483P |
| glutaryl-CoA dehydrogenase deficiency | GCDH | R138G |
| glutaryl-CoA dehydrogenase deficiency | GCDH | M263V |
| glutaryl-Co A dehydrogenase deficiency | GCDH | R402W |
| glycine encephalopathy | GLDC | A389V |
| glycine encephalopathy | GLDC | G771R |
| glycine encephalopathy | GLDC | T269M |
| hemophilia A | F8 | R2178C |
| hemophilia A | F8 | R550C |
| hemophilia A | F8 | R2169H |
| hemophilia A | F8 | R1985Q |
| hemophilia B | F9 | T342M |
| hemophilia B | F9 | R294Q |
| hemophilia B | F9 | R43Q |
| hemophilia B | F9 | R191H |
| hemophilia B | F9 | G106S |
| hemophilia B | F9 | A279T |
| hemophilia B | F9 | P75* |
| hemophilia B | F9 | R294* |
| hemophilia B | F9 | R379Q |
| Hereditary antithrombin deficiency type I | SERPINCI | R48C (R79C) |
| hereditary chronic pancreatitis | PRSS1 | R122H |
| Hunter syndrome | IDS | R88C |
| Hunter syndrome | IDS | G374G |
| Hurler syndrome (MPS1) | IDUA | Q70* |
| Hurler syndrome (MPS1) | IDUA | W402* |
| Hyperkalemic periodic paralysis | SCN4A | T704M |
| Hyperkalemic periodic paralysis | SCN4A | M1592V |
| Hyperkalemic periodic paralysis | CACNA1S | p.Arg528X |
| Hyperkalemic periodic paralysis | CACNA1S | p.Arg1239 |
| intermittent porphyria | HMBS | R173W |
| isolated agammaglobulinemia | E47 | E555K |
| Lattice corneal dystrophy type I | TGFBI | Arg124Cys |
| LCHAD deficiency | HADHA | Glu474Gln |
| Leber congenital amaurosis 2 | RPE65 | R44* |
| Leber congenital amaurosis 2 | RPE65 | IVS1 |
| Leber congenital amaurosis 2 | RPE65 | G-A, + 5 |
| Lesch-Nyhan syndrome | HPRTI | R51* |
| Lesch-Nyhan syndrome | HPRTI | R170* |
| Limb-girdle muscular dystrophy, type 2D | SGCA | Arg77Cys |
| Marteauz-Lamy Syndrome (MSPVI) | ARSB | Y210C |
| Mediterranean G6PD deficiency | G6PD | S188D |
| medium-chain acyl-CoA dehydrogenase deficiency | ACADM | K329E |
| medium-chain acyl-CoA dehydrogenase deficiency | ACADM | K329E |
| medium-chain acyl-CoA dehydrogenase deficiency | ACADM | K329E |
| Meesmann epithelial corneal dystrophy | KRT12 | L132P |
| metachfoniatic leukodystrophy | ARSA | P426L |
| metachromatic leukodystrophy | ARSA | c.459 + 1G > A |
| Morquio Syndrome (MPSIVA) | GALNS | R386C |
| Mucolipidosis IV | MCOLN1 | 406-2A > G |
| Mucolipidosis IV | MCOLN1 | 511_6943del |
| Neimann-Pick disease type A | SMPDI | L302P |
| Neuronal ceroid lipofuscinosis (NCL) | CLN2 | R208* |
| neuronal ceroid lipofuscinosis 1 | PPT1 | R151* |
| Parkinsons disease | LRRK2 | G2019S |
| Pendred syndrome | PDS | T461P |
| Pendred syndrome | PDS | L236P |
| Pendred syndrome | PDS | c.1001 + 1G > A |
| Pendred syndrome | PDS | IVS8, + 1 G > A, |
| phenylketonuria | PAH | R408W |
| phenylketonuria | PAH | 165T |
| phenylketonuria | PAH | R261Q |
| phenylketonuria | PAH | IVS10-HG > A |
| phenylketonuria | PCDH15 | R245* |
| phenylketonuria | PCDH15 | R245* |
| Pompe disease | GAA | c.-32 - 13T > G |
| Primary ciliary dyskinesia | DNAI1 | IVS1 + 2_3insT |
| Primary ciliary dyskinesia | DNAH5 | 10815delT |
| primary' hypoxalimia | AGXT | G170R |
| Progressive familial intrahepatic cholestasis type 2 | ABCB11 | D482G (c.1445A > G) |
| Progressive familial intrahepatic cholestasis type 2 | ABCB11 | E297G |
| Propionic acidemia | PCCB;PCCA | c.1218_1231del14ins12 |
| pseudoxanthoma, eiasticum | ABCC6 | R1141* |
| Pyruvate kinase deficiency (PKD) | PKLR | c.1456c -> T |
| retinitis pignientos | USH2a | C759F |
| retinitis pigmentosa | IMPDHI | D226N |
| retinitis pigmentosa | PDE6A | V685M |
| retinitis pigmentosa | PDE6A | D670G |
| retinitis pigmentosa | PRPF3 | T494M |
| retinitis pigmentosa | PRPF8 | H2309R |
| retinitis pigmentosa | RHO | P23H |
| retinitis pigmentosa | RHO | P347L |
| retinitis pigmentosa | RHO | P347L |
| retinitis pigmentosa | RHO | D190N |
| retinitis pigmentosa | RPI | R667* |
| retinitis pigmentosa/Usher syndrome type 1C | USH1C | V72V |
| Rett syndrome | MECP2 | R106W |
| Rett syndrome | MECP2 | R133C |
| Rett syndrome | MECP2 | R306C |
| Rett syndrome | MECP2 | R168* |
| Rett syndrome | MECP2 | R255* |
| Sanfilippo syndrome A (MPSIIIA) | SGSH | R74C |
| Sanfilippo syndrome A (MPSIIIA) | SGSH | R245H |
| Sanfilippo syndrome B (MPSIIIB) | NAGLU | R297* |
| Sanfilippo syndrome B (MPSIIIB) | NAGLU | Y140C |
| severe combined immunodeficiency | ADA | G216R |
| severe combined immunodeficiency | ADA | G216R |
| severe combined immunodeficiency | ADA | Q3* |
| sickle cell disease | HBB | E6V |
| sickle cell disease | HBB | E6V |
| sickle cell disease | HBB | E6V |
| sickle cell disease | HBB | E26K |
| sickle cell disease | HBB | E26K |
| sickle cell disease | HBB | E7K |
| sickle cell disease | HBB | c.-138C > T |
| sickle cell disease | HBB | IVS2 |
| sickle cell disease | HBB | 654 C > T |
| Sly Syndrome (MPSVH) | GUSB | L175F |
| Stargardt disease | ABCA4 | A1038V |
| Stargardt disease | ABCA4 | A1038V |
| Stargardt disease | ABCA4 | L541P |
| Stargardt disease | ABCA4 | G1961E |
| Stargardt disease | ABCA4 | G1961E |
| Stargardt disease | ABCA4 | G1961E |
| Stargardt disease | ABCA4 | G1961E |
| Stargardt disease | ABCA4 | c.2588G > C |
| Stargardt disease | ABCA4 | c.5461 - 10 T > C |
| Stargardt disease | ABCA4 | c.5714 + 5G > A |
| Tay Sachs | HEXA | InsTATC1278 |
| tyrosinemia type 1 | FAH | P261L |
| Usher syndrome type 1F | PCDH15 | R245* |
| variegate porphyria | PPOX | R59W |
| VCP myopathy (IBMPFD) 1 | VCP | R1555X |
| von Gierke disease | G6PC | Q347* |
| von Gierke disease | G6PC | Q347* |
| von Gierke disease | G6PC | Q347* |
| von Gierke disease | G6PC | R83C |
| Wilson's Disease | ATP7B | E297G |

TABLE 41-continued

Indications, genes, and causitive pathogenic mutations.

| Disease | Gene | Pathogenic Mutation# |
|---|---|---|
| X-linked myotubular myopathy | MTMI | c.1261 − 10A > G |
| X-linked retinoschisis | RS1 | R102W |
| X-linked retinoschisis | RS1 | R141C |

See J T den Dunnen and S E Antonarakis, Hum Mutat. 2000; 15(1): 7-12, herein incorporated by reference in its entirety, for details of the nomenclatures of gene mutations.
*means a stop codon.

Compensatory Edits

In some embodiments, the systems or methods provided herein can be used to introduce a compensatory edit. In some embodiments, the compensatory edit is at a position of a gene associated with a disease or disorder, which is different from the position of a disease-causing mutation. In some embodiments, the compensatory mutation is not in the gene containing the causitive mutation. In some embodiments, the compensatory edit can negate or compensate for a disease-causing mutation. In some embodiments, the compensatory edit can be introduced by the systems or methods provided herein to suppress or reverse the mutant effect of a disease-causing mutation.

Table 42 provides exemplary indications (column 1), genes (column 2), and compensatory edits that can be introduced using the systems or methods described herein (column 3). In some embodiments, the compensatory edits provided in Table 42 can be introduced to suppress or reverse the mutant effect of a disease-causing mutation.

TABLE 42

Indications, genes, compensatory edits, and exemplary design features.

| Disease | Gene | Nucleotide Change# |
|---|---|---|
| Alpha-1 Antitrypsin Deficiency | SERPINAI | F51L |
| Alpha-1 Antitrypsin Deficiency | SERPINAI | M3741 |
| Alpha-1 Antitrypsin Deficiency | SERPINAI | A348V/A347V |
| Alpha-1 Antitrypsin Deficiency | SERPINAI | K387R |
| Alpha-1 Antitrypsin Deficiency | SERPINAI | T59A |
| Alpha-1 Antitiypsin Deficiency | SERPINAI | T68A |
| ATTR amyloidosis | TTR | A108V |
| ATTR amyloidosis | TTR | R104H |
| ATTR amyloidosis | TTR | T119M |
| Cystic fibroses | CFTR | R555K |
| Cystic fibrosis | CFTR | F409L |
| Cystic fibrosis | CFTR | F433L |
| Cystic fibrosis | CFTR | H667R |
| Cystic fibrosis | CFTR | R1070W |
| Cystic fibrosis | CFTR | R29K |
| Cystic fibrosis | CFTR | R553Q |
| Cystic fibrosis | CFTR | 1539T |
| Cystic fibrosis | CFTR | G550E |
| Cystic fibroses | CFTR | F429S |
| Cystic fibrosis | CFTR | Q637R |
| Sickle cell disease | HBB | A70T |
| Sickle cell disease | HBB | A70V |
| Sickle cell disease | HBB | L88P |
| Sickle cell disease | HBB | F85L and/or F85P |
| Sickle cell disease | HBB | E22G |
| Sickle cell disease | HBB | G16D and/or G16N |

See J T den Dunnen and S E Antonarakis, Hum Mutat. 2000; 15(1): 7-12, herein incorporated by reference in its entirety, for details of the nomenclatures of gene mutations.

Regulatory Edits

In some embodiments, the systems or methods provided herein can be used to introduce a regulatory edit. In some embodiments, the regulatory edit is introduced to a regulatory sequence of a gene, for example, a gene promoter, gene enhancer, gene repressor, or a sequence that regulates gene splicing. In some embodiments, the regulatory edit increases or decreases the expression level of a target gene. In some embodiments, the target gene is the same as the gene containing a disease-causing mutation. In some embodiment, the target gene is different from the gene containing a disease-causing mutation. For example, the systems or methods provided herein can be used to upregulate the expression of fetal hemoglobin by introducing a regulatory edit at the promoter of bcl11a, thereby treating sickle cell disease.

Table 43 provides exemplary indications (column 1), genes (column 2), and regulatory edits that can be introduced using the systems or methods described herein (column 3).

TABLE 43

Indications, genes, and compensatory regulatory edits.

| Disease | Gene | Nucleotide Change# |
|---|---|---|
| homozygous familial hypercholesterolaemia | LDLR | c.81C > T |
| Porphyrias | ALAS1 | c.3G > A |
| Porphyrias | ALAS1 | c.2T > C |
| Porphyrias | ALAS1 | c.46C > T |
| Porphyrias | ALAS1 | c.91C > T |
| Porphyrias | ALAS1 | c.91C > T |
| Porphyrias | ALAS1 | c.226C > T |
| Porphyrias | ALAS1 | c.226C > T |
| Porphyrias | ALAS1 | c.226C > T |
| Porphyrias | ALAS1 | c.229C > T |
| Porphyrias | ALAS1 | c.247C > T |
| Porphyrias | ALAS1 | c.247C > T |
| Porphyrias | ALAS1 | c.250C > T |
| Porphyrias | ALAS1 | c.250C > T |
| Porphyrias | ALAS1 | c.340C > T |
| Porphyrias | ALAS1 | c.340C > T |
| Porphyrias | ALAS1 | c.349C > T |
| Porphyrias | ALAS1 | c.391C > T |
| Porphyrias | ALAS1 | c.391C > T |
| Porphyrias | ALAS1 | c.403C > T |
| Porphyrias | ALAS1 | c.403C > T |
| Porphyrias | ALAS1 | c.199 + 1G > A |
| Porphyrias | ALAS1 | c.199 + 1G > A |
| Porphyrias | ALAS1 | c.199 + 1G > A |
| Porphyrias | ALAS1 | c.199 + 1G > A |
| Porphyrias | ALAS1 | c.199 + 2T > C |
| Porphyrias | ALAS1 | c.199 + 2T > C |
| Porphyrias | ALAS1 | c.199 + 2T > C |
| Porphyrias | ALAS1 | c.199 + 2T > C |
| Porphyrias | ALAS1 | c.200 − 2A > G |
| Porphyrias | ALAS1 | C.427 + 1G > A |
| Porphyrias | ALAS1 | c.427 + 2T > C |
| Porphyrias | ALAS1 | c.1165 + 1G > A |
| Porphyrias | ALAS1 | c.1165 + 2T > C |
| Porphyrias | ALAS1 | c.1166 − 1A > G |
| Porphyrias | ALAS1 | c.1331 − 2A > G |
| sickle cell disease | BCL11A | c.386-24278G > A |
| sickle cell disease | BCL11A | c.386-24983T > C |
| sickle cell disease | HBG1 | c.−167C > T |
| sickle cell disease | HBG1 | c.−170G > A |
| sickle cell disease | HBG1 | c.−249C > T |
| sickle cell disease | HBG2 | c.−211C > T |
| sickle cell disease | HBG2 | c.−228T > C |
| sickle cell disease | HBG1/2 | C. −198 T > C |
| sickle cell disease | HBG1/2 | C. −198 T > C |
| sickle cell disease | HBG1/2 | C. −198 T > C |
| sickle cell disease | HBG1/2 | C. −198 T > C |
| sickle cell disease | HBG1/2 | C. −198 T > C |
| sickle cell disease | HBG1/2 | C. −198 T > C |
| sickle cell disease | HBG1/2 | C. −198 T > C |
| sickle cell disease | HBG1/2 | C. −175 T > C |
| sickle cell disease | HBG1/2 | C. −175 T > C |
| sickle cell disease | HBG1/2 | C. −175 T > C |
| sickle cell disease | HBG1/2 | C. −175 T > C |
| sickle cell disease | HBG1/2 | C. −175 T > C |
| sickle cell disease | HBG1/2 | C. −114~−102 deletion |

TABLE 43-continued

Indications, genes, and compensatory regulatory edits.

| Disease | Gene | Nucleotide Change# |
|---|---|---|
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | C. -114~-102 deletion |
| sickle cell disease | HBG1/2 | c. -90 BCL11A Binding |
| sickle cell disease | HBG1/2 | c. -90 BCL11A Binding |
| sickle cell disease | HBG1/2 | C. -202 C > T, -201 C > T, -198 T > C, -197 C > T, -196 C > T, -195 C > G |
| sickle cell disease | HBG1/2 | C. -197 C > T, -196 C > T, -195 C > G |

See J T den Dunnen and S E Antonarakis, Hum Mutat. 2000; 15(1): 7-12, herein incorporated by reference in its entirety, for details of the nomenclatures of gene mutations.

Repeat Expansion Diseases

In some embodiments, the systems or methods provided herein can be used to treat a repeat expansion disease, for example, a repeat expansion disease provided in Table 44. Table 44 provides the indication (column 1), the gene (column 2), minimal repeat sequence of the repeat that is expanded in the condition (column 3), and the location of the repeat relative to the listed gene for each indication (column 4). In some embodiments, the systems or methods provided herein, for example, those comprising GENE WRITER™ genome editor polypeptides, 10 can be used to treat repeat expansion diseases by resetting the number of repeats at the locus according to a customized RNA template (see, e.g., Example 24).

TABLE 44

Exemplary repeat expansion diseases, genes, causal repeats, and repeat locations.

| Disease | Gene | Causal repeat | Repeat location |
|---|---|---|---|
| myotonic dystrophy 1 | DMPK/DM1 | CTG | 3' UTR |
| myotonic dystrophy 2 | ZNF9/CNBP | CCTG | Intron 1 |
| dentatorubral-pallidoluysian atrophy | ATN1 | CAG | Coding |
| fragile X mental retardation syndrome | FMR1 | CGG | 5' UTR |
| fragile X E mental retardation | FMR2 | GCC | 5' UTR |
| Friedreich's ataxia | FXN | GAA | Intron |
| fragile X tremor ataxia syndrome | FMR1 | CGG | 5' UTR |
| Huntington's disease | HTT | CAG | Coding |
| Huntington's disease-like 2 | JPH3 | CTG | 3' UTR, coding |
| myoclonic epilepsy of Unverricht and Lundborg | CSTB | CCCC GCCC CGCG (SEQ ID NO: 1606) | Promoter |
| oculopharyngeal muscular dystrophy | PABPN1 | GCG | Coding |
| spinal and bulbar muscular atrophy | AR | CAG | Coding |
| spinocerebellar ataxia 1 | ATXN1 | CAG | Coding |
| spinocerebellar ataxia 2 | ATXN2 | CAG | Coding |
| spinocerebellar ataxia 3 | ATXN3 | CAG | Coding |
| spinocerebellar ataxia 6 | CACNA1A | CAG | Coding |
| spinocerebellar ataxia 7 | ATXN7 | CAG | Coding |
| spinocerebellar ataxia 8 | ATXN8 | CTG/CAG | CTG/CAG (ATXN8) |
| spinocerebellar ataxia 10 | ATXN10 | ATTCT | Intron |
| spinocerebellar ataxia 12 | PPP2R2B | CAG | Promoter, 5' UTR? |
| spinocerebellar ataxia 17 | TBP | CAG | Coding |
| Syndromic/non-syndromic X-linked mental retardation | ARX | GCG | Coding |

Exemplary Templates

In some embodiments, the systems or methods provided herein use the template sequences listed in Table 45. Table 45 provides exemplary template RNA sequences (column 5) and optional second-nick gRNA sequences (column 6) designed to be paired with a GENE WRITING™ polypeptide to correct the indicated pathogenic mutations (column 4). All the templates in Table 45 are meant to exemplify the total sequence of: (1) targeting gRNA for first strand nick, (2) polypeptide binding domain, (3) heterologous object sequence, and (4) target homology domain for setting up TPRT at first strand nick.

TABLE 45

Exemplary diseases, tissues, genes, pathogenic mutations, template RNA sequences, and second nick gRNA sequences.

| Disease | Tissue | Gene | Mutation | Template RNA | Second nick gRNA |
|---|---|---|---|---|---|
| Alpha-1 antitrypsin | Liver | SERPINA1 | PIZ | TCCCCTCCAGGCCGTGCATAGTTTT AGAGCTAGAAATAGCAAGTTAAAA TAAGGCTAGTCCGTTATCAACTTGA AAAAGTGGGACCGAGTCGGTCCTcG TCGATGGTCAGCACAGCCTTATGCA CGGCCTGGA (SEQ ID NO: 1607) | TTTGTT GAACTT GACCTC GG (SEQ ID NO: 1608) |
| Cystic fibrosis | Lung | CFTR | deltaF508 | ACCATTAAAGAAAATATCATGTTTT AGAGCTAGAAATAGCAAGTTAAAA TAAGGCTAGTCCGTTATCAACTTGA AAAAGTGGGACCGAGTCGGTCCAC CAaagATGATATTTTCTTTA (SEQ ID NO: 1609) | AaagAT GATATT TTCTTT AA (SEQ ID NO: 1610) |
| Sickle cell | HSC | HBB | HbS | GTAACGGCAGACTTCTCCACGTTTT AGAGCTAGAAATAGCAAGTTAAAA TAAGGCTAGTCCGTTATCAACTTGA AAAAGTGGGACCGAGTCGGTCCGA CTCCTGaGGAGAAGTCTGCC (SEQ ID NO: 1611) | TGGTGA GGCCCT GGGCA GGT (SEQ ID NO: 1612) |
| Wilson's Disease | Liver | ATP7B | H1069Q | TTGGTGACTGCCACGCCCAAGTTTT AGAGCTAGAAATAGCAAGTTAAAA TAAGGCTAGTCCGTTATCAACTTGA AAAAGTGGGACCGAGTCGGTCCAC AcCCCTTGGGCGTGGCAGTC (SEQ ID NO: 1613) | GGCCA GCAGT GAACAc CCCT (SEQ ID NO: 1614) |
| ARVC | Heart | PKP2 | 235C>T | ACTCAGGAACACTGCTGGTTGTTTT AGAGCTAGAAATAGCAAGTTAAAA TAAGGCTAGTCCGTTATCAACTTGA AAAAGTGGGACCGAGTCGGTCCTTC ACtGAACCAGCAGTGTTCC (SEQ ID NO: 1615) | TTGGTT GAAAA TGATTT TGT (SEQ ID NO: 1616) |
| Long QT syndrome 1 | Heart | KCNQ1 | P343S | CCAGGGAAAACGCACCCACGGTTTT AGAGCTAGAAATAGCAAGTTAAAA TAAGGCTAGTCCGTTATCAACTTGA AAAAGTGGGACCGAGTCGGTCCTCc CAGCGGTAGGTGCCCCGTGGGTGC GTTTTC (SEQ ID NO: 1617) | CTCCTT CTTTGC GCTCcC AG (SEQ ID NO: 1618) |
| Mucolipidosis IV | CNS | MCOLN1 | 406-2A>G | GCCCTCCCCTTCTCTGCCCAGTTTTA GAGCTAGAAATAGCAAGTTAAAAT AAGGCTAGTCCGTTATCAACTTGAA AAAGTGGGACCGAGTCGGTCCGGT ACtGTGGGCAGAGAAGGGG (SEQ ID NO: 1619) | TCAGGC AACGC CAGGT ACtG (SEQ ID NO: 1620) |

In some embodiments, the systems or methods provided herein use the template sequences listed in Table 46. Table 46 provides exemplary template RNA sequences (column 5) and optional second-nick gRNA sequences (column 6) designed to be paired with a GENE WRITING™ polypeptide to correct the indicated pathogenic mutations (column 4). All the templates in Table 46 are meant to exemplify the total sequence of: (1) targeting gRNA for first strand nick, (2) polypeptide binding domain, (3) heterologous object sequence, and (4) target homology domain for setting up TPRT at first strand nick.

TABLE 46

Exemplary Gene Writing™ templates and second nick gRNA sequences for the correction of exemplary repeat expansion diseases. The region of the template spanning the repeat(s) is indicated in lowercase.

| Disease | Gene | Reference Accession | Repeat | Location | Template RNA | Second-nick gRNA |
|---|---|---|---|---|---|---|
| myotonic dystrophy 1 | DMPK | NC_00019.10 (45769709 . . . 45782490, complement) | CTG | 3' UTR | CTCGAAGGGTCCTTGTAGCCGTTTTAGAGCTAGAAATAGCAAGTTAAAATAAGGCTAGTCCGTTATCAACTTGAAAAAGTGGGACCGAGTCGGTCCGTGATCCCCCcagcagcagcagcagcagcagcagcagcagcagcagcagcagcagcagcagcagcagcagcagcagcagcagCATTCCCGGCTACAAGGACCCT (SEQ ID NO: 1621) | ATCACAGGACTGGAGCTGGG (SEQ ID NO: 1622) |
| myotonic dystrophy 2 | CNBP | NC_00003.12 (129167827 . . . 129183896, complement) | CCTG | Intron 1 | ACCACTGCACTCCAGCCTAGGTTTTAGAGCTAGAAATAGCAAGTTAAAATAAGGCTAGTCCGTTATCAACTTGAAAAAGTGGGACCGAGTCGGTCCGTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTGTCTG TGcctgcctgcctgcctgcctgcctgcctgcctggctgcctgtctgcctgtctgcctgcctgcctgcctgcctgcctgtCTGTCTCACTTTGTCCCCTAGGCTGGAGTGCA (SEQ ID NO: 1623) | GCCTCAGCCTCCTGAGTAGC (SEQ ID NO: 1624) |
| fragile X mental retardation syndrome | FMR1 | NC_00023.11 (147911919 . . . 147951127) | CGG | 5' UTR | GGGGGCGTGCGGCAGCGCGGGTTTTAGAGCTAGAAATAGCAAGTTAAAATAAGGCTAGTCCGTTATCAACTTGAAAAAGTGGGACCGAGTCGGTCCTGCGGGCGCTCGAGGCCCAGccgccgccgccgccgccgccgccgccgcctccgccgccgccgccgccgccgccgCGCTGCCGCACG (SEQ ID NO: 1625) | GCTCAGAGGCGGCCCTCCAC (SEQ ID NO: 1626) |
| Friedreich's ataxia | FXN | NC_00009.12 (69035752 . . . 69079076) | GAA | Intron | CAGGCGCGCGACACCACGCCGTTTTAGAGCTAGAAATAGCAAGTTAAAATAAGGCTAGTCCGTTATCAACTTGAAAAAGTGGGACCGAGTCGGTCCAACCCAGTATCTACTAAAAAATACAAAAAAAAAAAAAAgaagaagaagaagaagaaAATAAAGAAAAGTTAGCCG | CGCTTGAGCCCGGGAGGCAG (SEQ ID NO: 1628) |

TABLE 46-continued

Exemplary Gene Writing ™ templates and second nick gRNA sequences for the correction of exemplary repeat expansion diseases. The region of the template spanning the repeat(s) is indicated in lowercase.

| Disease | Gene | Reference Accession | Repeat | Location | Template RNA | Second-nick gRNA |
|---|---|---|---|---|---|---|
| | | | | | GGCGTGGTGTCGCGC (SEQ ID NO: 1627) | |
| Huntington disease | HTT | NC_00004.12 (3074681 . . . 3243960) | CAG | Coding | GGCGGCTGAGGAAGCTGAGGGTTTTAGAGCTAGAAATAGCAAGTTAAAATAAGGCTAGTCCGTTATCAACTTGAAAAAGTGGGACCGAGTCGGTCCAGTCCCTCAAGTCCTTCcagcagcagcagcagcagcagcagcagcagcagcagcagcagcagcagcagcagcagcagcaacagccgccaccgccgccgccgcgccgccgcctcctCAGCTTCCTCAG (SEQ ID NO: 1629) | CGCTGCACCGACCGTGAGTT (SEQ ID NO: 1630) |
| spinocerebellar ataxia | ATXN1 | NC_00006.12 (16299112 . . . 16761490, complement) | CAG | Coding | TGAGCCCCGAGCCCTGCTGGTTTTAGAGCTAGAAATAGCAAGTTAAAATAAGGCTAGTCCGTTATCAACTTGAAAAAGTGGGACCGAGTCGGTCCACAAGGCTGAGcagcagcagcagcagcagcagcagcagcagcagcatcagcatcagcagcagcagcagcagcagcagcagcagcagcagcagCACCTCAGCAGGGCTCCGGG (SEQ ID NO: 1631) | TCCAGTTCTCCGCAGAACAC (SEQ ID NO: 1632) |

Exemplary Heterologous Object Sequences

In some embodiments, the systems or methods provided herein comprise a heterologous object sequence, wherein the heterologous object sequence or a reverse complementary sequence thereof, encodes a protein (e.g., an antibody) or peptide. In some embodiments, the therapy is one approved by a regulatory agency such as FDA.

In some embodiments, the protein or peptide is a protein or peptide from the THPdb database (Usmani et al. PLOS One 12 (7): e0181748 (2017), herein incorporated by reference in its entirety. In some embodiments, the protein or peptide is a protein or peptide disclosed in Table 47. In some embodiments, the systems or methods disclosed herein, for example, those comprising GENE WRITER™ genome editor polypeptides, may be used to integrate an expression cassette for a protein or peptide from Table 47 into a host cell to enable the expression of the protein or peptide in the host. In some embodiments, the sequences of the protein or peptide in the first column of Table 47 can be found in the patents or applications provided in the third column of Table 47, incorporated by reference in their entireties.

In some embodiments, the protein or peptide is an antibody disclosed in Table 1 of Lu et al. J Biomed Sci 27 (1): 1 (2020), herein incorporated by reference in its entirety. In some embodiments, the protein or peptide is an antibody disclosed in Table 48. In some embodiments, the systems or methods disclosed herein, for example, those comprising GENE WRITER™ genome editor polypeptides, may be used to integrate an expression cassette for an antibody from Table 48 into a host cell to enable the expression of the antibody in the host. In some embodiments, a system or method described herein is used to express an agent that binds a target of column 2 of Table 48 (e.g., a monoclonal antibody of column 1 of Table 48) in a subject having an indication of column 3 of Table 48.

TABLE 47

Exemplary protein and peptide therapeutics.

| Therapeutic peptide | Category | Pat. No. |
|---|---|---|
| Lepirudin | Antithrombins and Fibrinolytic Agents | CA1339104 |
| Cetuximab | Antineoplastic Agents | CA1340417 |
| Dor se alpha | Enzymes | CA2184581 |
| Denileukin diftitox | Antineoplastic Agents | |

TABLE 47-continued

Exemplary protein and peptide therapeutics.

| Therapeutic peptide | Category | Pat. No. |
|---|---|---|
| Etanercept | Immunosuppressive Agents | CA2476934 |
| Bivalirudin | Antithrombins | U.S. Pat. No. 7,582,727 |
| Leuprolide | Antineoplastic Agents | |
| Peginterferon alpha-2a | Immunosuppressive Agents | CA2203480 |
| Alteplase | Thrombolytic Agents | |
| Interferon alpha-n1 | Antiviral Agents | |
| Darbepoetin alpha | Anti-anemic Agents | CA2165694 |
| Reteplase | Fibrinolytic Agents | CA2107476 |
| Epoetin alpha | Hematinics | CA1339047 |
| Salmon Calcitonin | Bone Density Conservation Agents | U.S. Pat. No. 6,440,392 |
| Interferon alpha-n3 | Immunosuppressive Agents | |
| Pegfilgrastim | Immunosuppressive Agents | CA1341537 |
| Sargramostim | Immunosuppressive Agents | CA1341150 |
| Secretin | Diagnostic Agents | |
| Peginterferon alpha-2b | Immunosuppressive Agents | CA1341567 |
| Asparagi se | Antineoplastic Agents | |
| Thyrotropin alpha | Diagnostic Agents | U.S. Pat. No. 5,840,566 |
| Antihemophilic Factor | Coagulants and Thrombotic agents | CA2124690 |
| A kinra | Antirheumatic Agents | CA2141953 |
| Gramicidin D | Anti-Bacterial Agents | |
| Intravenous Immunoglobulin | Immunologic Factors | |
| Anistreplase | Fibrinolytic Agents | |
| Insulin Regular | Antidiabetic Agents | |
| Tenecteplase | Fibrinolytic Agents | CA2129660 |
| Menotropins | Fertility Agents | |
| Interferon gamma-1b | Immunosuppressive Agents | U.S. Pat. No. 6,936,695 |
| Interferon alpha-2a, Recombi nt | | CA2172664 |
| Coagulation factor VIIa | Coagulants | |
| Oprelvekin | Antineoplastic Agents | |
| Palifermin | Anti-Mucositis Agents | |
| Glucagon recombi nt | Hypoglycemic Agents | |
| Aldesleukin | Antineoplastic Agents | |
| Botulinum Toxin Type B | Antidystonic Agents | |
| Omalizumab | Anti-Allergic Agents | CA2113813 |
| Lutropin alpha | Fertility Agents | U.S. Pat. No. 5,767,251 |
| Insulin Lispro | Hypoglycemic Agents | U.S. Pat. No. 5,474,978 |
| Insulin Glargine | Hypoglycemic Agents | U.S. Pat. No. 7,476,652 |
| Collage se | | |
| Rasburicase | Gout Suppressants | CA2175971 |
| Adalimumab | Antirheumatic Agents | CA2243459 |
| Imiglucerase | Enzyme Replacement Agents | U.S. Pat. No. 5,549,892 |
| Abciximab | Anticoagulants | CA1341357 |
| Alpha-1-protei se inhibitor | Serine Protei se Inhibitors | |
| Pegaspargase | Antineoplastic Agents | |
| Interferon beta-1a | Antineoplastic Agents | CA1341604 |
| Pegademase bovine | Enzyme Replacement Agents | |
| Human Serum Albumin | Serum substitutes | U.S. Pat. No. 6,723,303 |
| Eptifibatide | Platelet Aggregation Inhibitors | U.S. Pat. No. 6,706,681 |
| Serum albumin iodo ted | Diagnostic Agents | |
| Infliximab | Antirheumatic Agents, Anti-Inflammatory Agents, Non-Steroidal, Dermatologic Agents, Gastrointesti 1 Agents and Immunosuppressive Agents | CA2106299 |
| Follitropin beta | Fertility Agents | U.S. Pat. No. 7,741,268 |
| Vasopressin | Anti diuretic Agents | |
| Interferon beta-1b | Adjuvants, Immunologic and Immunosuppressive Agents | CA1340861 |
| Interferon alphacon-1 | Antiviral Agents and Immunosuppressive Agents | CA1341567 |
| Hyaluronidase | Adjuvants, Anesthesia and Permeabilizing Agents | |
| Insulin, porcine | Hypoglycemic Agents | |
| Trastuzumab | Antineoplastic Agents | CA2103059 |
| Rituximab | Antineoplastic Agents, Immunologic Factors and Antirheumatic Agents | CA2149329 |
| Basiliximab | Immunosuppressive Agents | CA2038279 |
| Muromo b | Immunologic Factors and Immunosuppressive Agents | |
| Digoxin Immune Fab (Ovine) | Antidotes | |
| Ibritumomab | | CA2149329 |
| Daptomycin | | U.S. Pat. No. 6,468,967 |
| Tositumomab | | |
| Pegvisomant | Hormone Replacement Agents | U.S. Pat. No. 5,849,535 |
| Botulinum Toxin Type A | Neuromuscular Blocking Agents, Anti-Wrinkle Agents and Anti dystonic Agents | CA2280565 |
| Pancrelipase | Gastrointesti 1 Agents and Enzyme Replacement Agents | |
| Streptoki se | Fibrinolytic Agents and Thrombolytic Agents | |
| Alemtuzumab | | CA1339198 |
| Alglucerase | Enzyme Replacement Agents | |
| Capromab | Indicators, Reagents and Diagnostic Agents | |
| Laronidase | Enzyme Replacement Agents | |
| Urofollitropin | Fertility Agents | U.S. Pat. No. 5,767,067 |
| Efalizumab | Immunosuppressive Agents | |
| Serum albumin | Serum substitutes | U.S. Pat. No. 6,723,303 |
| Choriogo dotropin alpha | Fertility Agents and Go dotropins | U.S. Pat. No. 6,706,681 |
| Antithymocyte globulin | Immunologic Factors and Immunosuppressive Agents | |
| Filgrastim | Immunosuppressive Agents, Antineutropenic Agents and Hematopoietic Agents | CA1341537 |
| Coagulation factor ix | Coagulants and Thrombotic Agents | |
| Becaplermin | Angiogenesis Inducing Agents | CA1340846 |
| Agalsidase beta | Enzyme Replacement Agents | CA2265464 |

TABLE 47-continued

Exemplary protein and peptide therapeutics.

| Therapeutic peptide | Category | Pat. No. |
|---|---|---|
| Interferon alpha-2b | Immunosuppressive Agents | CA1341567 |
| Oxytocin | Oxytocics, Anti-tocolytic Agents and Labor Induction Agents | |
| Enfuvirtide | HIV Fusion Inhibitors | U.S. Pat. No. 6,475,491 |
| Palivizumab | Antiviral Agents | CA2197684 |
| Daclizumab | Immunosuppressive Agents | |
| Bevacizumab | Angiogenesis Inhibitors | CA2286330 |
| Arcitumomab | Diagnostic Agents | U.S. Pat. No. 8,420,081 |
| Arcitumomab | Diagnostic Agents | U.S. Pat. No. 7,790,142 |
| Eculizumab | | CA2189015 |
| Panitumumab | | |
| Ranibizumab | Ophthalmics | CA2286330 |
| Idursulfase | Enzyme Replacement Agents | |
| Alglucosidase alpha | Enzyme Replacement Agents | CA2416492 |
| Exe tide | Hypoglycemic Agents | U.S. Pat. No. 6,872,700 |
| Mecasermin | | U.S. Pat. No. 5,681,814 |
| Pramlintide | | U.S. Pat. No. 5,686,411 |
| Galsulfase | Enzyme Replacement Agents | |
| Abatacept | Antirheumatic Agents and Immunosuppressive Agents | CA2110518 |
| Cosyntropin | Hormones and Diagnostic Agents | |
| Corticotropin | | |
| Insulin aspart | Hypoglycemic Agents and Antidiabetic Agents | U.S. Pat. No. 5,866,538 |
| Insulin detemir | Antidiabetic Agents | U.S. Pat. No. 5,750,497 |
| Insulin glulisine | Antidiabetic Agents | U.S. Pat. No. 6,960,561 |
| Pegaptanib | Intended for the prevention of respiratory distress syndrome (RDS) in premature infants at high risk for RDS. | |
| Nesiritide | | |
| Thymalphasin | | |
| Defibrotide | Antithrombins | |
| tural alpha interferon OR multiferon | | |
| Glatiramer acetate | | |
| Preotact | | |
| Teicoplanin | Anti-Bacterial Agents | |
| Ca kinumab | Anti-Inflammatory Agents and Monoclo 1 antibodies | |
| Ipilimumab | Antineoplastic Agents and Monoclo 1 antibodies | CA2381770 |
| Sulodexide | Antithrombins and Fibrinolytic Agents and Hypoglycemic Agents and Anticoagulants and Hypolipidemic Agents | |
| Tocilizumab | | CA2201781 |
| Teriparatide | Bone Density Conservation Agents | US6977077 |
| Pertuzumab | Monoclo 1 antibodies | CA2376596 |
| Rilo cept | Immunosuppressive Agents | U.S. Pat. No. 5,844,099 |
| Denosumab | Bone Density Conservation Agents and Monoclo 1 antibodies | CA2257247 |
| Liraglutide | | U.S. Pat. No. 6,268,343 |
| Golimumab | Antipsoriatic Agents and Monoclo 1 antibodies and TNF inhibitor | |
| Belatacept | Antirheumatic Agents and Immunosuppressive Agents | |
| Buserelin | | |
| Velaglucerase alpha | Enzymes | U.S. Pat. No. 7,138,262 |
| Tesamorelin | | U.S. Pat. No. 5,861,379 |
| Brentuximab vedotin | | |
| Taliglucerase alpha | Enzymes | |
| Belimumab | Monoclo 1 antibodies | |
| Aflibercept | Antineoplastic Agents and Ophthalmics | U.S. Pat. No. 7,306,799 |
| Asparagi se erwinia chrysanthemi | Enzymes | |
| Ocriplasmin | Ophthalmics | |
| Glucarpidase | Enzymes | |
| Teduglutide | | U.S. Pat. No. 5,789,379 |
| Raxibacumab | Anti-Infective Agents and Monoclo 1 antibodies | |
| Certolizumab pegol | TNF inhibitor | CA2380298 |
| Insulin, isophane | Hypoglycemic Agents and Antidiabetic Agents | |
| Epoetin zeta | | |
| Obinutuzumab | Antineoplastic Agents | |
| Fibrinolysin aka plasmin | | U.S. Pat. No. 3,234,106 |
| Follitropin alpha | | |
| Romiplostim | Colony-Stimulating Factors and Thrombopoietic Agents | |
| Luci ctant | Pulmo ry surfactants | U.S. Pat. No. 5,407,914 |
| talizumab | Immunosuppressive agents | |
| Aliskiren | Renin inhibitor | |
| Ragweed Pollen Extract | | |
| Secukinumab | Inhibitor | US20130202610 |
| Somatotropin Recombi nt | Hormone Replacement Agents | CA1326439 |
| Drotrecogin alpha | Antisepsis | CA2036894 |
| Alefacept | Dermatologic and Immunosupressive agents | |
| OspA lipoprotein | Vaccines | |
| Uroki se | | U.S. Pat. No. 4,258,030 |
| Abarelix | Anti-Testosterone Agents | U.S. Pat. No. 5,968,895 |
| Sermorelin | Hormone Replacement Agents | |
| Aprotinin | | U.S. Pat. No. 5,198,534 |

TABLE 47-continued

Exemplary protein and peptide therapeutics.

| Therapeutic peptide | Category | Pat. No. |
|---|---|---|
| Gemtuzumab ozogamicin | Antineoplastic agents and Immunotoxins | U.S. Pat. No. 5,585,089 |
| Satumomab Pendetide | Diagnostic Agents | |
| Albiglutide | Drugs used in diabetes; alimentary tract and metabolism; blood glucose lowering drugs, excl. insulins. | |
| Alirocumab | | |
| Ancestim | | |
| Antithrombin alpha | | |
| Antithrombin III human | | |
| Asfotase alpha | Enzymes Alimentary Tract and Metabolism | |
| Atezolizumab | | |
| Autologous cultured chondrocytes | | |
| B er actant | | |
| Bli tumomab | Antineoplastic Agents Immunosuppressive Agents Monoclo 1 antibodies Antineoplastic and Immunomodulating Agents | US20120328618 |
| C1 Esterase Inhibitor (Human) | | |
| Coagulation Factor XIIIA-Subunit (Recombi nt) | | |
| Conestat alpha | | |
| Daratumumab | Antineoplastic Agents | |
| Desirudin | | |
| Dulaglutide | Hypoglycemic Agents; Drugs Used in Diabetes; Alimentary Tract and Metabolism; Blood Glucose Lowering Drugs, Excl. Insulins | |
| Elosulfase alpha | Enzymes; Alimentary Tract and Metabolism | |
| Elotuzumab | | US2014055370 |
| Evolocumab | Lipid Modifying Agents, Plain; Cardiovascular System | |
| Fibrinogen Concentrate (Human) | | |
| Filgrastim-sndz | | |
| Gastric intrinsic factor | | |
| Hepatitis B immune globulin | | |
| Human calcitonin | | |
| Human Clostridium tetani toxoid immune globulin | | |
| Human rabies virus immune globulin | | |
| Human Rho(D) immune globulin | | |
| Hyaluronidase (Human Recombi nt) | | U.S. Pat. No. 7,767,429 |
| Idarucizumab | Anticoagulant | |
| Immune Globulin Human | Immunologic Factors; Immunosuppressive Agents; Anti-Infective Agents | |
| Vedolizumab | Immunosupressive agent, Antineoplastic agent | US2012151248 |
| Ustekinumab | Deramtologic agent, Immunosuppressive agent, antineoplastic agent | |
| Turoctocog alpha | | |
| Tuberculin Purified Protein Derivative | | |
| Simoctocog alpha | Antihaemorrhagics: blood coagulation factor VIII | |
| Siltuximab | Antineoplastic and Immunomodulating Agents, Immunosuppressive Agents | U.S. Pat. No. 7,612,182 |
| Sebelipase alpha | Enzymes | |
| Sacrosidase | Enzymes | |
| Ramucirumab | Antineoplastic and Immunomodulating Agents | US2013067098 |
| Prothrombin complex concentrate | | |
| Poractant alpha | Pulmo ry Surfactants | |
| Pembrolizumab | Antineoplastic and Immunomodulating Agents | US2012135408 |
| Peginterferon beta-1a | | |
| Ofatumumab | Antineoplastic and Immunomodulating Agents | U.S. Pat. No. 8,337,847 |
| Obiltoxaximab | | |
| Nivolumab | Antineoplastic and Immunomodulating Agents | US2013173223 |
| Necitumumab | | |
| Metreleptin | | US20070099836 |
| Methoxy polyethylene glycol-epoetin beta | | |
| Mepolizumab | Antineoplastic and Immunomodulating Agents, Immunosuppressive Agents, Interleukin Inhibitors | US2008134721 |
| Ixekizumab | | |
| Insulin Pork | Hypoglycemic Agents, Antidiabetic Agents | |
| Insulin Degludec | | |
| Insulin Beef | | |
| Thyroglobulin | Hormone therapy | U.S. Pat. No. 5,099,001 |
| Anthrax immune globulin human | Plasma derivative | |
| Anti-inhibitor coagulant complex | Blood Coagulation Factors, Antihemophilic Agent | |
| Anti-thymocyte Globulin (Equine) | Antibody | |
| Anti-thymocyte Globulin (Rabbit) | Antibody | |
| Brodalumab | Antineoplastic and Immunomodulating Agents | |
| C1 Esterase Inhibitor (Recombi nt) | Blood and Blood Forming Organs | |
| Ca kinumab | Antineoplastic and Immunomodulating Agents | |
| Chorionic Go dotropin (Human) | Hormones | U.S. Pat. No. 6,706,681 |
| Chorionic Go dotropin (Recombi nt) | Hormones | U.S. Pat. No. 5,767,251 |
| Coagulation factor X human | Blood Coagulation Factors | |

TABLE 47-continued

Exemplary protein and peptide therapeutics.

| Therapeutic peptide | Category | Pat. No. |
|---|---|---|
| Dinutuximab | Antibody, Immunosuppresive agent, Antineoplastic agent | US20140170155 |
| Efmoroctocog alpha | Antihemophilic Factor | |
| Factor IX Complex (Human) | Antihemophilic agent | |
| Hepatitis A Vaccine | Vaccine | |
| Human Varicella-Zoster Immune Globulin | Antibody | |
| Ibritumomab tiuxetan | Antibody, Immunosuppressive Agents | CA2149329 |
| Lenograstim | Antineoplastic and Immunomodulating Agents | |
| Pegloticase | Enzymes | |
| Protamine sulfate | Heparin Antagonists, Hematologic Agents | |
| Protein S human | Anticoagulant plasma protein | |
| Sipuleucel-T | Antineoplastic and Immunomodulating Agents | U.S. Pat. No. 8,153,120 |
| Somatropin recombi nt | Hormones, Hormone Substitutes, and Hormone Antagonists | CA1326439, CA2252535, U.S. Pat. No. 5,288,703, U.S. Pat. No. 5,849,700, U.S. Pat. No. 5,849,704, U.S. Pat. No. 5,898,030, U.S. Pat. No. 6,004,297, U.S. Pat. No. 6,152,897, U.S. Pat. No. 6,235,004, U.S. Pat. No. 6,899,699 |
| Susoctocog alpha | Blood coagulation factors, Antihaemorrhagics | |
| Thrombomodulin alpha | Anticoagulant agent, Antiplatelet agent | |

TABLE 48

Exemplary monoclonal antibody therapies.

| mAb | Target | Indication |
|---|---|---|
| Muromonab-CD3 | CD3 | Kidney transplant rejection |
| Abciximab | GPIIb/IIIa | Prevention of blood dots in angioplasty |
| Rituximab | CD20 | Non-Hodgkin lymphoma |
| Palivizumab | RSV | Prevention of respiratory syncytial virus infection |
| Infliximab | TNFα | Crohn's disease |
| Trastuzumab | HER2 | Breast cancer |
| Alemtuzumab | CD52 | Chronic myeloid leukemia |
| Adalimumab | TNFα | Rheumatoid arthritis |
| Ibritumomab tiuxetan | CD20 | Non-Hodgkin lymphoma |
| Omalizumab | IgE | Asthma |
| Cetuximab | EGER | Colorectal cancer |
| Bevacizumab | VEGF-A | Colorectal cancer |
| Natalizumab | ITGA4 | Multiple sclerosis |
| Panitumumab | EGFR | Colorectal cancer |
| Ranibizumab | VEGF-A | Macular degeneration |
| Eculizumab | C5 | Paroxysmal nocturnal hemoglobinuria |
| Certolizumab pegol | TNFα | Crohn's disease |
| Ustekinumab | IL-12/23 | Psoriasis |

TABLE 48-continued

Exemplary monoclonal antibody therapies.

| mAb | Target | Indication |
|---|---|---|
| Canakinumab | IL-1β | Muckle-Wells syndrome |
| Golimumab | TNFα | Rheumatoid and psoriatic arthritis, ankylosing spondylitis |
| Ofatumumab | CD20 | Chronic lymphocytic leukemia |
| Tocilizumab | IL-6R | Rheumatoid arthritis |
| Denosumab | RANKE | Bone loss |
| Belimumab | BLyS | Systemic lupus erythematosus |
| Ipilimumab | CTLA-4 | Metastatic melanoma |
| Brentuximab vedotin | CD30 | Hodgkin lymphoma, systemic anaplastic large cell lymphoma |
| Pertuzumab | HER2 | Breast Cancer |
| Trastuzumab emtansine | HER2 | Breast cancer |
| Raxibacumab | B. anthrasis PA | Anthrax infection |
| Obinutuzumab | CD20 | Chronic lymphocytic leukemia |
| Siltuximab | IL-6 | Castleman disease |
| Ramucirumab | VEGFR2 | Gastric cancer |
| Vedolizumab | α4β7 integrin | Ulcerative colitis, Crohn disease |
| Blinatumomab | CD19, CD3 | Acute lymphoblastic leukemia |
| Nivolumab | PD-1 | Melanoma, non-small cell lung cancer |
| Pembrolizumab | PD-1 | Melanoma |
| Idarucizumab | Dabigatran | Reversal of dabigatran-induced anticoagulation |
| Necitumumab | EGFR | Non-small cell lung cancer |
| Dinutuximab | GD2 | Neuroblastoma |
| Secukinumab | IL-17α | Psoriasis |
| Mepolizumab | IL-5 | Severe eosinophilic asthma |
| Alirocurnab | PCSK9 | High cholesterol |
| Evoloeumab | PCSK9 | High cholesterol |
| Daratumumab | CD38 | Multiple myeloma |
| Elotuzumab | SLAMF7 | Muitiple myeloma |
| Ixekizumab | IL-17α | Psoriasis |
| Reslizumab | IL-5 | Asthma |
| Olaratumab | PDGFRα | Soft tissue sarcoma |
| Bezlotoxumab | Clostridium difficile enterotoxin B | Prevention of Clostridium difficile infection recurrence |
| Atezoiizumab | PD-L1 | Bladder cancer |
| Obiltoxaximab | B. anthrasis PA | Prevention of inhalational anthrax |
| Inotuzumab ozogamicin | CD22 | Acute lymphoblastic leukemia |
| Brodalumab | IL-17R | Plaque psoriasis |
| Guselkumab | IL-23 p19 | Plaque psoriasis |
| Dupilumab | IL-4Rα | Atopic dermatitis |
| Sarilumab | IL-6R | Rheumatoid arthritis |
| Avelumab | PD-L1 | Merkel cell carcinoma |
| Ocrelizumab | CD20 | Multiple sclerosis |
| Emicizumab | Factor IXa, X | Hemophilia A |
| Benralizumab | IL-5Rα | Asthma |
| Gemtuzumab ozogamicin | CD33 | Acute myeloid leukemia |
| Durvalumab | PD-L1 | Bladder cancer |
| Burosumab | FGF23 | X-linked hypophosphatemia |
| Lanadelumab | Plasma kallikrein | Hereditary angioedema attacks |
| Mogamulizumab | CCR4 | Mycosis fungoides or Sézary syndrome |
| Erenumab | CGRPR | Migraine prevention |
| Galcanezumab | CGRP | Migraine prevention |
| Tildrakizumab | IL-23 p19 | Plaque psoriasis |
| Cemiplimab | PD-1 | Cutaneous squamous cell carcinoma |
| Emapalumab | IFNγ | Primary hemophagocytic lymphohistiocytosis |
| Fremanezumab | CGRP | Migraine prevention |
| Ibalizumab | CD4 | HIV infection |
| Moxetumomab pasudodox | CD22 | Hairy cell leukemia |
| Ravulizuniab | C5 | Paroxysmal nocturnal hemoglobinuria |
| Caplacizumab | von Willebrand factor | Acquired thrombotic thrombocytopenic purpura |
| Romosozurnab | Sclerostin | Osteoporosis in postmenopausal women at increased risk of fracture |

TABLE 48-continued

Exemplary monoclonal antibody therapies.

| mAb | Target | Indication |
|---|---|---|
| Risankizumab | IL-23 p19 | Plaque psoriasis |
| Polatuzumab vedotin | CD79P | Diffuse large B-cell lymphoma |
| Brolucizumab | VEGF-A | Macular degeneration |
| Crizanlizumab | P-selectin | Sickle cell disease |

Plant-Modification Methods

GENE WRITER™ systems described herein may be used to modify a plant or a plant part (e.g., leaves, roots, flowers, fruits, or seeds), e.g., to increase the fitness of a plant.

A. Delivery to a Plant

Provided herein are methods of delivering a GENE WRITER™ system described herein to a plant. Included are methods for delivering a GENE WRITER™ system to a plant by contacting the plant, or part thereof, with a GENE WRITER™ system. The methods are useful for modifying the plant to, e.g., increase the fitness of a plant.

More specifically, in some embodiments, a nucleic acid described herein (e.g., a nucleic acid encoding a GENE WRITER™) may be encoded in a vector, e.g., inserted adjacent to a plant promoter, e.g., a maize ubiquitin promoter (ZmUBI) in a plant vector (e.g., pHUC411). In some embodiments, the nucleic acids described herein are introduced into a plant (e.g., japonica rice) or part of a plant (e.g., a callus of a plant) via agrobacteria. In some embodiments, the systems and methods described herein can be used in plants by replacing a plant gene (e.g., hygromycin phosphotransferase (HPT)) with a null allele (e.g., containing a base substitution at the start codon). Systems and methods for modifying a plant genome are described in Xu et. al. *Development of plant prime-editing systems for precise genome editing*, 2020, Plant Communications.

In one aspect, provided herein is a method of increasing the fitness of a plant, the method including delivering to the plant the GENE WRITER™ system described herein (e.g., in an effective amount and duration) to increase the fitness of the plant relative to an untreated plant (e.g., a plant that has not been delivered the GENE WRITER™ system).

An increase in the fitness of the plant as a consequence of delivery of a GENE WRITER™ system can manifest in a number of ways, e.g., thereby resulting in a better production of the plant, for example, an improved yield, improved vigor of the plant or quality of the harvested product from the plant, an improvement in pre- or post-harvest traits deemed desirable for agriculture or horticulture (e.g., taste, appearance, shelf life), or for an improvement of traits that otherwise benefit humans (e.g., decreased allergen production). An improved yield of a plant relates to an increase in the yield of a product (e.g., as measured by plant biomass, grain, seed or fruit yield, protein content, carbohydrate or oil content or leaf area) of the plant by a measurable amount over the yield of the same product of the plant produced under the same conditions, but without the application of the instant compositions or compared with application of conventional plant-modifying agents. For example, yield can be increased by at least about 0.5%, about 1%, about 2%, about 3%, about 4%, about 5%, about 10%, about 20%, about 30%, about 40%, about 50%, about 60%, about 70%, about 80%, about 90%, about 100%, or more than 100%. In some instances, the method is effective to increase yield by about 2x-fold, 5x-fold, 10x-fold, 25x-fold, 50x-fold, 75x-fold, 100x-fold, or more than 100x-fold relative to an untreated plant. Yield can be expressed in terms of an amount by weight or volume of the plant or a product of the plant on some basis. The basis can be expressed in terms of time, growing area, weight of plants produced, or amount of a raw material used. For example, such methods may increase the yield of plant tissues including, but not limited to: seeds, fruits, kernels, bolls, tubers, roots, and leaves.

An increase in the fitness of a plant as a consequence of delivery of a GENE WRITER™ system can also be measured by other means, such as an increase or improvement of the vigor rating, the stand (the number of plants per unit of area), plant height, stalk circumference, stalk length, leaf number, leaf size, plant canopy, visual appearance (such as greener leaf color), root rating, emergence, protein content, increased tillering, bigger leaves, more leaves, less dead basal leaves, stronger tillers, less fertilizer needed, less seeds needed, more productive tillers, earlier flowering, early grain or seed maturity, less plant verse (lodging), increased shoot growth, earlier germination, or any combination of these factors, by a measurable or noticeable amount over the same factor of the plant produced under the same conditions, but without the administration of the instant compositions or with application of conventional plant-modifying agents.

Accordingly, provided herein is a method of modifying a plant, the method including delivering to the plant an effective amount of any of the GENE WRITER™ systems provided herein, wherein the method modifies the plant and thereby introduces or increases a beneficial trait in the plant (e.g., by about 1%, 2%, 5%, 10%, 20%, 30%, 40%, 50%, 60%, 70%, 80%, 90%, 100%, or more than 100%) relative to an untreated plant. In particular, the method may increase the fitness of the plant (e.g., by about 1%, 2%, 5%, 10%, 20%, 30%, 40%, 50%, 60%, 70%, 80%, 90%, 100%, or more than 100%) relative to an untreated plant.

In some instances, the increase in plant fitness is an increase (e.g., by about 1%, 2%, 5%, 10%, 20%, 30%, 40%, 50%, 60%, 70%, 80%, 90%, 100%, or more than 100%) in disease resistance, drought tolerance, heat tolerance, cold tolerance, salt tolerance, metal tolerance, herbicide tolerance, chemical tolerance, water use efficiency, nitrogen utilization, resistance to nitrogen stress, nitrogen fixation, pest resistance, herbivore resistance, pathogen resistance, yield, yield under water-limited conditions, vigor, growth, photosynthetic capability, nutrition, protein content, carbohydrate content, oil content, biomass, shoot length, root length, root architecture, seed weight, or amount of harvestable produce.

In some instances, the increase in fitness is an increase (e.g., by about 1%, 2%, 5%, 10%, 20%, 30%, 40%, 50%, 60%, 70%, 80%, 90%, 100%, or more than 100%) in development, growth, yield, resistance to abiotic stressors, or resistance to biotic stressors. An abiotic stress refers to an environmental stress condition that a plant or a plant part is subjected to that includes, e.g., drought stress, salt stress, heat stress, cold stress, and low nutrient stress. A biotic stress refers to an environmental stress condition that a plant or plant part is subjected to that includes, e.g. nematode stress, insect herbivory stress, fungal pathogen stress, bacterial pathogen stress, or viral pathogen stress. The stress may be temporary, e.g. several hours, several days, several months, or permanent, e.g, for the life of the plant.

In some instances, the increase in plant fitness is an increase (e.g., by about 1%, 2%, 5%, 10%, 20%, 30%, 40%, 50%, 60%, 70%, 80%, 90%, 100%, or more than 100%) in quality of products harvested from the plant. For example, the increase in plant fitness may be an improvement in commercially favorable features (e.g., taste or appearance)

of a product harvested from the plant. In other instances, the increase in plant fitness is an increase in shelf-life of a product harvested from the plant (e.g., by about 1%, 2%, 5%, 10%, 20%, 30%, 40%, 50%, 60%, 70%, 80%, 90%, 100%, or more than 100%).

Alternatively, the increase in fitness may be an alteration of a trait that is beneficial to human or animal health, such as a reduction in allergen production. For example, the increase in fitness may be a decrease (e.g., by about 1%, 2%, 5%, 10%, 20%, 30%, 40%, 50%, 60%, 70%, 80%, 90%, 100%, or more than 100%) in production of an allergen (e.g., pollen) that stimulates an immune response in an animal (e.g., human).

The modification of the plant (e.g., increase in fitness) may arise from modification of one or more plant parts. For example, the plant can be modified by contacting leaf, seed, pollen, root, fruit, shoot, flower, cells, protoplasts, or tissue (e.g., meristematic tissue) of the plant. As such, in another aspect, provided herein is a method of increasing the fitness of a plant, the method including contacting pollen of the plant with an effective amount of any of the plant-modifying compositions herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In yet another aspect, provided herein is a method of increasing the fitness of a plant, the method including contacting a seed of the plant with an effective amount of any of the GENE WRITER™ systems disclosed herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In another aspect, provided herein is a method including contacting a protoplast of the plant with an effective amount of any of the GENE WRITER™ systems described herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In a further aspect, provided herein is a method of increasing the fitness of a plant, the method including contacting a plant cell of the plant with an effective amount of any of the GENE WRITER™ system described herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In another aspect, provided herein is a method of increasing the fitness of a plant, the method including contacting meristematic tissue of the plant with an effective amount of any of the plant-modifying compositions herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

In another aspect, provided herein is a method of increasing the fitness of a plant, the method including contacting an embryo of the plant with an effective amount of any of the plant-modifying compositions herein, wherein the method increases the fitness of the plant (e.g., by about 1%, 2%, 5%, 10%, 20%, 30%, 40%, 50%, 60%, 70%, 80%, 90%, 100%, or more than 100%) relative to an untreated plant.

B. Application Methods

A plant described herein can be exposed to any of the GENE WRITER™ system compositions described herein in any suitable manner that permits delivering or administering the composition to the plant. The GENE WRITER™ system may be delivered either alone or in combination with other active (e.g., fertilizing agents) or inactive substances and may be applied by, for example, spraying, injection (e.g., microinjection), through plants, pouring, dipping, in the form of concentrated liquids, gels, solutions, suspensions, sprays, powders, pellets, briquettes, bricks and the like, formulated to deliver an effective concentration of the plant-modifying composition. Amounts and locations for application of the compositions described herein are generally determined by the habitat of the plant, the lifecycle stage at which the plant can be targeted by the plant-modifying composition, the site where the application is to be made, and the physical and functional characteristics of the plant-modifying composition.

In some instances, the composition is sprayed directly onto a plant, e.g., crops, by e.g., backpack spraying, aerial spraying, crop spraying/dusting etc. In instances where the GENE WRITER™ system is delivered to a plant, the plant receiving the GENE WRITER™ system may be at any stage of plant growth. For example, formulated plant-modifying compositions can be applied as a seed-coating or root treatment in early stages of plant growth or as a total plant treatment at later stages of the crop cycle. In some instances, the plant-modifying composition may be applied as a topical agent to a plant.

Further, the GENE WRITER™ system may be applied (e.g., in the soil in which a plant grows, or in the water that is used to water the plant) as a systemic agent that is absorbed and distributed through the tissues of a plant. In some instances, plants or food organisms may be genetically transformed to express the GENE WRITER™ system.

Delayed or continuous release can also be accomplished by coating the GENE WRITER™ system or a composition with the plant-modifying composition(s) with a dissolvable or bioerodable coating layer, such as gelatin, which coating dissolves or erodes in the environment of use, to then make the plant-modifying com GENE WRITER™ system position available, or by dispersing the agent in a dissolvable or erodable matrix. Such continuous release and/or dispensing means devices may be advantageously employed to consistently maintain an effective concentration of one or more of the plant-modifying compositions described herein.

In some instances, the GENE WRITER™ system is delivered to a part of the plant, e.g., a leaf, seed, pollen, root, fruit, shoot, or flower, or a tissue, cell, or protoplast thereof. In some instances, the GENE WRITER™ system is delivered to a cell of the plant. In some instances, the GENE WRITER™ system is delivered to a protoplast of the plant. In some instances, the GENE WRITER™ system is delivered to a tissue of the plant. For example, the composition may be delivered to meristematic tissue of the plant (e.g., apical meristem, lateral meristem, or intercalary meristem). In some instances, the composition is delivered to permanent tissue of the plant (e.g., simple tissues (e.g., parenchyma, collenchyma, or sclerenchyma) or complex permanent tissue (e.g., xylem or phloem)). In some instances, the GENE WRITER™ system is delivered to a plant embryo.

C. Plants

A variety of plants can be delivered to or treated with a GENE WRITER™ system described herein. Plants that can be delivered a GENE WRITER™ system (i.e., "treated") in accordance with the present methods include whole plants and parts thereof, including, but not limited to, shoot vegetative organs/structures (e.g., leaves, stems and tubers), roots, flowers and floral organs/structures (e.g., bracts, sepals, petals, stamens, carpels, anthers and ovules), seed (including embryo, endosperm, cotyledons, and seed coat)

and fruit (the mature ovary), plant tissue (e.g., vascular tissue, ground tissue, and the like) and cells (e.g., guard cells, egg cells, and the like), and progeny of same. Plant parts can further refer parts of the plant such as the shoot, root, stem, seeds, stipules, leaves, petals, flowers, ovules, bracts, branches, petioles, internodes, bark, pubescence, tillers, rhizomes, fronds, blades, pollen, stamen, and the like.

The class of plants that can be treated in a method disclosed herein includes the class of higher and lower plants, including angiosperms (monocotyledonous and dicotyledonous plants), gymnosperms, ferns, horsetails, psilophytes, lycophytes, bryophytes, and algae (e.g., multicellular or unicellular algae). Plants that can be treated in accordance with the present methods further include any vascular plant, for example monocotyledons or dicotyledons or gymnosperms, including, but not limited to alfalfa, apple, Arabidopsis, banana, barley, canola, castor bean, chrysanthemum, clover, cocoa, coffee, cotton, cottonseed, corn, crambe, cranberry, cucumber, dendrobium, dioscorea, eucalyptus, fescue, flax, gladiolus, liliacea, linseed, millet, muskmelon, mustard, oat, oil palm, oilseed rape, papaya, peanut, pineapple, ornamental plants, Phaseolus, potato, rapeseed, rice, rye, ryegrass, safflower, sesame, sorghum, soybean, sugarbect, sugarcane, sunflower, strawberry, tobacco, tomato, turfgrass, wheat and vegetable crops such as lettuce, celery, broccoli, cauliflower, cucurbits; fruit and nut trees, such as apple, pear, peach, orange, grapefruit, lemon, lime, almond, pecan, walnut, hazel; vines, such as grapes (e.g., a vineyard), kiwi, hops; fruit shrubs and brambles, such as raspberry, blackberry, gooseberry; forest trees, such as ash, pine, fir, maple, oak, chestnut, popular; with alfalfa, canola, castor bean, corn, cotton, crambe, flax, linseed, mustard, oil palm, oilseed rape, peanut, potato, rice, safflower, sesame, soybean, sugarbeet, sunflower, tobacco, tomato, and wheat. Plants that can be treated in accordance with the methods of the present invention include any crop plant, for example, forage crop, oilseed crop, grain crop, fruit crop, vegetable crop, fiber crop, spice crop, nut crop, turf crop, sugar crop, beverage crop, and forest crop. In certain instances, the crop plant that is treated in the method is a soybean plant. In other certain instances, the crop plant is wheat. In certain instances, the crop plant is corn. In certain instances, the crop plant is cotton. In certain instances, the crop plant is alfalfa. In certain instances, the crop plant is sugarbeet. In certain instances, the crop plant is rice. In certain instances, the crop plant is potato. In certain instances, the crop plant is tomato.

In certain instances, the plant is a crop. Examples of such crop plants include, but are not limited to, monocotyledonous and dicotyledonous plants including, but not limited to, fodder or forage legumes, ornamental plants, food crops, trees, or shrubs selected from Acer spp., *Allium* spp., *Amaranthus* spp., *Ananas comosus, Apium graveolens, Arachis* spp, *Asparagus officinalis, Beta vulgaris, Brassica* spp. (e.g., *Brassica napus, Brassica rapa* ssp. (canola, oilseed rape, turnip rape), *Camellia sinensis, Canna indica, Cannabis saliva, Capsicum* spp., *Castanea* spp., *Cichorium endivia, Citrullus lanatus*, Citrus spp., *Cocos* spp., *Coffea* spp., *Coriandrum sativum, Corylus* spp., *Crataegus* spp., *Cucurbita* spp., *Cucumis* spp., *Daucus carota, Fagus* spp., *Ficus carica*, Fragaria spp., *Ginkgo biloba*, Glycine spp. (e.g., *Glycine max, Soja hispida* or *Soja* max), *Gossypium hirsutum, Helianthus* spp. (e.g., *Helianthus annuus*), Hibiscus spp., *Hordeum* spp. (e.g., *Hordeum vulgare*), *Ipomoca batatas, Juglans* spp., *Lactuca sativa, Linum usitatissimum, Litchi chinensis, Lotus* spp., *Luffa acutangula, Lupinus* spp., *Lycopersicon* spp. (e.g., *Lycopersicon esculenturn, Lycopersicon lycopersicum, Lycopersicon pyriforme*), *Malus* spp., *Medicago sativa, Mentha* spp., *Miscanthus sinensis, Morus nigra, Musa* spp., *Nicotiana* spp., *Olea* spp., *Oryza* spp. (e.g., *Oryza sativa, Oryza latifolia*), *Panicum miliaceum, Panicum virgatum, Passiflora edulis, Petroselinum crispum, Phaseolus* spp., *Pinus* spp., *Pistacia vera, Pisum* spp., *Poa* spp., *Populus* spp., *Prunus* spp., *Pyrus communis, Quercus* spp., *Raphanus sativus, Rheum rhabarbarum, Ribes* spp., *Ricinus communis, Rubus* spp., *Saccharum* spp., Salix sp., *Sambucus* spp., *Secale cercale, Sesamum* spp., *Sinapis* spp., *Solanum* spp. (e.g., *Solanum tuberosum, Solanum integrifolium* or *Solanum lycopersicum*), *Sorghum bicolor, Sorghum halepense, Spinacia* spp., *Tamarindus indica, Theobroma cacao, Trifolium* spp., *Triticosecale rimpaui, Triticum* spp. (e.g., *Triticum aestivum, Triticum durum, Triticum turgidum, Triticum hybernum, Triticum macha, Triticum sativum* or *Triticum vulgare*), *Vaccinium* spp., *Vicia* spp., *Vigna* spp., *Viola odorata, Vitis* spp., and *Zea mays*. In certain embodiments, the crop plant is rice, oilseed rape, canola, soybean, corn (maize), cotton, sugarcane, alfalfa, sorghum, or wheat.

The plant or plant part for use in the present invention include plants of any stage of plant development. In certain instances, the delivery can occur during the stages of germination, seedling growth, vegetative growth, and reproductive growth. In certain instances, delivery to the plant occurs during vegetative and reproductive growth stages. In some instances, the composition is delivered to pollen of the plant. In some instances, the composition is delivered to a seed of the plant. In some instances, the composition is delivered to a protoplast of the plant. In some instances, the composition is delivered to a tissue of the plant. For example, the composition may be delivered to meristematic tissue of the plant (e.g., apical meristem, lateral meristem, or intercalary meristem). In some instances, the composition is delivered to permanent tissue of the plant (e.g., simple tissues (e.g., parenchyma, collenchyma, or sclerenchyma) or complex permanent tissue (e.g., xylem or phloem)). In some instances, the composition is delivered to a plant embryo. In some instances, the composition is delivered to a plant cell. The stages of vegetative and reproductive growth are also referred to herein as "adult" or "mature" plants.

In instances where the GENE WRITER™ system is delivered to a plant part, the plant part may be modified by the plant-modifying agent. Alternatively, the GENE WRITER™ system may be distributed to other parts of the plant (e.g., by the plant's circulatory system) that are subsequently modified by the plant-modifying agent.

Administration

The composition and systems described herein may be used in vitro or in vivo. In some embodiments the system or components of the system are delivered to cells (e.g., mammalian cells, e.g., human cells), e.g., in vitro or in vivo. In some embodiments, the cells are eukaryotic cells, e.g., cells of a multicellular organism, e.g., an animal, e.g., a mammal (e.g., human, swine, bovine) a bird (e.g., poultry, such as chicken, turkey, or duck), or a fish. In some embodiments, the cells are non-human animal cells (e.g., a laboratory animal, a livestock animal, or a companion animal). In some embodiments, the cell is a stem cell (e.g., a hematopoietic stem cell), a fibroblast, or a T cell. In some embodiments, the cell is a non-dividing cell, e.g., a non-dividing fibroblast or non-dividing T cell. In some embodiments, the cell is an HSC and p53 is not upregulated or is upregulated by less than 10%, 5%, 2%, or 1%, e.g., as determined according to the method described in Example 30 of PCT/US2019/048607 which is hereby incorporated by reference. The skilled artisan will understand that the components of the GENE WRITER™ system may be delivered in the form of polypeptide, nucleic acid (e.g., DNA, RNA), and combinations thereof.

For instance, delivery can use any of the following combinations for delivering the retrotransposase (e.g., as DNA encoding the retrotransposase protein, as RNA encoding the retrotransposase protein, or as the protein itself) and the template RNA (e.g., as DNA encoding the RNA, or as RNA):

1. Retrotransposase DNA+template DNA
2. Retrotransposase RNA+template DNA
3. Retrotransposase DNA+template RNA
4. Retrotransposase RNA+template RNA
5. Retrotransposase protein+template DNA
6. Retrotransposase protein+template RNA
7. Retrotransposase virus+template virus
8. Retrotransposase virus+template DNA
9. Retrotransposase virus+template RNA
10. Retrotransposase DNA+template virus
11. Retrotransposase RNA+template virus
12. Retrotransposase protein+template virus As indicated above, in some embodiments, the DNA or RNA that encodes the retrotransposase protein is delivered using a virus, and in some embodiments, the template RNA (or the DNA encoding the template RNA) is delivered using a virus.

In one embodiments the system and/or components of the system are delivered as nucleic acid. For example, the GENE WRITER™ polypeptide may be delivered in the form of a DNA or RNA encoding the polypeptide, and the template RNA may be delivered in the form of RNA or its complementary DNA to be transcribed into RNA. In some embodiments the system or components of the system are delivered on 1, 2, 3, 4, or more distinct nucleic acid molecules. In some embodiments the system or components of the system are delivered as a combination of DNA and RNA. In some embodiments the system or components of the system are delivered as a combination of DNA and protein. In some embodiments the system or components of the system are delivered as a combination of RNA and protein. In some embodiments the GENE WRITER™ genome editor polypeptide is delivered as a protein.

In some embodiments the system or components of the system are delivered to cells, e.g. mammalian cells or human cells, using a vector. The vector may be, e.g., a plasmid or a virus. In some embodiments delivery is in vivo, in vitro, ex vivo, or in situ. In some embodiments the virus is an adeno associated virus (AAV), a lentivirus, an adenovirus. In some embodiments the system or components of the system are delivered to cells with a viral-like particle or a virosome. In some embodiments the delivery uses more than one virus, viral-like particle or virosome.

In one embodiment, the compositions and systems described herein can be formulated in liposomes or other similar vesicles. Liposomes are spherical vesicle structures composed of a uni- or multilamellar lipid bilayer surrounding internal aqueous compartments and a relatively impermeable outer lipophilic phospholipid bilayer. Liposomes may be anionic, neutral or cationic. Liposomes are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi: 10.1155/2011/469679 for review).

Vesicles can be made from several different types of lipids; however, phospholipids are most commonly used to generate liposomes as drug carriers. Methods for preparation of multilamellar vesicle lipids are known in the art (see for example U.S. Pat. No. 6,693,086, the teachings of which relating to multilamellar vesicle lipid preparation are incorporated herein by reference). Although vesicle formation can be spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi: 10.1155/2011/469679 for review). Extruded lipids can be prepared by extruding through filters of decreasing size, as described in Templeton et al., Nature Biotech, 15:647-652, 1997, the teachings of which relating to extruded lipid preparation are incorporated herein by reference.

A variety of nanoparticles can be used for delivery, such as a liposome, a lipid nanoparticle, a cationic lipid nanoparticle, an ionizable lipid nanoparticle, a polymeric nanoparticle, a gold nanoparticle, a dendrimer, a cyclodextrin nanoparticle, a micelle, or a combination of the foregoing.

Lipid nanoparticles are an example of a carrier that provides a biocompatible and biodegradable delivery system for the pharmaceutical compositions described herein. Nanostructured lipid carriers (NLCs) are modified solid lipid nanoparticles (SLNs) that retain the characteristics of the SLN, improve drug stability and loading capacity, and prevent drug leakage. Polymer nanoparticles (PNPs) are an important component of drug delivery. These nanoparticles can effectively direct drug delivery to specific targets and improve drug stability and controlled drug release. Lipid-polymer nanoparticles (PLNs), a new type of carrier that combines liposomes and polymers, may also be employed. These nanoparticles possess the complementary advantages of PNPs and liposomes. A PLN is composed of a core-shell structure; the polymer core provides a stable structure, and the phospholipid shell offers good biocompatibility. As such, the two components increase the drug encapsulation efficiency rate, facilitate surface modification, and prevent leakage of water-soluble drugs. For a review, see, e.g., Li et al. 2017, Nanomaterials 7, 122; doi: 10.3390/nano7060122.

Exosomes can also be used as drug delivery vehicles for the compositions and systems described herein. For a review, see Ha et al. July 2016. Acta Pharmaceutica Sinica B. Volume 6, Issue 4, Pages 287-296; doi.org/10.1016/j.apsb.2016.02.001.

Fusosomes interact and fuse with target cells, and thus can be used as delivery vehicles for a variety of molecules. They generally consist of a bilayer of amphipathic lipids enclosing a lumen or cavity and a fusogen that interacts with the amphipathic lipid bilayer. The fusogen component has been shown to be engineerable in order to confer target cell specificity for the fusion and payload delivery, allowing the creation of delivery vehicles with programmable cell specificity (see for example Patent Application WO2020014209, the teachings of which relating to fusosome design, preparation, and usage are incorporated herein by reference).

In some embodiments, the protein component(s) of the GENE WRITING™ system may be pre-associated with the template nucleic acid (e.g., template RNA). For example, in some embodiments, the GENE WRITER™ polypeptide may be first combined with the template nucleic acid (e.g., template RNA) to form a ribonucleoprotein (RNP) complex.

In some embodiments, the RNP may be delivered to cells via, e.g., transfection, nucleofection, virus, vesicle, LNP, exosome, fusosome.

A GENE WRITER™ system can be introduced into cells, tissues and multicellular organisms. In some embodiments the system or components of the system are delivered to the cells via mechanical means or physical means.

Formulation of protein therapeutics is described in Meyer (Ed.), *Therapeutic Protein Drug Products: Practical Approaches to formulation in the Laboratory, Manufacturing, and the Clinic*, Woodhead Publishing Series (2012).

Tissue Specific Activity/Administration

In some embodiments, a system, template RNA, or polypeptide described herein is administered to or is active in (e.g., is more active in) a target tissue, e.g., a first tissue. In some embodiments, the system, template RNA, or polypeptide is not administered to or is less active in (e.g., not active in) a non-target tissue. In some embodiments, a system, template RNA, or polypeptide described herein is useful for modifying DNA in a target tissue, e.g., a first tissue, (e.g., and not modifying DNA in a non-target tissue).

In some embodiments, a system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, the nucleic acid in (b) comprises RNA.

In some embodiments, the nucleic acid in (b) comprises DNA.

In some embodiments, the nucleic acid in (b): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (b) is double-stranded or comprises a double-stranded segment.

In some embodiments, (a) comprises a nucleic acid encoding the polypeptide.

In some embodiments, the nucleic acid in (a) comprises RNA.

In some embodiments, the nucleic acid in (a) comprises DNA.

In some embodiments, the nucleic acid in (a): (i) is single-stranded or comprises a single-stranded segment, e.g., is single-stranded DNA or comprises a single-stranded segment and one or more double stranded segments; (ii) has inverted terminal repeats; or (iii) both (i) and (ii).

In some embodiments, the nucleic acid in (a) is double-stranded or comprises a double-stranded segment.

In some embodiments, the nucleic acid in (a), (b), or (a) and (b) is linear.

In some embodiments, the nucleic acid in (a), (b), or (a) and (b) is circular, e.g., a plasmid or minicircle.

In some embodiments, the heterologous object sequence is in operative association with a first promoter.

In some embodiments, the one or more first tissue-specific expression-control sequences comprises a tissue specific promoter.

In some embodiments, the tissue-specific promoter comprises a first promoter in operative association with: i. the heterologous object sequence, ii. a nucleic acid encoding the transposase, or iii. (i) and (ii).

In some embodiments, the one or more first tissue-specific expression-control sequences comprises a tissue-specific microRNA recognition sequence in operative association with: i. the heterologous object sequence, ii. a nucleic acid encoding the transposase, or iii. (i) and (ii). In some embodiments, a system comprises a tissue-specific promoter, and the system further comprises one or more tissue-specific microRNA recognition sequences, wherein: i. the tissue specific promoter is in operative association with: I. the heterologous object sequence, II. a nucleic acid encoding the transposase, or III. (I) and (II); and/or ii. the one or more tissue-specific microRNA recognition sequences are in operative association with: I. the heterologous object sequence, II. a nucleic acid encoding the transposase, or III. (I) and (II).

In some embodiments, wherein (a) comprises a nucleic acid encoding the polypeptide, the nucleic acid comprises a promoter in operative association with the nucleic acid encoding the polypeptide.

In some embodiments, the nucleic acid encoding the polypeptide comprises one or more second tissue-specific expression-control sequences specific to the target tissue in operative association with the polypeptide coding sequence.

In some embodiments, the one or more second tissue-specific expression-control sequences comprises a tissue specific promoter.

In some embodiments, the tissue-specific promoter is the promoter in operative association with the nucleic acid encoding the polypeptide.

In some embodiments, the one or more second tissue-specific expression-control sequences comprises a tissue-specific microRNA recognition sequence.

In some embodiments, the promoter in operative association with the nucleic acid encoding the polypeptide is a tissue-specific promoter, the system further comprising one or more tissue-specific microRNA recognition sequences.

In some embodiments, a nucleic acid component of a system provided by the invention a sequence (e.g., encoding the polypeptide or comprising a heterologous object sequence) is flanked by untranslated regions (UTRs) that modify protein expression levels. Various 5' and 3' UTRs can affect protein expression. For example, in some embodiments, the coding sequence may be preceded by a 5' UTR that modifies RNA stability or protein translation. In some embodiments, the sequence may be followed by a 3' UTR that modifies RNA stability or translation. In some embodiments, the sequence may be preceded by a 5' UTR and followed by a 3' UTR that modify RNA stability or translation. In some embodiments, the 5' and/or 3' UTR may be selected from the 5' and 3' UTRs of complement factor 3 (C3) (cactcctccccatcctctccctctgtccc-tetgtccctctgaccctgcactgtcccagcacc (SEQ ID NO: 1633)) or orosomucoid 1 (ORM1) (caggacacagccttggatcaggacaga-gacttgggggccatcctgccccctccaacccgacatgtgtacctcagcttttccct-cacttgcat caataaagcttctgtgtttggaacagctaa (SEQ ID NO: 1634)) (Asrani et al. RNA Biology 2018). In certain embodiments, the 5' UTR is the 5' UTR from C3 and the 3' UTR is the 3' UTR from ORM1. In certain embodiments, a 5' UTR and 3' UTR for protein expression, e.g., mRNA (or DNA encoding the RNA) for a GENE WRITER™ polypeptide or heterologous object sequence, comprise optimized expression sequences. In some embodiments, the 5' UTR comprises GGGAAAUAAGAGAGAAAAGAAGAGU AAGAAGAAAUAUAAGAGCCACC (SEQ ID NO: 1603) and/or the 3' UTR comprising UGAUAAUAGGCUG- GAGCCUCGGUGGCCAUGCUUCUUGCCCCUUGGGCCUCCCCCC AGCCCCUCCUCCCCUUCCUGCACCCGUACCCCCGUGGUCUUUGAAUAAAGUCUGA (SEQ ID NO: 1604), e.g., as described in Richner et al. *Cell* 168 (6): P1114-1125 (2017), the sequences of which are incorporated herein by reference.

In some embodiments, a 5' and/or 3' UTR may be selected to enhance protein expression. In some embodiments, a 5' and/or 3' UTR may be selected to modify protein expression such that overproduction inhibition is minimized. In some embodiments, UTRs are around a coding sequence, e.g., outside the coding sequence and in other embodiments proximal to the coding sequence, In some embodiments additional regulatory elements (e.g., miRNA binding sites, cis-regulatory sites) are included in the UTRs.

In some embodiments, an open reading frame of a GENE WRITER™ system, e.g., an ORF of an mRNA (or DNA encoding an mRNA) encoding a GENE WRITER™ polypeptide or one or more ORFs of an mRNA (or DNA encoding an mRNA) of a heterologous object sequence, is flanked by a 5' and/or 3' untranslated region (UTR) that enhances the expression thereof. In some embodiments, the 5' UTR of an mRNA component (or transcript produced from a DNA component) of the system comprises the sequence 5'-GGGAAAUAAGAGAGAAAAGAA GAGUAAGAAGAAAUAUAAGAGCCACC-3' (SEQ ID NO: 1603). In some embodiments, the 3' UTR of an mRNA component (or transcript produced from a DNA component) of the system comprises the sequence 5'-UGAUAAUAGGCUGGAGCCUCGGUGGCCAUGCUUCUUGCCCCUUGGGCCUCCCCCC AGCCCCUCCUCCCCUUCCUGCACCCGUACCCCCGUGGUCUUUGAAUAAAGUCUGA-3' (SEQ ID NO: 1604). This combination of 5' UTR and 3' UTR has been shown to result in desirable expression of an operably linked ORF by Richner et al. *Cell* 168 (6): P1114-1125 (2017), the teachings and sequences of which are incorporated herein by reference. In some embodiments, a system described herein comprises a DNA encoding a transcript, wherein the DNA comprises the corresponding 5' UTR and 3' UTR sequences, with T substituting for U in the above-listed sequence). In some embodiments, a DNA vector used to produce an RNA component of the system further comprises a promoter upstream of the 5' UTR for initiating in vitro transcription, e.g, a T7, T3, or SP6 promoter. The 5' UTR above begins with GGG, which is a suitable start for optimizing transcription using T7 RNA polymerase. For tuning transcription levels and altering the transcription start site nucleotides to fit alternative 5' UTRs, the teachings of Davidson et al. *Pac Symp Biocomput* 433-443 (2010) describe T7 promoter variants, and the methods of discovery thereof, that fulfill both of these traits.

Viral Vectors and Components Thereof

Viruses are a useful source of delivery vehicles for the systems described herein, in addition to a source of relevant enzymes or domains as described herein, e.g., as sources of polymerases and polymerase functions used herein, e.g., DNA-dependent DNA polymerase, RNA-dependent RNA polymerase, RNA-dependent DNA polymerase, DNA-dependent RNA polymerase, reverse transcriptase. Some enzymes, e.g., reverse transcriptases, may have multiple activities, e.g., be capable of both RNA-dependent DNA polymerization and DNA-dependent DNA polymerization, e.g., first and second strand synthesis. In some embodiments, the virus used as a GENE WRITER™ delivery system or a source of components thereof may be selected from a group as described by Baltimore *Bacteriol Rev* 35 (3): 235-241 (1971).

In some embodiments, the virus is selected from a Group I virus, e.g., is a DNA virus and packages dsDNA into virions. In some embodiments, the Group I virus is selected from, e.g., Adenoviruses, Herpesviruses, Poxviruses.

In some embodiments, the virus is selected from a Group II virus, e.g., is a DNA virus and packages ssDNA into virions. In some embodiments, the Group II virus is selected from, e.g., Parvoviruses. In some embodiments, the parvovirus is a dependoparvovirus, e.g., an adeno-associated virus (AAV).

In some embodiments, the virus is selected from a Group III virus, e.g., is an RNA virus and packages dsRNA into virions. In some embodiments, the Group III virus is selected from, e.g., Reoviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group IV virus, e.g., is an RNA virus and packages ssRNA (+) into virions. In some embodiments, the Group IV virus is selected from, e.g., Coronaviruses, Picornaviruses, Togaviruses. In some embodiments, the ssRNA (+) contained in such virions is a coding molecule able to serve directly as mRNA upon transduction into a host cell, e.g., can be directly translated into protein upon transduction into a host cell without requiring any intervening nucleic acid replication or polymerization steps.

In some embodiments, the virus is selected from a Group V virus, e.g., is an RNA virus and packages ssRNA (−) into virions. In some embodiments, the Group V virus is selected from, e.g., Orthomyxoviruses, Rhabdoviruses. In some embodiments, an RNA virus with an ssRNA (−) genome also carries an enzyme inside the virion that is transduced to host cells with the viral genome, e.g., an RNA-dependent RNA polymerase, capable of copying the ssRNA (−) into ssRNA (+) that can be translated directly by the host.

In some embodiments, the virus is selected from a Group VI virus, e.g., is a retrovirus and packages ssRNA (+) into virions. In some embodiments, the Group VI virus is selected from, e.g., Retroviruses. In some embodiments, the retrovirus is a lentivirus, e.g., HIV-1, HIV-2, SIV, BIV. In some embodiments, the retrovirus is a spumavirus, e.g., a foamy virus, e.g., HFV, SFV, BFV. In some embodiments, the ssRNA (+) contained in such virions is a coding molecule able to serve directly as mRNA upon transduction into a host cell, e.g., can be directly translated into protein upon transduction into a host cell without requiring any intervening nucleic acid replication or polymerization steps. In some embodiments, the ssRNA (+) is first reverse transcribed and copied to generate a dsDNA genome intermediate from which mRNA can be transcribed in the host cell. In some embodiments, an RNA virus with an ssRNA (+) genome also carries an enzyme inside the virion that is transduced to host cells with the viral genome, e.g., an RNA-dependent DNA polymerase, capable of copying the ssRNA (+) into dsDNA that can be transcribed into mRNA and translated by the host. In some embodiments, the reverse transcriptase from a Group VI retrovirus is incorporated as the reverse transcriptase domain of a GENE WRITER™ polypeptide.

In some embodiments, the virus is selected from a Group VII virus, e.g., is a retrovirus and packages dsRNA into virions. In some embodiments, the Group VII virus is selected from, e.g., Hepadnaviruses. In some embodiments, one or both strands of the dsRNA contained in such virions is a coding molecule able to serve directly as mRNA upon transduction into a host cell, e.g., can be directly translated into protein upon transduction into a host cell without requiring any intervening nucleic acid replication or polymerization steps. In some embodiments, one or both strands of the dsRNA contained in such virions is first reverse transcribed and copied to generate a dsDNA genome intermediate from which mRNA can be transcribed in the host cell. In some embodiments, an RNA virus with a dsRNA genome also carries an enzyme inside the virion that is transduced to host cells with the viral genome, e.g., an RNA-dependent DNA polymerase, capable of copying the dsRNA into dsDNA that can be transcribed into mRNA and translated by the host. In some embodiments, the reverse transcriptase from a Group VII retrovirus is incorporated as the reverse transcriptase domain of a GENE WRITER™ polypeptide.

In some embodiments, virions used to deliver nucleic acid in this invention may also carry enzymes involved in the process of GENE WRITING™. For example, a retroviral virion may contain a reverse transcriptase domain that is delivered into a host cell along with the nucleic acid. In some embodiments, an RNA template may be associated with a GENE WRITER™ polypeptide within a virion, such that both are co-delivered to a target cell upon transduction of the nucleic acid from the viral particle. In some embodiments, the nucleic acid in a virion may comprise DNA, e.g., linear ssDNA, linear dsDNA, circular ssDNA, circular dsDNA, minicircle DNA, dbDNA, ceDNA. In some embodiments, the nucleic acid in a virion may comprise RNA, e.g., linear ssRNA, linear dsRNA, circular ssRNA, circular dsRNA. In some embodiments, a viral genome may circularize upon transduction into a host cell, e.g., a linear ssRNA molecule may undergo a covalent linkage to form a circular ssRNA, a linear dsRNA molecule may undergo a covalent linkage to form a circular dsRNA or one or more circular ssRNA. In some embodiments, a viral genome may replicate by rolling circle replication in a host cell. In some embodiments, a viral genome may comprise a single nucleic acid molecule, e.g., comprise a non-segmented genome. In some embodiments, a viral genome may comprise two or more nucleic acid molecules, e.g., comprise a segmented genome. In some embodiments, a nucleic acid in a virion may be associated with one or proteins. In some embodiments, one or more proteins in a virion may be delivered to a host cell upon transduction. In some embodiments, a natural virus may be adapted for nucleic acid delivery by the addition of virion packaging signals to the target nucleic acid, wherein a host cell is used to package the target nucleic acid containing the packaging signals.

In some embodiments, a virion used as a delivery vehicle may comprise a commensal human virus. In some embodiments, a virion used as a delivery vehicle may comprise an anellovirus, the use of which is described in WO2018232017A1, which is incorporated herein by reference in its entirety.

AAV Administration

In some embodiments, an adeno-associated virus (AAV) is used in conjunction with the system, template nucleic acid, and/or polypeptide described herein. In some embodiments, an AAV is used to deliver, administer, or package the system, template nucleic acid, and/or polypeptide described herein. In some embodiments, the AAV is a recombinant AAV (rAAV).

In some embodiments, a system comprises (a) a polypeptide described herein or a nucleic acid encoding the same, (b) a template nucleic acid (e.g., template RNA) described herein, and (c) one or more first tissue-specific expression-control sequences specific to the target tissue, wherein the one or more first tissue-specific expression-control sequences specific to the target tissue are in operative association with (a), (b), or (a) and (b), wherein, when associated with (a), (a) comprises a nucleic acid encoding the polypeptide.

In some embodiments, a system described herein further comprises a first recombinant adeno-associated virus (rAAV) capsid protein; wherein the at least one of (a) or (b) is associated with the first rAAV capsid protein, wherein at least one of (a) or (b) is flanked by AAV inverted terminal repeats (ITRs).

In some embodiments, (a) and (b) are associated with the first rAAV capsid protein.

In some embodiments, (a) and (b) are on a single nucleic acid.

In some embodiments, the system further comprises a second rAAV capsid protein, wherein at least one of (a) or (b) is associated with the second rAAV capsid protein, and wherein the at least one of (a) or (b) associated with the second rAAV capsid protein is different from the at least one of (a) or (b) is associated with the first rAAV capsid protein.

In some embodiments, the at least one of (a) or (b) is associated with the first or second rAAV capsid protein is dispersed in the interior of the first or second rAAV capsid protein, which first or second rAAV capsid protein is in the form of an AAV capsid particle.

In some embodiments, the system further comprises a nanoparticle, wherein the nanoparticle is associated with at least one of (a) or (b).

In some embodiments, (a) and (b), respectively are associated with: a) a first rAAV capsid protein and a second rAAV capsid protein; b) a nanoparticle and a first rAAV capsid protein; c) a first rAAV capsid protein; d) a first adenovirus capsid protein; e) a first nanoparticle and a second nanoparticle; or f) a first nanoparticle.

Viral vectors are useful for delivering all or part of a system provided by the invention, e.g., for use in methods provided by the invention. Systems derived from different viruses have been employed for the delivery of polypeptides, nucleic acids, or transposons; for example: integrase-deficient lentivirus, adenovirus, adeno-associated virus (AAV), herpes simplex virus, and baculovirus (reviewed in Hodge et al. Hum Gene Ther 2017; Narayanavari et al. Crit Rev Biochem Mol Biol 2017; Boehme et al. Curr Gene Ther 2015).

Adenoviruses are common viruses that have been used as gene delivery vehicles given well-defined biology, genetic stability, high transduction efficiency, and ease of large-scale production (see, for example, review by Lee et al. Genes & Diseases 2017). They possess linear dsDNA genomes and come in a variety of serotypes that differ in tissue and cell tropisms. In order to prevent replication of infectious virus in recipient cells, adenovirus genomes used for packaging are deleted of some or all endogenous viral proteins, which are provided in trans in viral production cells. This renders the genomes helper-dependent, meaning they can only be replicated and packaged into viral particles in the presence of the missing components provided by so-called helper functions. A helper-dependent adenovirus system with all viral ORFs removed may be compatible with packaging foreign DNA of up to ~37 kb (Parks et al. *J Virol* 1997). In some embodiments, an adenoviral vector is used to deliver DNA corresponding to the polypeptide or template component of the GENE WRITING™ system, or both are contained on separate or the same adenoviral vector. In some embodiments, the adenovirus is a helper-dependent adenovirus (HD-AdV) that is incapable of self-packaging. In some embodiments, the adenovirus is a high-capacity adenovirus (HC-AdV) that has had all or a substantial portion of endogenous viral ORFs deleted, while retaining the necessary sequence components for packaging into adenoviral particles. For this type of vector, the only adenoviral sequences required for genome packaging are noncoding sequences: the inverted terminal repeats (ITRs) at both ends and the packaging signal at the 5'-end (Jager et al. Nat Protoc 2009). In some embodiments, the adenoviral genome also comprises stuffer DNA to meet a minimal genome size for optimal production and stability (see, for example, Hausl et al. Mol Ther 2010). Adenoviruses have been used in the art for the delivery of transposons to various tissues. In some embodiments, an adenovirus is used to deliver a GENE WRITING™ system to the liver.

In some embodiments, an adenovirus is used to deliver a GENE WRITING™ system to HSCs, e.g., HDAd5/35++. HDAd5/35++ is an adenovirus with modified serotype 35 fibers that de-target the vector from the liver (Wang et al. Blood Adv 2019). In some embodiments, the adenovirus that delivers a GENE WRITING™ system to HSCs utilizes a receptor that is expressed specifically on primitive HSCs, e.g., CD46.

Adeno-associated viruses (AAV) belong to the parvoviridae family and more specifically constitute the dependoparvovirus genus. The AAV genome is composed of a linear single-stranded DNA molecule which contains approximately 4.7 kilobases (kb) and consists of two major open reading frames (ORFs) encoding the non-structural Rep (replication) and structural Cap (capsid) proteins. A second ORF within the cap gene was identified that encodes the assembly-activating protein (AAP). The DNAs flanking the AAV coding regions are two cis-acting inverted terminal repeat (ITR) sequences, approximately 145 nucleotides in length, with interrupted palindromic sequences that can be folded into energetically stable hairpin structures that function as primers of DNA replication. In addition to their role in DNA replication, the ITR sequences have been shown to be involved in viral DNA integration into the cellular genome, rescue from the host genome or plasmid, and encapsidation of viral nucleic acid into mature virions (Muzyczka, (1992) Curr. Top. Micro. Immunol. 158:97-129). In some embodiments, one or more GENE WRITING™ nucleic acid components is flanked by ITRs derived from AAV for viral packaging. See, e.g., WO2019113310.

In some embodiments, one or more components of the GENE WRITING™ system are carried via at least one AAV vector. In some embodiments, the at least one AAV vector is selected for tropism to a particular cell, tissue, organism. In some embodiments, the AAV vector is pseudotyped, e.g., AAV2/8, wherein AAV2 describes the design of the construct but the capsid protein is replaced by that from AAV8. It is understood that any of the described vectors could be pseudotype derivatives, wherein the capsid protein used to package the AAV genome is derived from that of a different AAV serotype. In some embodiments, an AAV to be employed for GENE WRITING™ may be evolved for novel cell or tissue tropism as has been demonstrated in the literature (e.g., Davidsson et al. Proc Natl Acad Sci USA 2019).

In some embodiments, the AAV delivery vector is a vector which has two AAV inverted terminal repeats (ITRs) and a nucleotide sequence of interest (for example, a sequence coding for a GENE WRITER™ polypeptide or a DNA template, or both), each of said ITRs having an interrupted (or noncontiguous) palindromic sequence, i.e., a sequence composed of three segments: a first segment and a last segment that are identical when read 5'>3' but hybridize when placed against each other, and a segment that is different that separates the identical segments. Such sequences, notably the ITRs, form hairpin structures. See, for example, WO2012123430.

Conventionally, AAV virions with capsids are produced by introducing a plasmid or plasmids encoding the rAAV or scAAV genome, Rep proteins, and Cap proteins (Grimm et al, 1998). Upon introduction of these helper plasmids in trans, the AAV genome is "rescued" (i.e., released and subsequently recovered) from the host genome, and is further encapsidated to produce infectious AAV. In some embodiments, one or more GENE WRITING™ nucleic acids are packaged into AAV particles by introducing the ITR-flanked nucleic acids into a packaging cell in conjunction with the helper functions.

In some embodiments, the AAV genome is a so called self-complementary genome (referred to as scAAV), such that the sequence located between the ITRs contains both the desired nucleic acid sequence (e.g., DNA encoding the GENE WRITER™ polypeptide or template, or both) in addition to the reverse complement of the desired nucleic acid sequence, such that these two components can fold over and self-hybridize. In some embodiments, the self-complementary modules are separated by an intervening sequence that permits the DNA to fold back on itself, e.g., forms a stem-loop. An scAAV has the advantage of being poised for transcription upon entering the nucleus, rather than being first dependent on ITR priming and second-strand synthesis to form dsDNA. In some embodiments, one or more GENE WRITING™ components is designed as an scAAV, wherein the sequence between the AAV ITRs contains two reverse complementing modules that can self-hybridize to create dsDNA.

In some embodiments, nucleic acid (e.g., encoding a polypeptide, or a template, or both) delivered to cells is closed-ended, linear duplex DNA (CELID DNA or ceDNA). In some embodiments, ceDNA is derived from the replicative form of the AAV genome (Li et al. PLOS One 2013). In some embodiments, the nucleic acid (e.g., encoding a polypeptide, or a template DNA, or both) is flanked by ITRs, e.g., AAV ITRs, wherein at least one of the ITRs comprises a terminal resolution site and a replication protein binding site (sometimes referred to as a replicative protein binding site). In some embodiments, the ITRs are derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, the ITRs are symmetric. In some embodiments, the ITRs are asymmetric. In some embodiments, at least one Rep protein is provided to enable replication of the construct. In some embodiments, the at least one Rep protein is derived from an adeno-associated virus, e.g., AAV1, AAV2, AAV3, AAV4, AAV5, AAV6, AAV7, AAV8, AAV9, AAV10, AAV11, AAV12, or a combination thereof. In some embodiments, ceDNA is generated by providing a production cell with (i) DNA flanked by ITRs, e.g., AAV ITRs, and (ii) components required for ITR-dependent replication, e.g., AAV proteins Rep78 and Rep52 (or nucleic acid encoding the proteins). In some embodiments, ceDNA is free of any capsid protein, e.g., is not packaged into an infectious AAV particle. In some embodiments, ceDNA is formulated into LNPs (see, for example, WO2019051289A1).

In some embodiments, the ceDNA vector consists of two self complementary sequences, e.g., asymmetrical or symmetrical or substantially symmetrical ITRs as defined herein, flanking said expression cassette, wherein the ceDNA vector is not associated with a capsid protein. In some embodiments, the ceDNA vector comprises two self-complementary sequences found in an AAV genome, where at least one ITR comprises an operative Rep-binding element (RBE) (also sometimes referred to herein as "RBS") and a terminal resolution site (trs) of AAV or a functional variant of the RBE. See, for example, WO2019113310.

In some embodiments, the AAV genome comprises two genes that encode four replication proteins and three capsid proteins, respectively. In some embodiments, the genes are flanked on either side by 145-bp inverted terminal repeats (ITRs). In some embodiments, the virion comprises up to three capsid proteins (Vp1, Vp2, and/or Vp3), e.g., produced in a 1:1:10 ratio. In some embodiments, the capsid proteins are produced from the same open reading frame and/or from differential splicing (Vp1) and alternative translational start sites (Vp2 and Vp3, respectively). Generally, Vp3 is the most abundant subunit in the virion and participates in receptor recognition at the cell surface defining the tropism of the virus. In some embodiments, Vp1 comprises a phospholipase domain, e.g., which functions in viral infectivity, in the N-terminus of Vp1.

In some embodiments, packaging capacity of the viral vectors limits the size of the base editor that can be packaged into the vector. For example, the packaging capacity of the AAVs can be about 4.5 kb (e.g., about 3.0, 3.5, 4.0, 4.5, 5.0, 5.5, or 6.0 kb), e.g., including one or two inverted terminal repeats (ITRs), e.g., 145 base ITRs.

In some embodiments, recombinant AAV (rAAV) comprises cis-acting 145-bp ITRs flanking vector transgene cassettes, e.g., providing up to 4.5 kb for packaging of foreign DNA. Subsequent to infection, rAAV can, in some instances, express a fusion protein of the invention and persist without integration into the host genome by existing episomally in circular head-to-tail concatemers. rAAV can be used, for example, in vitro and in vivo. In some embodiments, AAV-mediated gene delivery requires that the length of the coding sequence of the gene is equal or greater in size than the wild-type AAV genome.

AAV delivery of genes that exceed this size and/or the use of large physiological regulatory elements can be accomplished, for example, by dividing the protein(s) to be delivered into two or more fragments. In some embodiments, the N-terminal fragment is fused to a split intein-N. In some embodiments, the C-terminal fragment is fused to a split intein-C. In embodiments, the fragments are packaged into two or more AAV vectors.

In some embodiments, dual AAV vectors are generated by splitting a large transgene expression cassette in two separate halves (5 and 3 ends, or head and tail), e.g., wherein each half of the cassette is packaged in a single AAV vector (of <5 kb). The re-assembly of the full-length transgene expression cassette can, in some embodiments, then be achieved upon co-infection of the same cell by both dual AAV vectors. In some embodiments, co-infection is followed by one or more of: (1) homologous recombination (HR) between 5 and 3 genomes (dual AAV overlapping vectors); (2) ITR-mediated tail-to-head concatemerization of 5 and 3 genomes (dual AAV trans-splicing vectors); and/or (3) a combination of these two mechanisms (dual AAV hybrid vectors). In some embodiments, the use of dual AAV vectors in vivo results in the expression of full-length proteins. In some embodiments, the use of the dual AAV vector platform represents an efficient and viable gene transfer strategy for transgenes of greater than about 4.0, 4.1, 4.2, 4.3, 4.4, 4.5, 4.6, 4.7, 4.8, 4.9, or 5.0 kb in size. In some embodiments, AAV vectors can also be used to transduce cells with target nucleic acids, e.g., in the in vitro production of nucleic acids and peptides. In some embodiments, AAV vectors can be used for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994); each of which is incorporated herein by reference in their entirety). The construction of recombinant AAV vectors is described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989) (incorporated by reference herein in their entirety).

In some embodiments, a GENE WRITER™ described herein (e.g., with or without one or more guide nucleic acids) can be delivered using AAV, lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For example, for AAV, the route of administration, formulation and dose can be as described in U.S. Pat. No. 8,454,972 and as in clinical trials involving AAV. For Adenovirus, the route of administration, formulation and dose can be as described in U.S. Pat. No. 8,404,658 and as in clinical trials involving adenovirus. For plasmid delivery, the route of administration, formulation and dose can be as described in U.S. Pat. No. 5,846,946 and as in clinical studies involving plasmids. Doses can be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. In some embodiments, the viral vectors can be injected into the tissue of interest. For cell-type specific GENE WRITING™, the expression of the GENE WRITER™ and optional guide nucleic acid can, in some embodiments, be driven by a cell-type specific promoter.

In some embodiments, AAV allows for low toxicity, for example, due to the purification method not requiring ultra-centrifugation of cell particles that can activate the immune response. In some embodiments, AAV allows low probability of causing insertional mutagenesis, for example, because it does not substantially integrate into the host genome.

In some embodiments, AAV has a packaging limit of about 4.4, 4.5, 4.6, 4.7, or 4.75 kb. In some embodiments, a GENE WRITER™, promoter, and transcription terminator can fit into a single viral vector. SpCas9 (4.1 kb) may, in some instances, be difficult to package into AAV. Therefore, in some embodiments, a GENE WRITER™ is used that is shorter in length than other GENE WRITER® genome editor polypeptides or base editors. In some embodiments, the GENE WRITER® genome editor polypeptides are less than about 4.5 kb, 4.4 kb, 4.3 kb, 4.2 kb, 4.1 kb, 4 kb, 3.9 kb, 3.8 kb, 3.7 kb, 3.6 kb, 3.5 kb, 3.4 kb, 3.3 kb, 3.2 kb, 3.1 kb, 3 kb, 2.9 kb, 2.8 kb, 2.7 kb, 2.6 kb, 2.5 kb, 2 kb, or 1.5 kb.

An AAV can be AAV1, AAV2, AAV5 or any combination thereof. In some embodiments, the type of AAV is selected with respect to the cells to be targeted; e.g., AAV serotypes 1, 2, 5 or a hybrid capsid AAV1, AAV2, AAV5 or any combination thereof can be selected for targeting brain or neuronal cells; or AAV4 can be selected for targeting cardiac tissue. In some embodiments, AAV8 is selected for delivery to the liver. Exemplary AAV serotypes as to these cells are described, for example, in Grimm, D. et al, J. Virol. 82:5887-5911 (2008) (incorporated herein by reference in its entirety). In some embodiments, AAV refers all serotypes, subtypes, and naturally-occurring AAV as well as recombinant AAV. AAV may be used to refer to the virus itself or a derivative thereof. In some embodiments, AAV includes AAV1, AAV2, AAV3, AAV3B, AAV4, AAV5, AAV6, AAV6.2, AAV7, AAVrh.64R1, AAVhu.37, AAVrh.8, AAVrh.32.33, AAV8, AAV9, AAV-DJ, AAV2/8, AAVrhIO, AAVLK03, AV10, AAV11, AAV 12, rhIO, and hybrids thereof, avian AAV, bovine AAV, canine AAV, equine AAV, primate AAV, nonprimate AAV, and ovine AAV. The genomic sequences of various serotypes of AAV, as well as the sequences of the native terminal repeats (TRs), Rep proteins, and capsid subunits are known in the art. Such sequences may be found in the literature or in public databases such as GenBank. Additional exemplary AAV serotypes are listed in Table 49.

TABLE 49

Exemplary AAV serotypes.

| Target Tissue | Vehicle | Reference |
|---|---|---|
| Liver | AAV (AAV8[1], AAVrh.8[1], AAVhu.37[1], AAV2/8, AAV2/rh10[2], AAV9, AAV2, NP40[3], NP59[2, 3], AAV3B[5], AAV-DJ[4], AAV-LK01[4], AAV-LK02[4], AAV-LK03[4], AAV-LK19[4] Adenovirus (Ad5, HC-AdV[6]) | 1. Wang et al., *Mol. Ther.* 18, 118-25 (2010) 2. Ginn et al., *JHEP Reports*, 100065 (2019) 3. Paulk et al., *Mol. Ther.* 26, 289-303 (2018). 4. L. Lisowski et al., *Nature*. 506, 382-6 (2014). 5. L. Wang et al., *Mol. Ther.* 23, 1877-87 (2015). 6. Hausl *Mol Ther* (2010) |
| Lung | AAV (AAV4, AAV5, AAV6[1], AAV9, H22[2]) Adenovirus (Ad5, Ad3, Ad21, Ad14)[3] | 1. Duncan et al., *Mol Ther Methods Clin Dev* (2018) 2. Cooney et al., Am J Respir Cell Mol Biol (2019) 3. Li et al., *Mol Ther Methods Clin Dev* (2019) |
| Skin | AAV (AAV6[1], AAV-LK19[2]) | 1. Petek et al., *Mol. Ther.* (2010) 2. L. Lisowski et al., *Nature*. 506, 382-6 (2014). |
| HSCs | Adenovirus (HDAd5/35[++]) | Wang et al. *Blood Adv* (2019) |

In some embodiments, a pharmaceutical composition (e.g., comprising an AAV as described herein) has less than 10% empty capsids, less than 8% empty capsids, less than 7% empty capsids, less than 5% empty capsids, less than 3% empty capsids, or less than 1% empty capsids. In some embodiments, the pharmaceutical composition has less than about 5% empty capsids. In some embodiments, the number of empty capsids is below the limit of detection. In some embodiments, it is advantageous for the pharmaceutical composition to have low amounts of empty capsids, e.g., because empty capsids may generate an adverse response (e.g., immune response, inflammatory response, liver response, and/or cardiac response), e.g., with little or no substantial therapeutic benefit.

In some embodiments, the residual host cell protein (rHCP) in the pharmaceutical composition is less than or equal to 100 ng/ml rHCP per $1 \times 10^{13}$ vg/ml, e.g., less than or equal to ng/ml rHCP per $1 \times 10^{13}$ vg/ml or 1-50 ng/ml rHCP per $1 \times 10^{13}$ vg/ml. In some embodiments, the pharmaceutical composition comprises less than 10 ng rHCP per $1.0 \times 10^{13}$ vg, or less than 5 ng rHCP per $1.0 \times 10^{13}$ vg, less than 4 ng rHCP per $1.0 \times 10^{13}$ vg, or less than 3 ng rHCP per $1.0 \times 10^{13}$ vg, or any concentration in between. In some embodiments, the residual host cell DNA (hcDNA) in the pharmaceutical composition is less than or equal to $5 \times 10^6$ µg/ml hcDNA per $1 \times 10^{13}$ vg/ml, less than or equal to $1.2 \times 10^6$ µg/ml hcDNA per $1 \times 10^{13}$ vg/ml, or $1 \times 10^5$ µg/ml hcDNA per $1 \times 10^{13}$ vg/ml. In some embodiments, the residual host cell DNA in said pharmaceutical composition is less than $5.0 \times 10^5$ µg per $1 \times 10^{13}$ vg, less than $2.0 \times 10^5$ µg per $1.0 \times 10^{13}$ vg, less than $1.1 \times 10^5$ µg per $1.0 \times 10^{13}$ vg, less than $1.0 \times 10^5$ pg hcDNA per $1.0 \times 10^{13}$ vg, less than $0.9 \times 10^5$ pg hcDNA per $1.0 \times 10^{13}$ vg, less than $0.8 \times 10^5$ pg hcDNA per $1.0 \times 10^{13}$ vg, or any concentration in between.

In some embodiments, the residual plasmid DNA in the pharmaceutical composition is less than or equal to $1.7 \times 10^5$ µg/ml per $1.0 \times 10^{13}$ vg/ml, or $1 \times 10^5$ µg/ml per $1 \times 1.0 \times 10^{13}$ vg/ml, or $1.7 \times 10^6$ µg/ml per $1.0 \times 10^{13}$ vg/ml. In some embodiments, the residual DNA plasmid in the pharmaceutical composition is less than $10.0 \times 10^5$ pg by $1.0 \times 10^{13}$ vg, less than $8.0 \times 10^5$ pg by $1.0 \times 10^{13}$ vg or less than $6.8 \times 10^5$ pg by $1.0 \times 10^{13}$ vg. In embodiments, the pharmaceutical composition comprises less than 0.5 ng per $1.0 \times 10^{13}$ vg, less than 0.3 ng per $1.0 \times 10^{13}$ vg, less than 0.22 ng per $1.0 \times 10^{13}$ vg or less than 0.2 ng per $1.0 \times 10^{13}$ vg or any intermediate concentration of bovine serum albumin (BSA). In embodiments, the benzonase in the pharmaceutical composition is less than 0.2 ng by $1.0 \times 10^{13}$ vg, less than 0.1 ng by $1.0 \times 10^{13}$ vg, less than 0.09 ng by $1.0 \times 10^{13}$ vg, less than 0.08 ng by $1.0 \times 10^{13}$ vg or any intermediate concentration. In embodiments, Poloxamer 188 in the pharmaceutical composition is about 10 to 150 ppm, about 15 to 100 ppm or about 20 to 80 ppm. In embodiments, the cesium in the pharmaceutical composition is less than 50 pg/g (ppm), less than 30 pg/g (ppm) or less than 20 pg/g (ppm) or any intermediate concentration.

In embodiments, the pharmaceutical composition comprises total impurities, e.g., as determined by SDS-PAGE, of less than 10%, less than 8%, less than 7%, less than 6%, less than 5%, less than 4%, less than 3%, less than 2%, or any percentage in between. In embodiments, the total purity, e.g., as determined by SDS-PAGE, is greater than 90%, greater than 92%, greater than 93%, greater than 94%, greater than 95%, greater than 96%, greater than 97%, greater than 98%, or any percentage in between. In embodiments, no single unnamed related impurity, e.g., as measured by SDS-PAGE, is greater than 5%, greater than 4%, greater than 3% or greater than 2%, or any percentage in between. In embodiments, the pharmaceutical composition comprises a percentage of filled capsids relative to total capsids (e.g., peak 1+peak 2 as measured by analytical ultracentrifugation) of greater than 85%, greater than 86%, greater than 87%, greater than 88%, greater than 89%, greater than 90%, greater than 91%, greater than 91.9%, greater than 92%, greater than 93%, or any percentage in between. In embodiments of the pharmaceutical composition, the percentage of filled capsids measured in peak 1 by analytical ultracentrifugation is 20-80%, 25-75%, 30-75%, 35-75%, or 37.4-70.3%. In embodiments of the pharmaceutical composition, the percentage of filled capsids measured in peak 2 by analytical ultracentrifugation is 20-80%, 20-70%, 22-65%, 24-62%, or 24.9-60.1%.

In one embodiment, the pharmaceutical composition comprises a genomic titer of 1.0 to $5.0 \times 10^{13}$ vg/mL, 1.2 to $3.0 \times 10^{13}$ vg/mL or 1.7 to $2.3 \times 10^{13}$ vg/ml. In one embodiment, the pharmaceutical composition exhibits a biological load of less than 5 CFU/mL, less than 4 CFU/mL, less than 3 CFU/mL, less than 2 CFU/mL or less than 1 CFU/mL or any intermediate contraction. In embodiments, the amount of endotoxin according to USP, for example, USP <85> (incorporated by reference in its entirety) is less than 1.0 EU/mL, less than 0.8 EU/mL or less than 0.75 EU/mL. In embodiments, the osmolarity of a pharmaceutical composition according to USP, for example, USP <785> (incorporated by reference in its entirety) is 350 to 450 mOsm/kg, 370 to 440 mOsm/kg or 390 to 430 mOsm/kg. In embodiments, the pharmaceutical composition contains less than 1200 particles that are greater than 25 μm per container, less than 1000 particles that are greater than 25 μm per container, less than 500 particles that are greater than 25 μm per container or any intermediate value. In embodiments, the pharmaceutical composition contains less than 10,000 particles that are greater than 10 μm per container, less than 8000 particles that are greater than 10 μm per container or less than 600 particles that are greater than 10 μm per container.

In one embodiment, the pharmaceutical composition has a genomic titer of 0.5 to $5.0 \times 10^{13}$ vg/mL, 1.0 to $4.0 \times 10^{13}$ vg/mL, 1.5 to $3.0 \times 10^{13}$ vg/ml or 1.7 to $2.3 \times 10^{13}$ vg/ml. In one embodiment, the pharmaceutical composition described herein comprises one or more of the following: less than about 0.09 ng benzonase per $1.0 \times 10^{13}$ vg, less than about 30 pg/g (ppm) of cesium, about 20 to 80 ppm Poloxamer 188, less than about 0.22 ng BSA per $1.0 \times 10^{13}$ vg, less than about $6.8 \times 10^5$ pg of residual DNA plasmid per $1.0 \times 10^{13}$ vg, less than about $1.1 \times 10^5$ pg of residual hcDNA per $1.0 \times 10^{13}$ vg, less than about 4 ng of rHCP per $1.0 \times 10^{13}$ vg, pH 7.7 to 8.3, about 390 to 430 mOsm/kg, less than about 600 particles that are >25 μm in size per container, less than about 6000 particles that are >10 μm in size per container, about $1.7 \times 10^{13}$-$2.3 \times 10^{13}$ vg/mL genomic titer, infectious titer of about $3.9 \times 10^8$ to $8.4 \times 10^{10}$ IU per $1.0 \times 10^{13}$ vg, total protein of about 100-300 pg per $1.0 \times 10^{13}$ vg, mean survival of >24 days in A7SMA mice with about $7.5 \times 10^{13}$ vg/kg dose of viral vector, about 70 to 130% relative potency based on an in vitro cell based assay and/or less than about 5% empty capsid. In various embodiments, the pharmaceutical compositions described herein comprise any of the viral particles discussed here, retain a potency of between ±20%, between ±15%, between ±10% or within +5% of a reference standard. In some embodiments, potency is measured using a suitable in vitro cell assay or in vivo animal model.

Additional methods of preparation, characterization, and dosing AAV particles are taught in WO2019094253, which is incorporated herein by reference in its entirety.

Additional rAAV constructs that can be employed consonant with the invention include those described in Wang et al 2019, available at://doi.org/10.1038/s41573-019-0012-9, including Table 1 thereof, which is incorporated by reference in its entirety.

Inteins

In some embodiments, as described in more detail below, Intein-N may be fused to the N-terminal portion of a first domain described herein, and and intein-C may be fused to the C-terminal portion of a second domain described herein for the joining of the N-terminal portion to the C-terminal portion, thereby joining the first and second domains. In some embodiments, the first and second domains are each independent chosen from a DNA binding domain, an RNA binding domain, an RT domain, and an endonuclease domain.

As used herein, "intein" refers to a self-splicing protein intron (e.g., peptide), e.g., which ligates flanking N-terminal and C-terminal exteins (e.g., fragments to be joined). An intein may, in some instances, comprise a fragment of a protein that is able to excise itself and join the remaining fragments (the exteins) with a peptide bond in a process known as protein splicing. Inteins are also referred to as "protein introns." The process of an intein excising itself and joining the remaining portions of the protein is herein termed "protein splicing" or "intein-mediated protein splicing." In some embodiments, an intein of a precursor protein (an intein containing protein prior to intein-mediated protein splicing) comes from two genes. Such intein is referred to herein as a split intein (e.g., split intein-N and split intein-C). For example, in cyanobacteria, DnaE, the catalytic subunit a of DNA polymerase III, is encoded by two separate genes, dnaE-n and dnaE-c. The intein encoded by the dnaE-n gene may be herein referred as "intein-N." The intein encoded by the dnaE-c gene may be herein referred as "intein-C."

Use of inteins for joining heterologous protein fragments is described, for example, in Wood et al., J. Biol. Chem. 289 (21); 14512-9 (2014) (incorporated herein by reference in its entirety). For example, when fused to separate protein fragments, the inteins IntN and IntC may recognize each other, splice themselves out, and/or simultaneously ligate the flanking N- and C-terminal exteins of the protein fragments to which they were fused, thereby reconstituting a full-length protein from the two protein fragments.

In some embodiments, a synthetic intein based on the dnaE intein, the Cfa-N (e.g., split intein-N) and Cfa-C (e.g., split intein-C) intein pair, is used. Examples of such inteins have been described, e.g., in Stevens et al., J Am Chem Soc. 2016 Feb. 24; 138 (7): 2162-5 (incorporated herein by reference in its entirety). Non-limiting examples of intein pairs that may be used in accordance with the present disclosure include: Cfa DnaE intein, Ssp GyrB intein, Ssp DnaX intein, Ter DnaE3 intein, Ter ThyX intein, Rma DnaB intein and Cne Prp8 intein (e.g., as described in U.S. Pat. No. 8,394,604, incorporated herein by reference.

In some embodiments, Intein-N and intein-C may be fused to the N-terminal portion of the split Cas9 and the C-terminal portion of a split Cas9, respectively, for the joining of the N-terminal portion of the split Cas9 and the C-terminal portion of the split Cas9. For example, in some embodiments, an intein-N is fused to the C-terminus of the N-terminal portion of the split Cas9, i.e., to form a structure of N-[N-terminal portion of the split Cas9]-[intein-N]~C. In some embodiments, an intein-C is fused to the N-terminus of the C-terminal portion of the split Cas9, i.e., to form a structure of N-[intein-C] ~ [C-terminal portion of the split Cas9]-C. The mechanism of intein-mediated protein splicing for joining the proteins the inteins are fused to (e.g., split Cas9) is described in Shah et al., Chem Sci. 2014; 5 (1): 446-461, incorporated herein by reference. Methods for designing and using inteins are known in the art and described, for example by WO2020051561, WO2014004336, WO2017132580, US20150344549, and US20180127780, each of which is incorporated herein by reference in their entirety.

In some embodiments, a split refers to a division into two or more fragments. In some embodiments, a split Cas9 protein or split Cas9 comprises a Cas9 protein that is provided as an N-terminal fragment and a C-terminal fragment encoded by two separate nucleotide sequences. The polypeptides corresponding to the N-terminal portion and the C-terminal portion of the Cas9 protein may be spliced to form a reconstituted Cas9 protein. In embodiments, the Cas9 protein is divided into two fragments within a disordered region of the protein, e.g., as described in Nishimasu et al., Cell, Volume 156, Issue 5, pp. 935-949, 2014, or as described in Jiang et al. (2016) Science 351:867-871 and PDB file: 5F9R (each of which is incorporated herein by reference in its entirety). A disordered region may be determined by one or more protein structure determination techniques known in the art, including, without limitation, X-ray crystallography, NMR spectroscopy, electron microscopy (e.g., cryoEM), and/or in silico protein modeling. In some embodiments, the protein is divided into two fragments at any C, T, A, or S, e.g., within a region of SpCas9 between amino acids A292-G364, F445-K483, or E565-T637, or at corresponding positions in any other Cas9, Cas9 variant (e.g., nCas9, dCas9), or other napDNAbp. In some embodiments, protein is divided into two fragments at SpCas9 T310, T313, A456, S469, or C574. In some embodiments, the process of dividing the protein into two fragments is referred to as splitting the protein.

In some embodiments, a protein fragment ranges from about 2-1000 amino acids (e.g., between 2-10, 10-50, 50-100, 100-200, 200-300, 300-400, 400-500, 500-600, 600-700, 700-800, 800-900, or 900-1000 amino acids) in length. In some embodiments, a protein fragment ranges from about 5-500 amino acids (e.g., between 5-10, 10-50, 50-100, 100-200, 200-300, 300-400, or 400-500 amino acids) in length. In some embodiments, a protein fragment ranges from about 20-200 amino acids (e.g., between 20-30, 30-40, 40-50, 50-100, or 100-200 amino acids) in length.

In some embodiments, a portion or fragment of a GENE WRITER™ (e.g., Cas9-R2Tg) is fused to an intein. The nuclease can be fused to the N-terminus or the C-terminus of the intein. In some embodiments, a portion or fragment of a fusion protein is fused to an intein and fused to an AAV capsid protein. The intein, nuclease and capsid protein can be fused together in any arrangement (e.g., nuclease-intein-capsid, intein-nuclease-capsid, capsid-intein-nuclease, etc.). In some embodiments, the N-terminus of an intein is fused to the C-terminus of a fusion protein and the C-terminus of the intein is fused to the N-terminus of an AAV capsid protein.

In some embodiments, an endonuclease domain (e.g., a nickase Cas9 domain) is fused to intein-N and a polypeptide comprising an RT domain is fused to an intein-C.

Exemplary nucleotide and amino acid sequences of inteins are provided below:

DnaE Intein-N DNA:
(SEQ ID NO: 1637)
TGCCTGTCATACGAAACCGAGATACTGACAGTAGAA

TATGGCCTTCTGCCAATCGGGAAGATTGTGGAGAAA

CGGATAGAATGCACAGTTTACTCTGTCGATAACAAT

GGTAACATTTATACTCAGCCAGTTGCCCAGTGGCAC

GACCGGGGAGAGCAGGAAGTATTCGAATACTGTCTG

GAGGATGGAAGTCTCATTAGGGCCACTAAGGACCAC

AAATTTATGACAGTCGATGGCCAGATGCTGCCTATA

GACGAAATCTTTGAGCGAGAGTTGGACCTCATGCGA

GTTGACAACCTTCCTAAT

DnaE Intein-N Protein:
(SEQ ID NO: 1638)
CLSYETEILTVEYGLLPIGKIVEKRIECTVYSVDNN

GNIYTQPVAQWHDRGEQEVFEYCLEDGSLIRATKDH

KFMTVDGQMLPIDEIFERELDLMRVDNLPN

DnaE Intein-C DNA:
(SEQ ID NO: 1639)
ATGATCAAGATAGCTACAAGGAAGTATCTTGGCAAA

CAAAACGTTTATGATATTGGAGTCGAAAGAGATCAC

AACTTTGCTCTGAAGAACGGATTCATAGCTTCTAAT

Intein-C:
(SEQ ID NO: 1640)
MIKIATRKYLGKQNVYDIGVERDHNFALKNGFIASN

Cfa-N DNA:
(SEQ ID NO: 1641)
TGCCTGTCTTATGATACCGAGATACTTACCGTTGAA

TATGGCTTCTTGCCTATTGGAAAGATTGTCGAAGAG

AGAATTGAATGCACAGTATATACTGTAGACAAGAAT

GGTTTCGTTTACACACAGCCCATTGCTCAATGGCAC

AATCGCGGCGAACAAGAAGTATTTGAGTACTGTCTC

GAGGATGGAAGCATCATACGAGCAACTAAAGATCAT

AAATTCATGACCACTGACGGGCAGATGTTGCCAATA

GATGAGATATTCGAGCGGGGCTTGGATCTCAAACAA

GTGGATGGATTGCCA

Cfa-N Protein:
(SEQ ID NO: 1642)
CLSYDTEILTVEYGFLPIGKIVEERIECTVYTVDKN

GFVYTQPIAQWHNRGEQEVFEYCLEDGSIIRATKDH

KFMTTDGQMLPIDEIFERGLDLKQVDGLP

Cfa-C DNA:
(SEQ ID NO: 1643)
ATGAAGAGGACTGCCGATGGATCAGAGTTTGAATCT

CCCAAGAAGAAGAGGAAAGTAAAGATAATATCTCGA

AAAAGTCTTGGTACCCAAAATGTCTATGATATTGGA

GTGGAGAAAGATCACAACTTCCTTCTCAAGAACGGT

CTCGTAGCCAGCAAC

Cfa-C Protein:
(SEQ ID NO: 1644)
MKRTADGSEFESPKKKRKVKIISRKSLGTQNVYDIG

VEKDHNFLLKNGLVASN

Lipid Nanoparticles

The methods and systems provided by the invention, may employ any suitable carrier or delivery modality, including, in certain embodiments, lipid nanoparticles (LNPs). Lipid nanoparticles, in some embodiments, comprise one or more ionic lipids, such as non-cationic lipids (e.g., neutral or anionic, or zwitterionic lipids); one or more conjugated lipids (such as PEG-conjugated lipids or lipids conjugated to polymers described in Table 5 of WO2019217941; incorporated herein by reference in its entirety); one or more sterols (e.g., cholesterol); and, optionally, one or more targeting molecules (e.g., conjugated receptors, receptor ligands, antibodies); or combinations of the foregoing.

Lipids that can be used in nanoparticle formations (e.g., lipid nanoparticles) include, for example those described in Table 4 of WO2019217941, which is incorporated by reference e.g., a lipid-containing nanoparticle can comprise one or more of the lipids in table 4 of WO2019217941. Lipid nanoparticles can include additional elements, such as polymers, such as the polymers described in table 5 of WO2019217941, incorporated by reference.

In some embodiments, conjugated lipids, when present, can include one or more of PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-0-(2', 3'-di (tetradecanoyloxy)propyl-1-0-(w-methoxy (polyethoxy)ethyl) butanedioate (PEG-S-DMG)), PEG dialkoxypropylcarbam, N-(carbonyl-methoxypoly ethylene glycol 2000)-1,2-distearoyl-sn-glycero-3-phosphoethanolamine sodium salt, and those described in Table 2 of WO2019051289 (incorporated by reference), and combinations of the foregoing.

In some embodiments, sterols that can be incorporated into lipid nanoparticles include one or more of cholesterol or cholesterol derivatives, such as those in WO2009/127060 or US2010/0130588, which are incorporated by reference. Additional exemplary sterols include phytosterols, including those described in Eygeris et al (2020), dx.doi.org/10.1021/acs.nanolett.0c01386, incorporated herein by reference.

In some embodiments, the lipid particle comprises an ionizable lipid, a non-cationic lipid, a conjugated lipid that inhibits aggregation of particles, and a sterol. The amounts of these components can be varied independently and to achieve desired properties. For example, in some embodiments, the lipid nanoparticle comprises an ionizable lipid is in an amount from about 20 mol % to about 90 mol % of the total lipids (in other embodiments it may be 20-70% (mol), 30-60% (mol) or 40-50% (mol); about 50 mol % to about 90 mol % of the total lipid present in the lipid nanoparticle), a non-cationic lipid in an amount from about 5 mol % to about mol % of the total lipids, a conjugated lipid in an amount from about 0.5 mol % to about 20 mol % of the total lipids, and a sterol in an amount from about 20 mol % to about 50 mol % of the total lipids. The ratio of total lipid to nucleic acid (e.g., encoding the GENE WRITER™ or template nucleic acid) can be varied as desired. For example, the total lipid to nucleic acid (mass or weight) ratio can be from about 10:1 to about 30:1.

In some embodiments, an ionizable lipid may be a cationic lipid, a ionizable cationic lipid, e.g., a cationic lipid that can exist in a positively charged or neutral form depending on pH, or an amine-containing lipid that can be readily protonated. In some embodiments, the cationic lipid is a lipid capable of being positively charged, e.g., under physiological conditions. Exemplary cationic lipids include one or more amine group(s) which bear the positive charge.

In some embodiments, the lipid particle comprises a cationic lipid in formulation with one or more of neutral lipids, ionizable amine-containing lipids, biodegradable alkyn lipids, steroids, phospholipids including polyunsaturated lipids, structural lipids (e.g., sterols), PEG, cholesterol and polymer conjugated lipids. In some embodiments, the cationic lipid may be an ionizable cationic lipid. An exemplary cationic lipid as disclosed herein may have an effective pKa over 6.0. In embodiments, a lipid nanoparticle may comprise a second cationic lipid having a different effective pKa (e.g., greater than the first effective pKa), than the first cationic lipid. A lipid nanoparticle may comprise between 40 and 60 mol percent of a cationic lipid, a neutral lipid, a steroid, a polymer conjugated lipid, and a therapeutic agent, e.g., a nucleic acid (e.g., RNA) described herein (e.g., a template nucleic acid or a nucleic acid encoding a GeneWriter), encapsulated within or associated with the lipid nanoparticle. In some embodiments, the nucleic acid is co-formulated with the cationic lipid. The nucleic acid may be adsorbed to the surface of an LNP, e.g., an LNP comprising a cationic lipid. In some embodiments, the nucleic acid may be encapsulated in an LNP, e.g., an LNP comprising a cationic lipid. In some embodiments, the lipid nanoparticle may comprise a targeting moiety, e.g., coated with a targeting agent. In embodiments, the LNP formulation is biodegradable. In some embodiments, a lipid nanoparticle comprising one or more lipid described herein, e.g., Formula (i), (ii), (ii), (vii) and/or (ix) encapsulates at least 1%, at least 5%, at least 10%, at least 20%, at least 30%, at least 40%, at least 50%, at least 60%, at least 70%, at least 80%, at least 90%, at least 92%, at least 95%, at least 97%, at least 98% or 100% of an RNA molecule, e.g., template RNA and/or a mRNA encoding the GENE WRITER™ polypeptide.

In some embodiments, the lipid to nucleic acid ratio (mass/mass ratio; w/w ratio) can be in the range of from about 1:1 to about 25:1, from about 10:1 to about 14:1, from about 3:1 to about 15:1, from about 4:1 to about 10:1, from about 5:1 to about 9:1, or about 6:1 to about 9:1. The amounts of lipids and nucleic acid can be adjusted to provide a desired N/P ratio, for example, N/P ratio of 3, 4, 5, 6, 7, 8, 9, 10 or higher. Generally, the lipid nanoparticle formulation's overall lipid content can range from about 5 mg/ml to about 30 mg/mL.

Exemplary ionizable lipids that can be used in lipid nanoparticle formulations include, without limitation, those listed in Table 1 of WO2019051289, incorporated herein by reference. Additional exemplary lipids include, without limitation, one or more of the following formulae: X of US2016/0311759; I of US20150376115 or in US2016/0376224; I, II or III of US20160151284; I, IA, II, or IIA of US20170210967; I-c of US20150140070; A of US2013/0178541; I of US2013/0303587 or US2013/0123338; I of US2015/0141678; II, III, IV, or V of US2015/0239926; I of US2017/0119904; I or II of WO2017/117528; A of US2012/0149894; A of US2015/0057373; A of WO2013/116126; A of US2013/0090372; A of US2013/0274523; A of US2013/0274504; A of US2013/0053572; A of WO2013/016058; A of WO2012/162210; I of US2008/042973; I, II, III, or IV of US2012/01287670; I or II of US2014/0200257; I, II, or III of US2015/0203446; I or III of US2015/0005363; I, IA, IB, IC, ID, II, IIA, IIB, IIC, IID, or III-XXIV of US2014/

0308304; of US2013/0338210; I, II, III, or IV of WO2009/132131; A of US2012/01011478; I or XXXV of US2012/0027796; XIV or XVII of US2012/0058144; of US2013/0323269; I of US2011/0117125; I, II, or III of US2011/0256175; I, II, III, IV, V, VI, VII, VIII, IX, X, XI, XII of US2012/0202871; I, II, III, IV, V, VI, VII, VIII, X, XII, XIII, XIV, XV, or XVI of US2011/0076335; I or II of US2006/008378; I of US2013/0123338; I or X-A-Y-Z of US2015/0064242; XVI, XVII, or XVIII of US2013/0022649; I, II, or III of US2013/0116307; I, II, or III of US2013/0116307; I or II of US2010/0062967; I-X of US2013/0189351; I of US2014/0039032; V of US2018/0028664; I of US2016/0317458; I of US2013/0195920; 5, 6, or 10 of U.S. Pat. No. 10,221,127; III-3 of WO2018/081480; I-5 or 1-8 of WO2020/081938; 18 or 25 of U.S. Pat. No. 9,867,888; A of US2019/0136231; II of WO2020/219876; 1 of US2012/0027803; OF-02 of US2019/0240349; 23 of U.S. Pat. No. 10,086,013; cKK-E12/A6 of Miao et al (2020); C12-200 of WO2010/053572; 7C1 of Dahlman et al (2017); 304-013 or 503-013 of Whitehead et al; TS-P4C2 of U.S. Pat. No. 9,708,628; I of WO2020/106946; I of WO2020/106946.

In some embodiments, the ionizable lipid is MC3 (6Z,9Z,28Z,3 IZ)-heptatriaconta-6,9,28,3 1-tetraen-19-yl-4-(dimethylamino) butanoate (DLin-MC3-DMA or MC3), e.g., as described in Example 9 of WO2019051289A9 (incorporated by reference herein in its entirety). In some embodiments, the ionizable lipid is the lipid ATX-002, e.g., as described in Example 10 of WO2019051289A9 (incorporated by reference herein in its entirety). In some embodiments, the ionizable lipid is (13Z,16Z)-A,A-dimethyl-3-nonyldocosa-13, 16-dien-1-amine (Compound 32), e.g., as described in Example 11 of WO2019051289A9 (incorporated by reference herein in its entirety). In some embodiments, the ionizable lipid is Compound 6 or Compound 22, e.g., as described in Example 12 of WO2019051289A9 (incorporated by reference herein in its entirety) In some embodiments, the ionizable lipid is heptadecan-9-yl 8-((2-hydroxyethyl) (6-oxo-6-(undecyloxy) hexyl)amino) octanoate (SM-102); e.g., as described in Example 1 of U.S. Pat. No. 9,867,888 (incorporated by reference herein in its entirety). In some embodiments, the ionizable lipid is 9Z,12Z)-3-((4,4-bis(octyloxy)butanoyl)oxy)-2-((((3-(diethylamino)propoxy)carbonyl)oxy)methyl)propyl octadeca-9,12-dienoate (LP01) e.g., as synthesized in Example 13 of WO2015/095340 (incorporated by reference herein in its entirety). In some embodiments, the ionizable lipid is Di((Z)-non-2-en-1-yl) 9-((4-dimethylamino)butanoyl)oxy) heptadecanedioate (L319), e.g. as synthesized in Example 7, 8, or 9 of US2012/0027803 (incorporated by reference herein in its entirety). In some embodiments, the ionizable lipid is 1,1'-((2-(4-(2-((2-(Bis (2-hydroxydodecyl)amino) ethyl) (2-hydroxydodecyl)amino)ethyl) piperazin-1-yl) ethyl) azanediyl)bis(dodecan-2-ol) (C12-200), e.g., as synthesized in Examples 14 and 16 of WO2010/053572 (incorporated by reference herein in its entirety). In some embodiments, the ionizable lipid is; Imidazole cholesterol ester (ICE) lipid (3S, 10R, 13R, 17R)-10, 13-dimethyl-17-((R)-6-methylheptan-2-yl)-2, 3, 4, 7, 8, 9, 10, 11, 12, 13, 14, 15, 16, 17-tetradecahydro-1H-cyclopenta [a]phenanthren-3-yl 3-(1H-imidazol-4-yl) propanoate, e.g., Structure (I) from WO2020/106946 (incorporated by reference herein in its entirety).

Some non-limiting example of lipid compounds that may be used (e.g., in combination with other lipid components) to form lipid nanoparticles for the delivery of compositions described herein, e.g., nucleic acid (e.g., RNA) described herein (e.g., a template nucleic acid or a nucleic acid encoding a GeneWriter) includes,

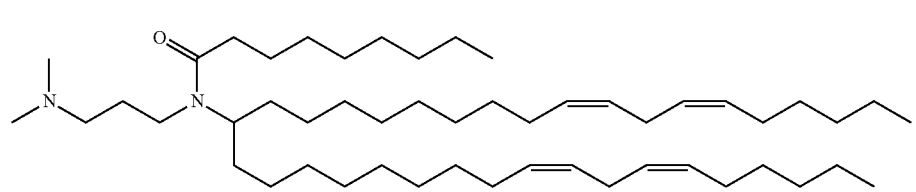

(i)

In some embodiments an LNP comprising Formula (i) is used to deliver a GeneWriter composition described herein to the liver and/or hepatocyte cells.

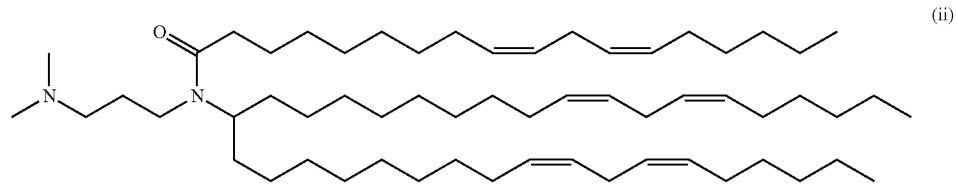 [SMILES: CCCCC/C=C\C/C=C\CCCCCCCCC(CCCCCCCC/C=C\C/C=C\CCCCC)N(CCCN(C)C)C(=O)CCCCCCC/C=C\C/C=C\CCCCC]

(ii)

In some embodiments an LNP comprising Formula (ii) is used to deliver a GeneWriter composition described herein to the liver and/or hepatocyte cells.

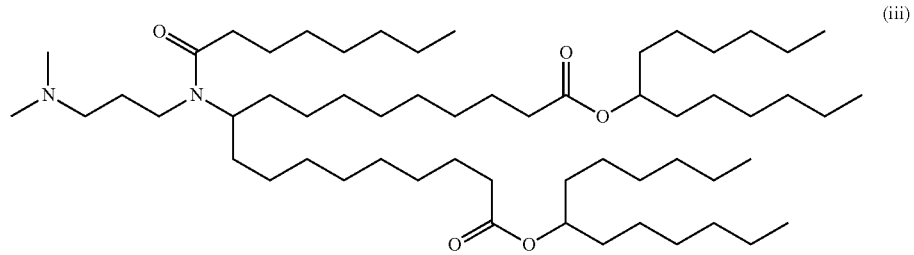 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC]

(iii)

In some embodiments an LNP comprising Formula (iii) is used to deliver a GeneWriter composition described herein to the liver and/or hepatocyte cells.

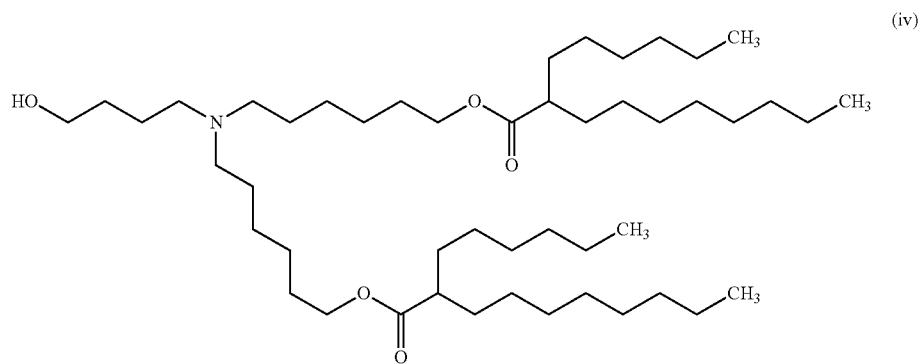

(iv)

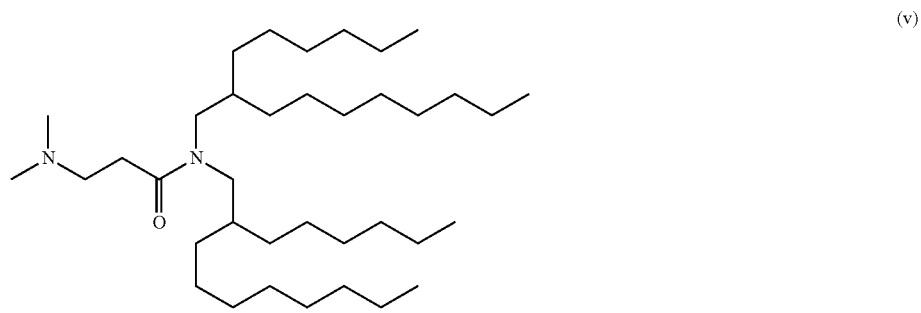

(v)

In some embodiments an LNP comprising Formula (v) is used to deliver a GeneWriter composition described herein to the liver and/or hepatocyte cells.

In some embodiments an LNP comprising Formula (vi) is used to deliver a GeneWriter composition described herein to the liver and/or hepatocyte cells.

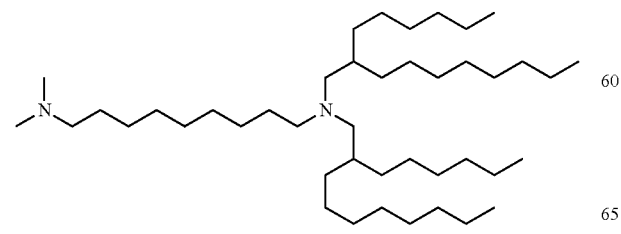

(vi)

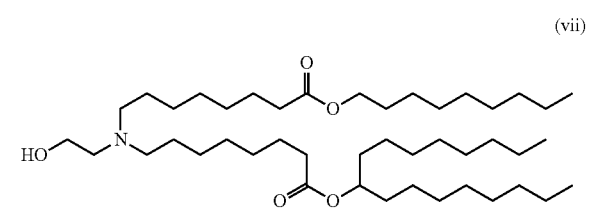

(vii)

(viii)

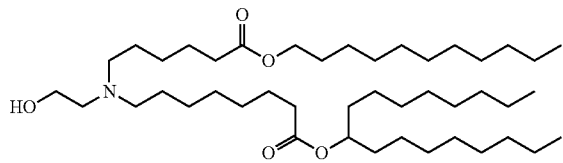

In some embodiments an LNP comprising Formula (viii) is used to deliver a GeneWriter composition described herein to the liver and/or hepatocyte cells.

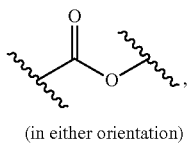

(in either orientation)

n is 0 to 3, $R^4$ is Ci-15 alkyl, $Z^1$ is Ci-6 alkylene or a direct bond, (ix)

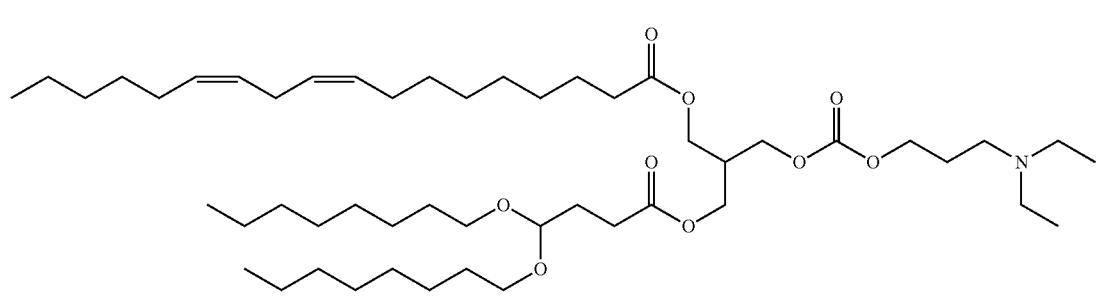

In some embodiments an LNP comprising Formula (ix) is used to deliver a GeneWriter composition described herein to the liver and/or hepatocyte cells.

$Z^2$ is

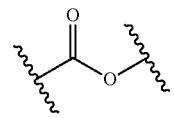

(x)

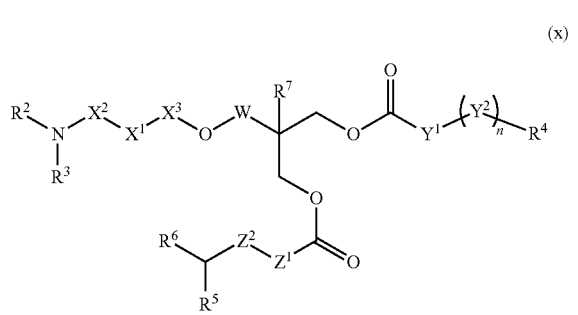

wherein
$X^1$ is O, $NR^1$, or a direct bond, $X^2$ is C2-5 alkylene, $X^3$ is C(=O) or a direct bond, R' is H or Me,
$R^3$ is Ci-3 alkyl, $R^2$ is Ci-3 alkyl, or R2 taken together with the nitrogen atom to which it is attached and 1-3 carbon atoms of X2 form a 4-, 5-, or 6-membered ring, or X1 is NR', R' and
$R^2$ taken together with the nitrogen atoms to which they are attached form a 5- or 6-membered ring, or $R^2$ taken together with $R^3$ and the nitrogen atom to which they are attached form a 5-, 6-, or 7-membered ring, Y' is C2-12 alkylene, $Y^2$ is selected from

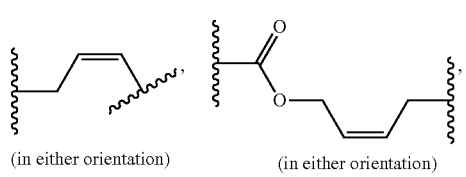

(in either orientation) (in either orientation)

(in either orientation) or absent, provided that if Z' is a direct bond, $Z^2$ is absent;
$R^5$ is C5-9 alkyl or C6-10 alkoxy, $R^6$ is C5-9 alkyl or C6-10 alkoxy, W is methylene or a direct bond, and $R^7$ is H or Me, or a salt thereof, provided that if $R^3$ and $R^2$ are C2 alkyls, $X^1$ is O, $X^2$ is linear C3 alkylene, $X^3$ is C(=O), $Y^1$ is linear Ce alkylene, $(Y^2)$n-$R^4$ is

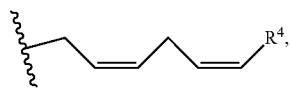

$R^4$ is linear C5 alkyl, $Z^1$ is C2 alkylene, $Z^2$ is absent, W is methylene, and $R^7$ is H, then $R^5$ and $R^6$ are not Cx alkoxy.

In some embodiments an LNP comprising Formula (xii) is used to deliver a GeneWriter composition described herein to the liver and/or hepatocyte cells.

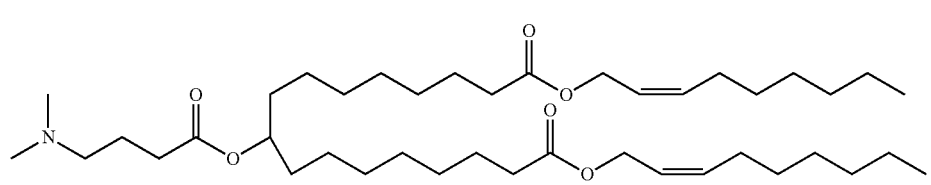
(xi)
In some embodiments an LNP comprising Formula (xi) is used to deliver a GeneWriter composition described herein to the liver and/or hepatocyte cells.
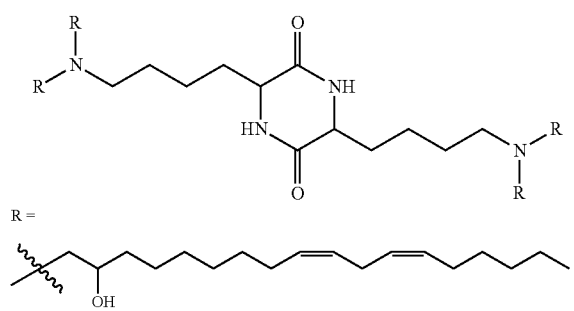
R =
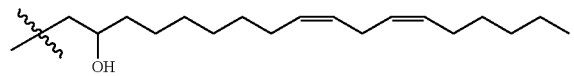
OF-02
where R=
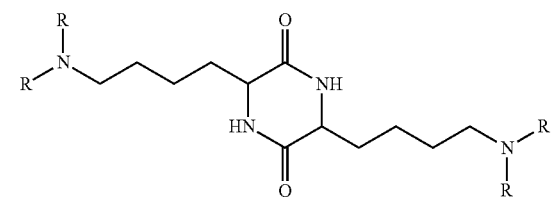
(xii)
In some embodiments, a lipid of Formula (xii) can be represented by the following structure
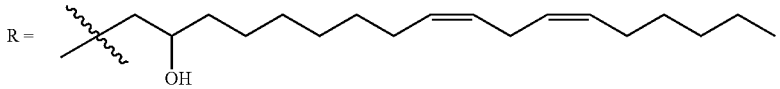
(xii) (a)
R =
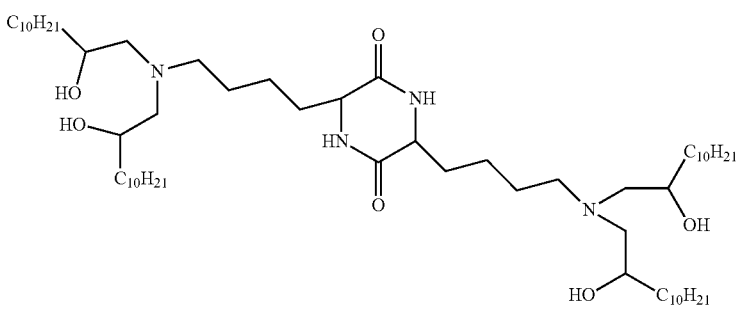
OF-02
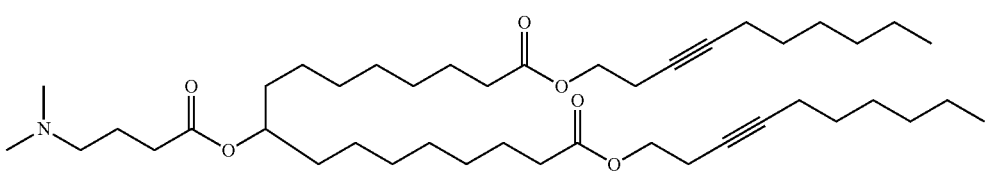
(xiii)
(xiv)

In some embodiments an LNP comprises a compound of Formula (xiii) and a compound of Formula (xiv).

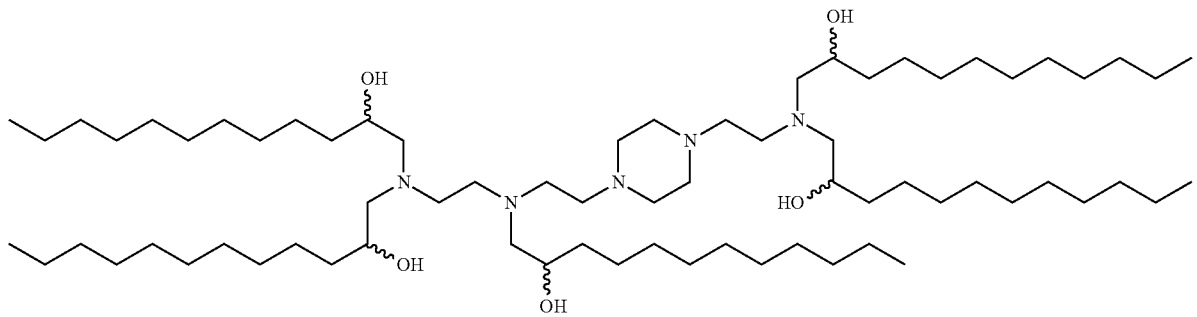

(xv)

In some embodiments an LNP comprising Formula (xv) is used to deliver a GeneWriter composition described herein to the liver and/or hepatocyte cells.

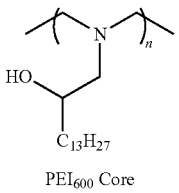

(xvi)

In some embodiments an LNP comprising a formulation of Formula (xvi) is used to deliver a GeneWriter composition described herein to the lung endothelial cells.

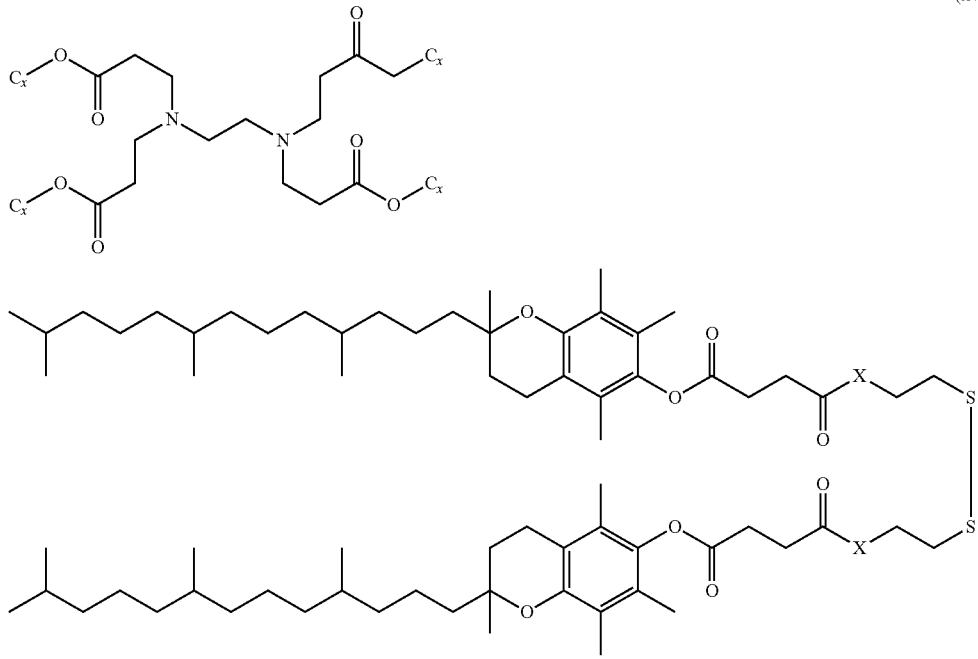

(xvii)

X = amino structure where X=

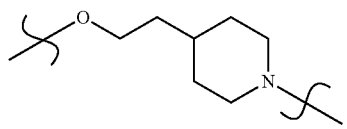

(xviii)(a)

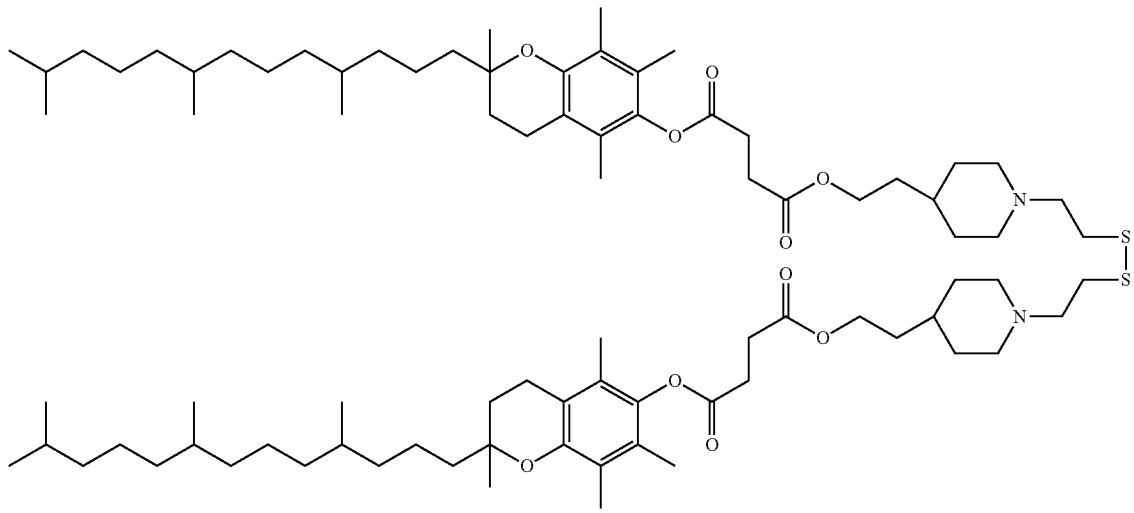

(xviii)(b)

(xix)

In some embodiments, a lipid compound used to form lipid nanoparticles for the delivery of compositions described herein, e.g., nucleic acid (e.g., RNA) described herein (e.g., a template nucleic acid or a nucleic acid encoding a GeneWriter) is made by one of the following reactions:

(xx)(a)

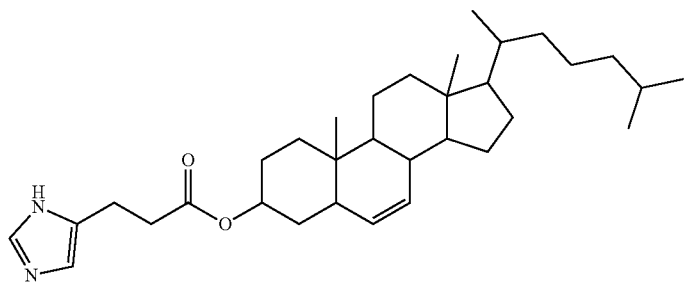

+

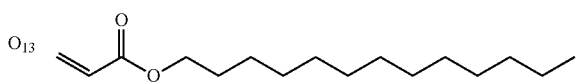

-continued (xx)(b)

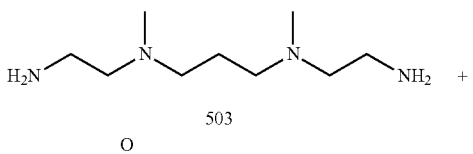

+

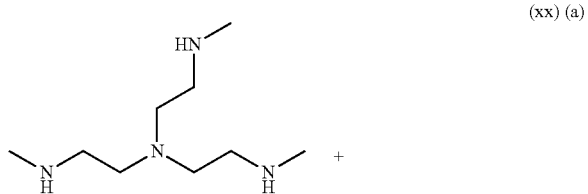

Exemplary non-cationic lipids include, but are not limited to, distearoyl-sn-glycero-phosphoethanolamine, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), 1,2-dioleoyl-sn-glycero-3-phosphoethanolamine (DOPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidylethanolamine (DSPE), monomethyl-phosphatidylethanolamine (such as 16-O-monomethyl PE), dimethylphosphatidylethanolamine (such as 16-O-dimethyl PE), 18-1-trans PE, 1-stearoyl-2-oleoyl-phosphatidyethanolamine (SOPE), hydrogenated soy phosphatidylcholine (HSPC), egg phosphatidylcholine (EPC), dioleoylphosphatidylserine (DOPS), sphingomyelin (SM), dimyristoyl phosphatidylcholine (DMPC), dimyristoyl phosphatidylglycerol (DMPG), distearoylphosphatidylglycerol (DSPG), dierucoylphosphatidylcholine (DEPC), palmitoyloleyolphosphatidylglycerol (POPG), dielaidoyl-phosphatidylethanolamine (DEPE), lecithin, phosphatidylethanolamine, lysolecithin, lysophosphatidylethanolamine, phosphatidylserine, phosphatidylinositol, sphingomyelin, egg sphingomyelin (ESM), cephalin, cardiolipin, phosphatidicacid,cerebrosides, dicetylphosphate, lysophosphatidylcholine, dilinoleoylphosphatidylcholine, or mixtures thereof. It is understood that other diacylphosphatidylcholine and diacylphosphatidylethanolamine phospholipids can also be used. The acyl groups in these lipids are preferably acyl groups derived from fatty acids having C10-C24 carbon chains, e.g., lauroyl, myristoyl, paimitoyl, stearoyl, or oleoyl. Additional exemplary lipids, in certain embodiments, include, without limitation, those described in Kim et al. (2020) dx.doi.org/10.1021/acs.nanolett.0c01386, incorporated herein by reference. Such lipids include, in some embodiments, plant lipids found to improve liver transfection with mRNA (e.g., DGTS).

In some embodiments, the non-cationic lipid may have the following structure

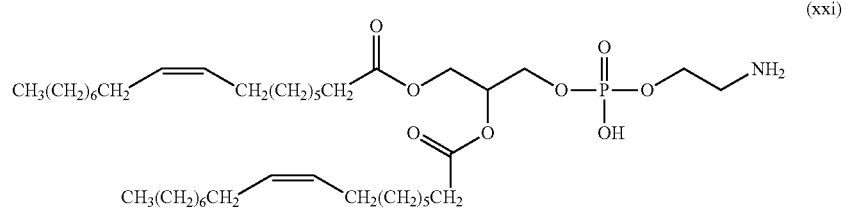

(xxi)

Other examples of non-cationic lipids suitable for use in the lipid nanopartieles include, without limitation, nonphosphorous lipids such as, e.g., stearylamine, dodeeylamine, hexadecylamine, acetyl palmitate, glycerol ricinoleate, hexadecyl stereate, isopropyl myristate, amphoteric acrylic polymers, triethanolamine-lauryl sulfate, alkyl-aryl sulfate polyethyloxylated fatty acid amides, dioctadecyl dimethyl ammonium bromide, ceramide, sphingomyelin, and the like. Other non-cationic lipids are described in WO2017/099823 or US patent publication US2018/0028664, the contents of which is incorporated herein by reference in their entirety.

In some embodiments, the non-cationic lipid is oleic acid or a compound of Formula I, II, or IV of US2018/0028664, incorporated herein by reference in its entirety. The non-cationic lipid can comprise, for example, 0-30% (mol) of the total lipid present in the lipid nanoparticle. In some embodiments, the non-cationic lipid content is 5-20% (mol) or 10-15% (mol) of the total lipid present in the lipid nanoparticle. In embodiments, the molar ratio of ionizable lipid to the neutral lipid ranges from about 2:1 to about 8:1 (e.g., about 2:1, 3:1, 4:1, 5:1, 6:1, 7:1, or 8:1).

In some embodiments, the lipid nanoparticles do not comprise any phospholipids.

In some aspects, the lipid nanoparticle can further comprise a component, such as a sterol, to provide membrane integrity. One exemplary sterol that can be used in the lipid nanoparticle is cholesterol and derivatives thereof. Non-limiting examples of cholesterol derivatives include polar analogues such as 5a-choiestanol, 53-coprostanol, choiesteryl-(2-hydroxy)-ethyl ether, choiesteryl-(4'-hydroxy)-butyl ether, and 6-ketocholestanol; non-polar analogues such as 5a-cholestane, cholestenone, 5a-cholestanone, 5p-cholestanone, and cholesteryl decanoate; and mixtures thereof. In some embodiments, the cholesterol derivative is a polar analogue, e.g., choiesteryl-(4'-hydroxy)-butyl ether. Exemplary cholesterol derivatives are described in PCT publication WO2009/127060 and US patent publication US2010/0130588, each of which is incorporated herein by reference in its entirety.

In some embodiments, the component providing membrane integrity, such as a sterol, can comprise 0-50% (mol) (e.g., 0-10%, 10-20%, 20-30%, 30-40%, or 40-50%) of the total lipid present in the lipid nanoparticle. In some embodiments, such a component is 20-50% (mol) 30-40% (mol) of the total lipid content of the lipid nanoparticle.

In some embodiments, the lipid nanoparticle can comprise a polyethylene glycol (PEG) or a conjugated lipid molecule. Generally, these are used to inhibit aggregation of lipid nanoparticles and/or provide steric stabilization. Exemplary conjugated lipids include, but are not limited to, PEG-lipid conjugates, polyoxazoline (POZ)-lipid conjugates, polyamide-lipid conjugates (such as ATTA-lipid conjugates), cationic-polymer lipid (CPL) conjugates, and mixtures thereof. In some embodiments, the conjugated lipid molecule is a PEG-lipid conjugate, for example, a (methoxy polyethylene glycol)-conjugated lipid.

Exemplary PEG-lipid conjugates include, but are not limited to, PEG-diacylglycerol (DAG) (such as 1-(monomethoxy-polyethyleneglycol)-2,3-dimyristoylglycerol (PEG-DMG)), PEG-dialkyloxypropyl (DAA), PEG-phospholipid, PEG-ceramide (Cer), a pegylated phosphatidylethanoloamine (PEG-PE), PEG succinate diacylglycerol (PEGS-DAG) (such as 4-0-(2', 3'-di (tetradecanoyloxy)propyl-1-0-(w-methoxy (polyethoxy)ethyl) butanedioate (PEG-S-DMG)), PEG dialkoxypropylcarbam, N-(carbonyl-methoxypolyethylene glycol 2000)-1,2-distearoyl-sn-glycero-3-phosphoethanolamine sodium salt, 1,2-dimyristoyl-sn-glycerol, methoxypoly ethylene glycol (DMG-PEG-2K), or a mixture thereof. Additional exemplary PEG-lipid conjugates are described, for example, in U.S. Pat. Nos. 5,885,613, 6,287,591, US2003/0077829, US2003/0077829, US2005/0175682, US2008/0020058, US2011/0117125, US2010/0130588, US2016/0376224, US2017/0119904, and US/099823, the contents of all of which are incorporated herein by reference in their entirety. In some embodiments, a PEG-lipid is a compound of Formula III, III-a-I, III-a-2, III-b-1, III-b-2, or V of US2018/0028664, the content of which is incorporated herein by reference in its entirety. In some embodiments, a PEG-lipid is of Formula II of US20150376115 or US2016/0376224, the content of both of which is incorporated herein by reference in its entirety. In some embodiments, the PEG-DAA conjugate can be, for example, PEG-dilauryloxypropyl, PEG-dimyristyloxypropyl, PEG-dipalmityloxypropyl, or PEG-distearyloxypropyl. The PEG-lipid can be one or more of PEG-DMG, PEG-dilaurylglycerol, PEG-dipalmitoylglycerol, PEG-disterylglycerol, PEG-dilaurylglycamide, PEG-dimyristylglycamide, PEG-dipalmitoylglycamide, PEG-disterylglycamide, PEG-cholesterol (1-[8'-(Cholest-5-en-3 [beta]-oxy) carboxamido-3', 6'-dioxaoctanyl] carbamoyl-[omega]-methyl-poly (ethylene glycol), PEG-DMB (3,4-Ditetradecoxylbenzyl-[omega]-methyl-poly (ethylene glycol) ether), and 1,2-dimyristoyl-sn-glycero-3-phosphoethanolamine-N-[methoxy (polyethylene glycol)-2000]. In some embodiments, the PEG-lipid comprises PEG-DMG, 1,2-dimyristoyl-sn-glycero-3-phosphoethanolamine-N-[methoxy (polyethylene glycol)-2000]. In some embodiments, the PEG-lipid comprises a structure selected from:

WO2020106946A1, the contents of all of which are incorporated herein by reference in their entirety.

In some embodiments an LNP comprises a compound of Formula (xix), a compound of Formula (xxi) and a compound of Formula (xxv). In some embodiments a LNP comprising a formulation of Formula (xix), Formula (xxi) and Formula (xxv) is used to deliver a GeneWriter composition described herein to the lung or pulmonary cells.

In some embodiments, the PEG or the conjugated lipid can comprise 0-20% (mol) of the total lipid present in the lipid nanoparticle. In some embodiments, PEG or the conjugated lipid content is 0.5-10% or 2-5% (mol) of the total lipid present in the lipid nanoparticle. Molar ratios of the ionizable lipid, non-cationic-lipid, sterol, and PEG/conjugated lipid can be varied as needed. For example, the lipid particle can comprise 30-70% ionizable lipid by mole or by total weight of the composition, 0-60% cholesterol by mole or by total weight of the composition, 0-30% non-cationic-lipid by mole or by total weight of the composition and

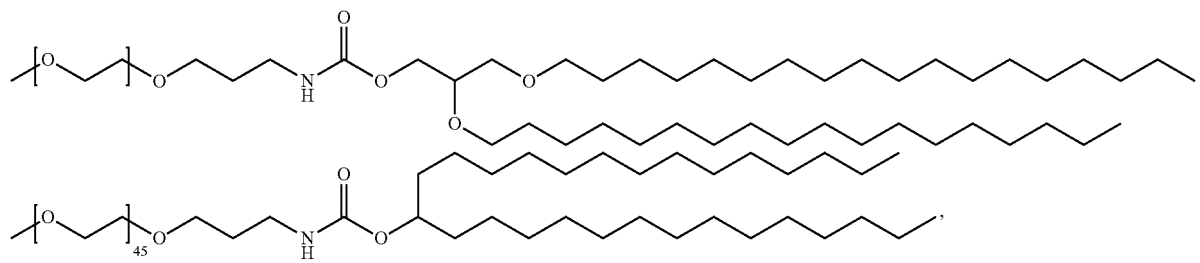

(xxii)

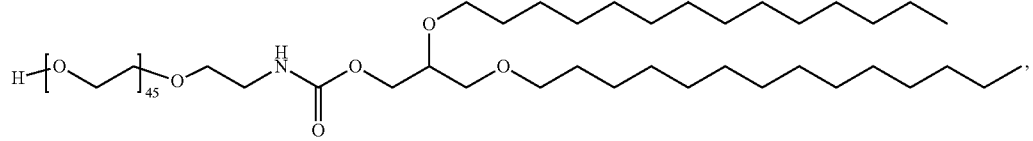

(xxiii)

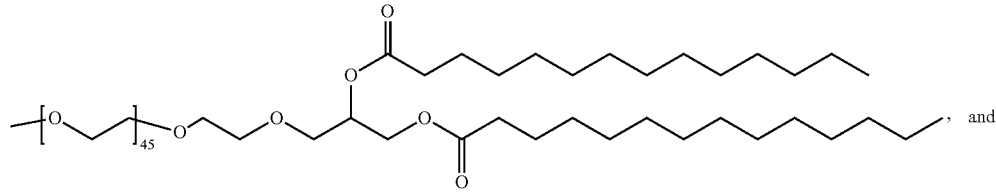

(xxiv)

, and

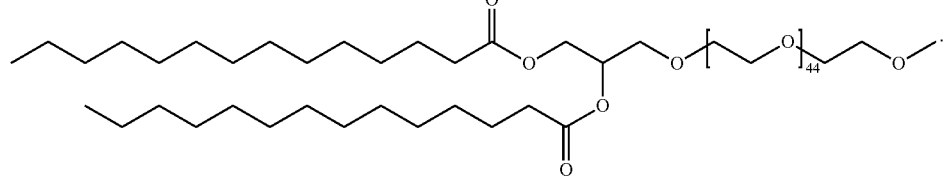

(xxv)

In some embodiments, lipids conjugated with a molecule other than a PEG can also be used in place of PEG-lipid. For example, polyoxazoline (POZ)-lipid conjugates, polyamide-lipid conjugates (such as ATTA-lipid conjugates), and cationic-polymer lipid (GPL) conjugates can be used in place of or in addition to the PEG-lipid.

Exemplary conjugated lipids, i.e., PEG-lipids, (POZ)-lipid conjugates, ATTA-lipid conjugates and cationic polymer-lipids are described in the PCT and LIS patent applications listed in Table 2 of WO2019051289A9 and in 1-10% conjugated lipid by mole or by total weight of the composition. Preferably, the composition comprises 30-40% ionizable lipid by mole or by total weight of the composition, 40-50% cholesterol by mole or by total weight of the composition, and 10-20% non-cationic-lipid by mole or by total weight of the composition. In some other embodiments, the composition is 50-75% ionizable lipid by mole or by total weight of the composition, 20-40% cholesterol by mole or by total weight of the composition, and 5 to 10% non-cationic-lipid, by mole or by total weight of the composition and 1-10% conjugated lipid by mole or by total weight of the composition. The composition may contain 60-70% ionizable lipid by mole or by total weight of the composition, 25-35% cholesterol by mole or by total weight of the composition, and 5-10% non-cationic-lipid by mole or by total weight of the composition. The composition may also contain up to 90% ionizable lipid by mole or by total weight of the composition and 2 to 15% non-cationic lipid by mole or by total weight of the composition. The formulation may also be a lipid nanoparticle formulation, for example comprising 8-30% ionizable lipid by mole or by total weight of the composition, 5-30% non-cationic lipid by mole or by total weight of the composition, and 0-20% cholesterol by mole or by total weight of the composition; 4-25% ionizable lipid by mole or by total weight of the composition, 4-25% non-cationic lipid by mole or by total weight of the composition, 2 to 25% cholesterol by mole or by total weight of the composition, 10 to 35% conjugate lipid by mole or by total weight of the composition, and 5% cholesterol by mole or by total weight of the composition; or 2-30% ionizable lipid by mole or by total weight of the composition, 2-30% non-cationic lipid by mole or by total weight of the composition, 1 to 15% cholesterol by mole or by total weight of the composition, 2 to 35% conjugate lipid by mole or by total weight of the composition, and 1-20% cholesterol by mole or by total weight of the composition; or even up to 90% ionizable lipid by mole or by total weight of the composition and 2-10% non-cationic lipids by mole or by total weight of the composition, or even 100% cationic lipid by mole or by total weight of the composition. In some embodiments, the lipid particle formulation comprises ionizable lipid, phospholipid, cholesterol and a PEG-ylated lipid in a molar ratio of 50:10:38.5:1, 5. In some other embodiments, the lipid particle formulation comprises ionizable lipid, cholesterol and a PEG-ylated lipid in a molar ratio of 60:38.5:1.5.

In some embodiments, the lipid particle comprises ionizable lipid, non-cationic lipid (e.g. phospholipid), a sterol (e.g., cholesterol) and a PEG-ylated lipid, where the molar ratio of lipids ranges from 20 to 70 mole percent for the ionizable lipid, with a target of 40-60, the mole percent of non-cationic lipid ranges from 0 to 30, with a target of 0 to 15, the mole percent of sterol ranges from 20 to 70, with a target of 30 to 50, and the mole percent of PEG-ylated lipid ranges from 1 to 6, with a target of 2 to 5.

In some embodiments, the lipid particle comprises ionizable lipid/non-cationic-lipid/sterol/conjugated lipid at a molar ratio of 50:10:38.5:1.5.

In an aspect, the disclosure provides a lipid nanoparticle formulation comprising phospholipids, lecithin, phosphatidylcholine and phosphatidylethanolamine.

In some embodiments, one or more additional compounds can also be included. Those compounds can be administered separately or the additional compounds can be included in the lipid nanoparticles of the invention. In other words, the lipid nanoparticles can contain other compounds in addition to the nucleic acid or at least a second nucleic acid, different than the first. Without limitations, other additional compounds can be selected from the group consisting of small or large organic or inorganic molecules, monosaccharides, disaccharides, trisaccharides, oligosaccharides, polysaccharides, peptides, proteins, peptide analogs and derivatives thereof, peptidomimetics, nucleic acids, nucleic acid analogs and derivatives, an extract made from biological materials, or any combinations thereof.

In some embodiments, a lipid nanoparticle (or a formulation comprising lipid nanoparticles) lacks reactive impurities (e.g., aldehydes or ketones), or comprises less than a preselected level of reactive impurities (e.g., aldehydes or ketones). While not wishing to be bound by theory, in some embodiments, a lipid reagent is used to make a lipid nanoparticle formulation, and the lipid reagent may comprise a contaminating reactive impurity (e.g., an aldehyde or ketone). A lipid regent may be selected for manufacturing based on having less than a preselected level of reactive impurities (e.g., aldehydes or ketones). Without wishing to be bound by theory, in some embodiments, aldehydes can cause modification and damage of RNA, e.g., cross-linking between bases and/or covalently conjugating lipid to RNA (e.g., forming lipid-RNA adducts). This may, in some instances, lead to failure of a reverse transcriptase reaction and/or incorporation of inappropriate bases, e.g., at the site(s) of lesion(s), e.g., a mutation in a newly synthesized target DNA.

In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, a lipid nanoparticle formulation is produced using a lipid reagent comprising less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, a lipid nanoparticle formulation is produced using a lipid reagent comprising: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation is produced using a plurality of lipid reagents, and each lipid reagent of the plurality independently meets one or more criterion described in this paragraph. In some embodiments, each lipid reagent of the plurality meets the same criterion, e.g., a criterion of this paragraph.

In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, the lipid nanoparticle formulation comprises less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, the lipid nanoparticle formulation comprises: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content. In some embodiments, one or more, or optionally all, of the lipid reagents used for a lipid nanoparticle as described herein or a formulation thereof comprise less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species. In some embodiments, one or more, or optionally all, of the lipid reagents used for a lipid nanoparticle as described herein or a formulation thereof comprise: (i) less than 5%, 4%, 3%, 2%, 1%, 0.9%, 0.8%, 0.7%, 0.6%, 0.5%, 0.4%, 0.3%, 0.2%, or 0.1% total reactive impurity (e.g., aldehyde) content; and (ii) less than 5%, 4%, 3%, 2%, 1%, 0.9%, 0.8%, 0.7%, 0.6%, 0.5%, 0.4%, 0.3%, 0.2%, or 0.1% of any single reactive impurity (e.g., aldehyde) species.

In some embodiments, total aldehyde content and/or quantity of any single reactive impurity (e.g., aldehyde) species is determined by liquid chromatography (LC), e.g., coupled with tandem mass spectrometry (MS/MS), e.g., according to the method described in Example 40. In some embodiments, reactive impurity (e.g., aldehyde) content and/or quantity of reactive impurity (e.g., aldehyde) species is determined by detecting one or more chemical modifications of a nucleic acid molecule (e.g., an RNA molecule, e.g., as described herein) associated with the presence of reactive impurities (e.g., aldehydes), e.g., in the lipid reagents. In some embodiments, reactive impurity (e.g., aldehyde) content and/or quantity of reactive impurity (e.g., aldehyde) species is determined by detecting one or more chemical modifications of a nucleotide or nucleoside (e.g., a ribonucleotide or ribonucleoside, e.g., comprised in or isolated from a template nucleic acid, e.g., as described herein) associated with the presence of reactive impurities (e.g., aldehydes), e.g., in the lipid reagents, e.g., as described in Example 41. In embodiments, chemical modifications of a nucleic acid molecule, nucleotide, or nucleoside are detected by determining the presence of one or more modified nucleotides or nucleosides, e.g., using LC-MS/MS analysis, e.g., as described in Example 41.

In some embodiments, a nucleic acid (e.g., RNA) described herein (e.g., a template nucleic acid or a nucleic acid encoding a GeneWriter) does not comprise an aldehyde modification, or comprises less than a preselected amount of aldehyde modifications. In some embodiments, on average, a nucleic acid has less than 50, 20, 10, 5, 2, or 1 aldehyde modifications per 1000 nucleotides, e.g., wherein a single cross-linking of two nucleotides is a single aldehyde modification. In some embodiments, the aldehyde modification is an RNA adduct (e.g., a lipid-RNA adduct). In some embodiments, the aldehyde-modified nucleotide is cross-linking between bases. In some embodiments, a nucleic acid (e.g., RNA) described herein comprises less than 50, 20, 10, 5, 2, or 1 cross-links between nucleotide.

In some embodiments, LNPs are directed to specific tissues by the addition of targeting domains. For example, biological ligands may be displayed on the surface of LNPs to enhance interaction with cells displaying cognate receptors, thus driving association with and cargo delivery to tissues wherein cells express the receptor. In some embodiments, the biological ligand may be a ligand that drives delivery to the liver, e.g., LNPs that display GalNAc result in delivery of nucleic acid cargo to hepatocytes that display asialoglycoprotein receptor (ASGPR). The work of Akinc et al. *Mol Ther* 18 (7): 1357-1364 (2010) teaches the conjugation of a trivalent GalNAc ligand to a PEG-lipid (Gal-NAc-PEG-DSG) to yield LNPs dependent on ASGPR for observable LNP cargo effect (see, e.g., FIG. 6). Other ligand-displaying LNP formulations, e.g., incorporating folate, transferrin, or antibodies, are discussed in WO2017223135, which is incorporated herein by reference in its entirety, in addition to the references used therein, namely Kolhatkar et al., Curr Drug Discov Technol. 2011 8:197-206; Musacchio and Torchilin, Front Biosci. 2011 16:1388-1412; Yu et al., Mol Membr Biol. 2010 27:286-298; Patil et al., Crit Rev Ther Drug Carrier Syst. 2008 25:1-61; Benoit et al., Biomacromolecules. 2011 12:2708-2714; Zhao et al., Expert Opin Drug Deliv. 2008 5:309-319; Akinc et al., Mol Ther. 2010 18:1357-1364; Srinivasan et al., Methods Mol Biol. 2012 820:105-116; Ben-Arie et al., Methods Mol Biol. 2012 757:497-507; Peer 2010 J Control Release. 20:63-68; Peer et al., Proc Natl Acad Sci USA. 2007 104:4095-4100; Kim et al., Methods Mol Biol. 2011 721: 339-353; Subramanya et al., Mol Ther. 2010 18:2028-2037; Song et al., Nat Biotechnol. 2005 23:709-717; Peer et al., Science. 2008 319:627-630; and Peer and Lieberman, Gene Ther. 2011 18:1127-1133.

In some embodiments, LNPs are selected for tissue-specific activity by the addition of a Selective ORgan Targeting (SORT) molecule to a formulation comprising traditional components, such as ionizable cationic lipids, amphipathic phospholipids, cholesterol and poly (ethylene glycol) (PEG) lipids. The teachings of Cheng et al. Nat Nanotechnol 15 (4): 313-320 (2020) demonstrate that the addition of a supplemental "SORT" component precisely alters the in vivo RNA delivery profile and mediates tissue-specific (e.g., lungs, liver, spleen) gene delivery and editing as a function of the percentage and biophysical property of the SORT molecule.

In some embodiments, the LNPs comprise biodegradable, ionizable lipids. In some embodiments, the LNPs comprise (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl) propyl (9Z,12Z)-octadeca-9,12-dienoate) or another ionizable lipid. Sec, e.g, lipids of WO2019/067992, WO/2017/173054, WO2015/095340, and WO2014/136086, as well as references provided therein. In some embodiments, the term cationic and ionizable in the context of LNP lipids is interchangeable, e.g., wherein ionizable lipids are cationic depending on the pH.

In some embodiments, multiple components of a GENE WRITER™ system may be prepared as a single LNP formulation, e.g., an LNP formulation comprises mRNA encoding for the GENE WRITER™ polypeptide and an RNA template. Ratios of nucleic acid components may be varied in order to maximize the properties of a therapeutic. In some embodiments, the ratio of RNA template to mRNA encoding a GENE WRITER™ polypeptide is about 1:1 to 100:1, e.g., about 1:1 to 20:1, about 20:1 to 40:1, about 40:1 to 60:1, about 60:1 to 80:1, or about 80:1 to 100:1, by molar ratio. In other embodiments, a system of multiple nucleic acids may be prepared by separate formulations, e.g., one LNP formulation comprising a template RNA and a second LNP formulation comprising an mRNA encoding a GENE WRITER™ polypeptide. In some embodiments, the system may comprise more than two nucleic acid components formulated into LNPs. In some embodiments, the system may comprise a protein, e.g., a GENE WRITER™ polypeptide, and a template RNA formulated into at least one LNP formulation.

In some embodiments, the average LNP diameter of the LNP formulation may be between 10s of nm and 100s of nm, e.g., measured by dynamic light scattering (DLS). In some embodiments, the average LNP diameter of the LNP formulation may be from about 40 nm to about 150 nm, such as about 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, or 150 nm. In some embodiments, the average LNP diameter of the LNP formulation may be from about 50 nm to about 100 nm, from about 50 nm to about 90 nm, from about 50 nm to about 80 nm, from about 50 nm to about 70 nm, from about 50 nm to about 60 nm, from about 60 nm to about 100 nm, from about 60 nm to about 90 nm, from about 60 nm to about 80 nm, from about 60 nm to about 70 nm, from about 70 nm to about 100 nm, from about 70 nm to about 90 nm, from about 70 nm to about 80 nm, from about 80 nm to about 100 nm, from about 80 nm to about 90 nm, or from about 90 nm to about 100 nm. In some embodiments, the average LNP diameter of the LNP formulation may be from about 70 nm to about 100 nm. In a particular embodiment, the average LNP diameter of the LNP formulation may be about 80 nm. In some embodiments, the average LNP diameter of the LNP formulation may be about 100 nm. In some embodiments, the average LNP diameter of the LNP formulation ranges from about 1 mm to about 500 mm, from about 5 mm to about 200 mm, from about 10 mm to about 100 mm, from about 20 mm to about 80 mm, from about 25 mm to about 60 mm, from about 30 mm to about 55 mm, from about 35 mm to about 50 mm, or from about 38 mm to about 42 mm.

A LNP may, in some instances, be relatively homogenous. A polydispersity index may be used to indicate the homogeneity of a LNP, e.g., the particle size distribution of the lipid nanoparticles. A small (e.g., less than 0.3) polydispersity index generally indicates a narrow particle size distribution. A LNP may have a polydispersity index from about 0 to about 0.25, such as 0.01, 0.02, 0.03, 0.04, 0.05, 0.06, 0.07, 0.08, 0.09, 0.10, 0.11, 0.12, 0.13, 0.14, 0.15, 0.16, 0.17, 0.18, 0.19, 0.20, 0.21, 0.22, 0.23, 0.24, or 0.25. In some embodiments, the polydispersity index of a LNP may be from about 0.10 to about 0.20.

The zeta potential of a LNP may be used to indicate the electrokinetic potential of the composition. In some embodiments, the zeta potential may describe the surface charge of a LNP. Lipid nanoparticles with relatively low charges, positive or negative, are generally desirable, as more highly charged species may interact undesirably with cells, tissues, and other elements in the body. In some embodiments, the zeta potential of a LNP may be from about −10 mV to about +20 mV, from about −10 mV to about +15 mV, from about −10 mV to about +10 mV, from about −10 mV to about +5 mV, from about −10 mV to about 0 mV, from about −10 mV to about −5 mV, from about −5 mV to about +20 mV, from about −5 mV to about +15 mV, from about −5 mV to about +10 mV, from about −5 mV to about +5 mV, from about −5 mV to about 0 mV, from about 0 mV to about +20 mV, from about 0 mV to about +15 mV, from about 0 mV to about +10 mV, from about 0 mV to about +5 mV, from about +5 mV to about +20 mV, from about +5 mV to about +15 mV, or from about +5 mV to about +10 mV.

The efficiency of encapsulation of a protein and/or nucleic acid, e.g., GENE WRITER™ polypeptide or mRNA encoding the polypeptide, describes the amount of protein and/or nucleic acid that is encapsulated or otherwise associated with a LNP after preparation, relative to the initial amount provided. The encapsulation efficiency is desirably high (e.g., close to 100%). The encapsulation efficiency may be measured, for example, by comparing the amount of protein or nucleic acid in a solution containing the lipid nanoparticle before and after breaking up the lipid nanoparticle with one or more organic solvents or detergents. An anion exchange resin may be used to measure the amount of free protein or nucleic acid (e.g., RNA) in a solution. Fluorescence may be used to measure the amount of free protein and/or nucleic acid (e.g., RNA) in a solution. For the lipid nanoparticles described herein, the encapsulation efficiency of a protein and/or nucleic acid may be at least 50%, for example 50%, 55%, 60%, 65%, 70%, 75%, 80%, 85%, 90%, 91%, 92%, 93%, 94%, 95%, 96%, 97%, 98%, 99%, or 100%. In some embodiments, the encapsulation efficiency may be at least 80%. In some embodiments, the encapsulation efficiency may be at least 90%. In some embodiments, the encapsulation efficiency may be at least 95%.

A LNP may optionally comprise one or more coatings. In some embodiments, a LNP may be formulated in a capsule, film, or table having a coating. A capsule, film, or tablet including a composition described herein may have any useful size, tensile strength, hardness or density.

Additional exemplary lipids, formulations, methods, and characterization of LNPs are taught by WO2020061457, which is incorporated herein by reference in its entirety.

In some embodiments, in vitro or ex vivo cell lipofections are performed using LIPOFECTAMINE™ MESSENGERMAX™ (Thermo Fisher) or TransIT-mRNA Transfection Reagent (Mirus Bio). In certain embodiments, LNPs are formulated using the Gen Voy_ILM ionizable lipid mix (Precision NanoSystems). In certain embodiments, LNPs are formulated using 2,2-dilinoleyl-4-dimethylaminoethyl-[1,3]-dioxolane (DLin-KC2-DMA) or dilinoleylmethyl-4-dimethylaminobutyrate (DLin-MC3-DMA or MC3), the formulation and in vivo use of which are taught in Jayaraman et al. Angew Chem Int Ed Engl 51 (34): 8529-8533 (2012), incorporated herein by reference in its entirety.

LNP formulations optimized for the delivery of CRISPR-Cas systems, e.g., Cas9-gRNA RNP, gRNA, Cas9 mRNA, are described in WO2019067992 and WO2019067910, both incorporated by reference.

Additional specific LNP formulations useful for delivery of nucleic acids are described in U.S. Pat. Nos. 8,158,601 and 8,168,775, both incorporated by reference, which include formulations used in patisiran, sold under the name ONPATTRO.

Exemplary dosing of GENE WRITER™ LNP may include about 0.1, 0.25, 0.3, 0.5, 1, 2, 3, 4, 5, 6, 8, 10, or 100 mg/kg (RNA). Exemplary dosing of AAV comprising a nucleic acid encoding one or more components of the system may include an MOI of about $10^{11}$, $10^{12}$, $10^{13}$, and $10^{14}$ vg/kg.

All publications, patent applications, patents, and other publications and references (e.g., sequence database reference numbers) cited herein are incorporated by reference in their entirety. For example, all GenBank, Unigene, and Entrez sequences referred to herein, e.g., in any Table herein, are incorporated by reference. Unless otherwise specified, the sequence accession numbers specified herein, including in any Table herein, refer to the database entries current as of Mar. 4, 2020. When one gene or protein references a plurality of sequence accession numbers, all of the sequence variants are encompassed.

EXAMPLES

The invention is further illustrated by the following examples. The examples are provided for illustrative purposes only and are not to be construed as limiting the scope or content of the invention in any way.

Example 1: GENE WRITER™ Enabling Nucleotide Substitution in Genomic DNA to Correct Alpha-1 Antitrypsin Deficiency Mutation in Human Cells This example describes the use of a GENE WRITER™ gene editing system to alter a genomic sequence at a single nucleotide.

In this example, the GENE WRITER™ polypeptide and writing template are provided as DNA transfected into HEK293T cells that possess the PiZ genotype (E342K), a common allele associated with alpha-1 antitrypsin deficiency. The GENE WRITER™ polypeptide uses a Cas9 nickase for both DNA-binding and endonuclease functions. The writing template is designed to have homology to the target sequence, while incorporating additional nucleotides at the desired position, such that reverse transcription of the template RNA results in the generation of a new DNA strand containing the substitution.

To create the transversion in the affected human SERPINA1 gene that restores the GAG triplet coding for glutamate in healthy patients, the GENE WRITER™ polypeptide is used with a specific template nucleic acid, which encodes a gRNA scaffold for polypeptide binding, a spacer for polypeptide homing, target homology domain to set up TPRT, and a template sequence for reverse transcription that includes the required substitution. An exemplary template RNA carries the sequence (1) TCCCCTCCAGGCCGTGCATA (2) GTTTTAGAGCTAGAAATAGCAAGTTAAAATAAG GCTAGTCCGTTATCAACTTGAAAAAGTGGGACCGAGTCGGTCC (3) TcGTCGATGGTC AGCACAGCCTTAT (4) GCACGGCCTGGA (SEQ ID NO: 1607), where numbers are used to delineate the modules of the template in the order (5'-3') (1) gRNA spacer, (2) gRNA scaffold, (3) heterologous object sequence, (4) 3' homology priming domain, and the lowercase "c" indicates the position in the template carrying the nucleotide substitution to be written into the target site to correct the E342K mutation. An exemplary gRNA for providing a second nick as described in embodiments of this system comprises the spacer sequence TTTGTTGAACTTGACCTCGG (SEQ ID NO: 1608) and directs a Cas9 nickase to nick the second strand of the target site within the homologous region. In some embodiments, this second nick improves the efficiency of the edit.

After transfection, cells are incubated for three days to allow for expression of the GENE WRITING™ system and conversion of the genomic DNA target, and genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 2: GENE WRITER™ Enabling Short Insertion in Genomic DNA to Correct CFTR

This example describes the use of a GENE WRITER™ gene editing system to alter a genomic sequence by insertion of a short string of nucleotides.

In this example, the GENE WRITER™ polypeptide and writing template are provided as DNA transfected into HEK293T cells that possess the CFTR delta-F508 mutation, a common allele associated with cystic fibrosis. The GENE WRITER™ polypeptide uses a Cas9 nickase for both DNA-binding and endonuclease functions. The writing template is designed to have homology to the target sequence, while incorporating additional nucleotides at the desired position, such that reverse transcription of the template RNA results in the generation of a new DNA strand containing the short insertion.

To create a short insertion in the affected human CFTR locus that restores the TTT triplet coding for phenylalanine in healthy patients, the GENE WRITER™ polypeptide is used with a specific template, which encodes a spacer for polypeptide homing, target homology domain to set up TPRT, and a template sequence for reverse transcription that includes the 3-nt insertion.

After transfection, cells are incubated for three days to allow for expression of the GENE WRITING™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 3: GENE WRITER™ Enabling Deletion of Genomic DNA to Correct Duchenne Muscular Dystrophy (DMD)

This example describes the use of a GENE WRITER™ gene editing system to alter a genomic sequence by deletion of nucleotides.

One of the most common mutations found in patients with DMD is a deletion that eliminates exon 50 in the rod domain of dystrophin, which places exon 51 out of frame with preceding exons. Such a mutation results in production of truncated dystrophin, leading to the pathological effects of the disease. In order to ameliorate disease, the remainder of the 79 total exons, the splice acceptor site is deleted from exon 51, resulting in restoration of the full-length protein, an approach known as exon skipping.

In this example, the GENE WRITER™ polypeptide and writing template are provided as RNA nucleofected into cells containing a deletion in exon 50 that results in a truncated dystrophin product, as described above. Target cells are either patient-derived iPSCs containing the mutation or are synthetically engineered using CRISPR-Cas to generate the deletion. The GENE WRITER™ polypeptide uses a Cas9 nickase for both DNA-binding and endonuclease functions. The writing template is designed to have homology to the target sequence, while incorporating a deletion at the desired position, such that reverse transcription of the template RNA results in the generation of a new DNA strand lacking the deleted nucleotides.

To create a short deletion that removes the exon 51 5' splice acceptor site, the GENE WRITER™ polypeptide is used with a specific template that encodes a spacer for polypeptide homing, target homology domain to set up TPRT, and a template sequence for reverse transcription that includes a 5-nt deletion proximal to the GENE WRITER™ polypeptide-induced nick, which includes the splice acceptor site.

After transfection, cells are incubated for three days to allow for expression of the GENE WRITING™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit. Protein analysis by Western blot is used to further confirm the expression of the restored dystrophin, as compared to the truncated dystrophin produced in non-edited cells.

Example 4: GENE WRITER™ Enabling Large Insertion into Genomic DNA

This example describes the use of a GENE WRITER™ gene editing system to alter a genomic sequence by insertion of a large string of nucleotides.

In this example, the GENE WRITER™ polypeptide, gRNA, and writing template are provided as DNA transfected into HEK293T cells. The GENE WRITER™ polypeptide uses a Cas9 nickase for both DNA-binding and endonuclease functions. The reverse transcriptase function is derived from the highly processive RT domain of an R2 retrotransposase. The writing template is designed to have homology to the target sequence, while incorporating the genetic payload at the desired position, such that reverse transcription of the template RNA results in the generation of a new DNA strand containing the desired insertion.

To create a large insertion in the human HEK293T cell DNA, the GENE WRITER™ polypeptide is used in conjunction with a specific gRNA, which targets the Cas9-containing GENE WRITER™ to the target locus, and a template RNA for reverse transcription, which contains an RT-binding motif (3' UTR from an R2 element) for associating with the reverse transcriptase, a region of homology to the target site for priming reverse transcription, and a genetic payload (GFP expression unit). This complex nicks the target site and then performs TPRT on the template, initiating the reaction by using priming regions on the template that are complementary to the sequence immediately adjacent to the site of the nick and copying the GFP payload into the genomic DNA.

After transfection, cells are incubated for three days to allow for expression of the GENE WRITING™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 5: GENE WRITER™ Edits not Incorporating Binding Sequences from the Template RNA This example describes the use of a GENE WRITER™ gene editing system to alter a genomic sequence by insertion of a genetic payload without causing the insertion of additional sequence from the template molecule.

In this example, the GENE WRITER™ polypeptide and writing template are provided as DNA transfected into HEK293T cells. The GENE WRITER™ polypeptide uses a Cas9 nickase for both DNA-binding and endonuclease functions. The writing template is designed to have homology to the target sequence, while incorporating the genetic payload (e.g. GFP gene expression unit) at the desired position, such that reverse transcription of the template RNA results in the generation of a new DNA strand containing the desired insertion.

To accomplish specific insertion of a genetic payload without also incorporating extraneous template motifs (e.g. protein binding motif), the layout of the template RNA molecule is such that the protein binding sequences (e.g. UTRs) are terminal to the homology sequences used to write the new payload into the genomic target site.

After transfection, cells are incubated for three days to allow for expression of the GENE WRITING™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 6: GENE WRITER™ Genome Editing in the Presence of DNA Repair Inhibitors

This example describes the use of a GENE WRITER™ gene editing system to alter a genomic sequence by insertion of a genetic payload without causing the insertion of additional sequence from the template molecule.

In this example, experiments will test the effect of different DNA repair pathways on GENE WRITER™ via the application of DNA repair pathway inhibitors or DNA repair pathway deficient cell lines. When applying DNA repair pathway inhibitors, PrestoBlue cell viability assay is performed first to determine the toxicity of the inhibitors and whether any normalization should be applied for following assays. SCR7 is an inhibitor for NHEJ, which is applied at a series of dilutions during GENE WRITER™ delivery. PARP protein is a nuclear enzyme that binds as homodimers to both single- and double-strand breaks. Thus, its inhibitors are be used in the test of relevant DNA repair pathways, including homologous recombination repair pathway and base excision repair pathway. The experiment procedure is the same with that of SCR7. Cell lines with deficient core proteins of nucleotide excision repair (NER) pathway are used to test the effect of NER on GENE WRITING™. After the delivery of the GENE WRITER™ system into the cell, ddPCR is used to evaluate the retrotransposition in the context of inhibition of DNA repair pathways. Sequencing analysis is also performed to evaluate whether certain DNA repair pathways play a role in the alteration of the integration junction. In some embodiments, GENE WRITING™ into the genome will not be decreased by the knockdown of DNA repair pathways, suggesting that the system does not utilize host cell repair pathways for DNA integration. In some embodiments, GENE WRITING™ into the genome will not be decreased by more than 50% by the knockdown of DNA repair pathways, suggesting that the system does not rely on host cell repair pathways for DNA integration.

Example 7: Internal GENE WRITER™ Deletions Demonstrating Protein Domain Modularity This example describes deletions in a GENE WRITER™ polypeptide that retain functionality and further demonstrate the modularity of the DNA binding domain.

Figure 8A:
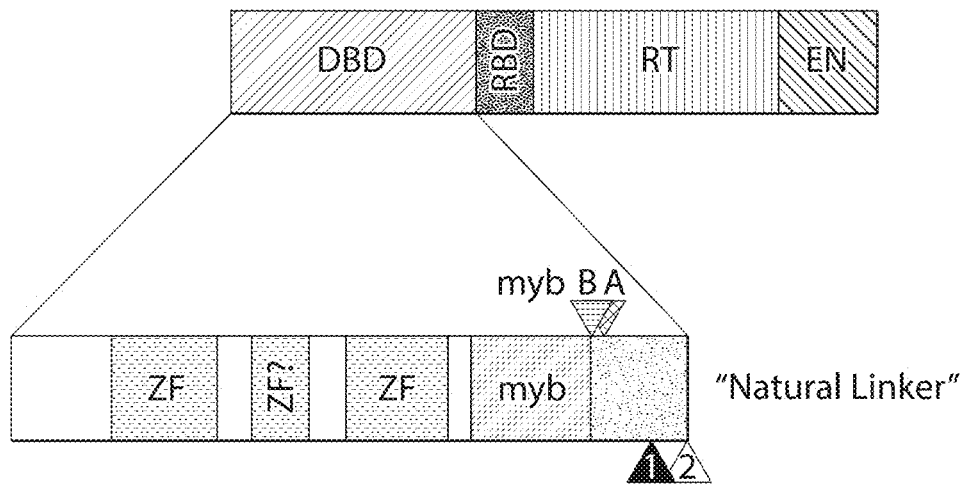
FIGS. 8A and 8B. The linker region at the C-terminus of the DNA-binding domain of R2Tg can be truncated and modified. Deletions in the Natural Linker from the myb domain at A or B to positions 1 or 2 along with replacement by 3GS (SEQ ID NO: 1024) or XTEN synthetic linkers were constructed (FIG. 8A). Integration efficiency was measured in HEK293T cells by ddPCR (FIG. 8B).

In this example, a series of experiments were performed to test the activity of various mutant retrotransposases, as well as gaining structural knowledge about the protein modularity. This experiment tested removing a polypeptide stretch after the c-myb motif in the DNA binding domain (DBD) and replacing it with a flexible linker (FIG. 8a). The polypeptide stretch removed is referred to as the "natural linker" since it is the intervening region between the DNA binding motifs and the RNA binding domain. The polypeptide region removed spans the following: on the N terminal side at either, location A (predicted random coil following c-myb motif) or location B (end of predicted alpha helix that contains part of the c-myb motif) and the removed region ends at either location v1 (alpha helical region of R2Tg that preceded the predicted-1 RNA binding motif or at location v2 (C-terminal side of an alpha helical region of R2Tg that preceded the predicted-1 RNA binding motif). In place of the polypeptide stretch removed, "natural linker", is the either of two linkers (Linker A, XTEN: SGSETPGTSESAT-PES (SEQ ID NO: 1023), and Linker B, 3GS: GGGS (SEQ ID NO: 1024)). For each of these mutant retrotransposases that contain different removed regions (location A—v1, location A—v2, location B—v1, or location B—v2) they were replaced with either linker A or linker B by PCR to a DNA plasmid that expressed R2Tg, thereby yielding these sequences: c-mybA—v1 replaced with 3GS linker (SEQ ID NO: 1024), c-mybA—v2 replaced with 3GS linker (SEQ ID NO: 1024), c-mybA—v1 replaced with XTEN linker, c-mybA—v2 replaced with XTEN linker, c-mybB—v1 replaced with 3GS linker (SEQ ID NO: 1024), c-mybB—v2 replaced with 3GS linker (SEQ ID NO: 1024), c-mybB—v1 replaced with XTEN linker, c-mybB-v2 replaced with XTEN linker, as shown in Table 50 below. The insertion of the linkers was verified by Sanger sequencing and the DNA plasmids were purified for transfection.

Table 50. Amino Acid Sequences of R2Tg Mutants with Linkers in Place of the "Natural Linker" Region that Intervenes the DNA Binding Domain (DBD) and RNA Binding Domain.

| R2Tg Mutant | Amino Acid Sequence | SEQ ID NO: |
|---|---|---|
| R2Tg with natural linker deletion c-mybA location-v1 replaced with 3GS linker (SEQ ID NO: 1024) | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLLSRK PAEEPREEPGTCHHTRRAAGGGSCFGCLESISQIRTATRDKKDTVTREK HPKKPFQKWMKDRAIKKGNYLRFQRLFYLDRGKLAKIILDDIECLSCDI PLSEIYSVFKTRWETTGSFKSLGDFKTYGKADNTAFRELITAKEIEKNV QEMSKGSAPGPDGITLGDVVKMDPEFSRTMEIFNLWLTTGKIPDMVRGC RTVLIPKSSKPDRLKDINNWRPITIGSILLRLFSRIVTARLSKACPLNP RQRGFIRAAGCSENLKLLQTIIWSAKREHRPLGVVFVDIAKAFDTVSHQ HIIHALQQREVDPHIVGLVSNMYENISTYITTKRNTHTDKIQIRVGVKQ GDPMSPLLFNLAMDPLLCKLEESGKGYHRGQSSITAMAFADDLVLLSDS WENMNTNISILETFCNLTGLKTQGQKCHGFYIKPTKDSYTINDCAAWTI NGTPLNMIDPGESEKYLGLQFDPWIGIARSGLSTKLDFWLQRIDQAPLK PLQKTDILKTYTIPRLIYIADHSEVKTALLETLDQKIRTAVKEWLHLPP CTCDAILYSSTRDGGLGITKLAGLIPSVQARRLHRIAQSSDDTMKCFME KEKMEQLHKKLWIQAGGDRENIPSIWEAPPSSEPPNNVSTNSEWEAPTQ KDKFPKPCNWRKNEFKKWTKLASQGRGIVNFERDKISNHWIQYYRRIPH RKLLTALQLRANVYPTREFLARGRQDQYIKACRHCDADIESCAHIIGNC PVTQDARIKRHNYICELLLEEAKKKDWVVFKEPHIRDSNKELYKPDLIF VKDARALVVDVTVRYEAAKSSLEEAAAEKVRKYKHLETEVRHLTNAKDV TFVGFPLGARGKWHQDNFKLLTELGLSKSRQVKMAETFSTVALFSSVDI VHMFASRARKSMVM | 1646 |
| R2Tg with natural linker deletion c-mybA location-v2 replaced with 3GS linker (SEQ ID NO: 1024) | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLLSRK PAEEPREEPGTCHHTRRAAGGGSTATRDKKDTVTREKHPKKPFQKWMKD RAIKKGNYLRFQRLFYLDRGKLAKIILDDIECLSCDIPLSEIYSVFKTR WETTGSFKSLGDFKTYGKADNTAFRELITAKEIEKNVQEMSKGSAPGPD GITLGDVVKMDPEFSRTMEIFNLWLTTGKIPDMVRGCRTVLIPKSSKPD RLKDINNWRPITIGSILLRLFSRIVTARLSKACPLNPRQRGFIRAAGCS ENLKLLQTIIWSAKREHRPLGVVFVDIAKAFDTVSHQHIIHALQQREVD PHIVGLVSNMYENISTYITTKRNTHTDKIQIRVGVKQGDPMSPLLFNLA MDPLLCKLEESGKGYHRGQSSITAMAFADDLVLLSDSWENMNTNISILE TFCNLTGLKTQGQKCHGFYIKPTKDSYTINDCAAWTINGTPLNMIDPGE SEKYLGLQFDPWIGIARSGLSTKLDFWLQRIDQAPLKPLQKTDILKTYT IPRLIYIADHSEVKTALLETLDQKIRTAVKEWLHLPPCTCDAILYSSTR DGGLGITKLAGLIPSVQARRLHRIAQSSDDTMKCFMEKEKMEQLHKKLW IQAGGDRENIPSIWEAPPSSEPPNNVSTNSEWEAPTQKDKFPKPCNWRK NEFKKWTKLASQGRGIVNFERDKISNHWIQYYRRIPHRKLLTALQLRAN VYPTREFLARGRQDQYIKACRHCDADIESCAHIIGNCPVTQDARIKRHN YICELLLEEAKKKDWVVFKEPHIRDSNKELYKPDLIFVKDARALVVDVT VRYEAAKSSLEEAAAEKVRKYKHLETEVRHLTNAKDVTFVGFPLGARGK WHQDNFKLLTELGLSKSRQVKMAETFSTVALFSSVDIVHMFASRARKSM VM | 1647 |
| R2Tg with natural linker deletion c-mybA location-v1 replaced with XTEN linker | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLLSRK PAEEPREEPGTCHHTRRAASGSETPGTSESATPESCFGCLESISQIRTA | 1648 |

| R2Tg Mutant | Amino Acid Sequence | SEQ ID NO: |
|---|---|---|
| | TRDKKDTVTREKHPKKPFQKWMKDRAIKKGNYLRFQRLFYLDRGKLAKI ILDDIECLSCDIPLSEIYSVFKTRWETTGSFKSLGDFKTYGKADNTAFR ELITAKEIEKNVQEMSKGSAPGPDGITLGDVVKMDPEFSRTMEIFNLWL TTGKIPDMVRGCRTVLIPKSSKPDRLKDINNWRPITIGSILLRLFSRIV TARLSKACPLNPRQRGFIRAAGCSENLKLLQTIIWSAKREHRPLGVVFV DIAKAFDTVSHQHIIHALQQREVDPHIVGLVSNMYENISTYITTKRNTH TDKIQIRVGVKQGDPMSPLLFNLAMDPLLCKLEESGKGYHRGQSSITAM AFADDLVLLSDSWENMNTNISILETFCNLTGLKTQGQKCHGFYIKPTKD SYTINDCAAWTINGTPLNMIDPGESEKYLGLQFDPWIGIARSGLSTKLD FWLQRIDQAPLKPLQKTDILKTYTIPRLIYIADHSEVKTALLETLDQKI RTAVKEWLHLPPCTCDAILYSSTRDGGLGITKLAGLIPSVQARRLHRIA QSSDDTMKCFMEKEKMEQLHKKLWIQAGGDRENIPSIWEAPPSSEPPNN VSTNSEWEAPTQKDKFPKPCNWRKNEFKKWTKLASQGRGIVNFERDKIS NHWIQYYRRIPHRKLLTALQLRANVYPTREFLARGRQDQYIKACRHCDA DIESCAHIIGNCPVTQDARIKRHNYICELLLEEAKKKDWVVFKEPHIRD SNKELYKPDLIFVKDARALVVDVTVRYEAAKSSLEEAAAEKVRKYKHLE TEVRHLTNAKDVTFVGFPLGARGKWHQDNFKLLTELGLSKSRQVKMAET FSTVALFSSVDIVHMFASRARKSMVM | |
| R2Tg with natural linker deletion c-mybA location-v2 replaced with XTEN linker | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLLSRK PAEEPREEPGTCHHTRRAA*SGSETPGTSESATPES*TATRDKKDTVTREK HPKKPFQKWMKDRAIKKGNYLRFQRLFYLDRGKLAKIILDDIECLSCDI PLSEIYSVFKTRWETTGSFKSLGDFKTYGKADNTAFRELITAKEIEKNV QEMSKGSAPGPDGITLGDVVKMDPEFSRTMEIFNLWLTTGKIPDMVRGC RTVLIPKSSKPDRLKDINNWRPITIGSILLRLFSRIVTARLSKACPLNP RQRGFIRAAGCSENLKLLQTIIWSAKREHRPLGVVFVDIAKAFDTVSHQ HIIHALQQREVDPHIVGLVSNMYENISTYITTKRNTHTDKIQIRVGVKQ GDPMSPLLFNLAMDPLLCKLEESGKGYHRGQSSITAMAFADDLVLLSDS WENMNTNISILETFCNLTGLKTQGQKCHGFYIKPTKDSYTINDCAAWTI NGTPLNMIDPGESEKYLGLQFDPWIGIARSGLSTKLDFWLQRIDQAPLK PLQKTDILKTYTIPRLIYIADHSEVKTALLETLDQKIRTAVKEWLHLPP CTCDAILYSSTRDGGLGITKLAGLIPSVQARRLHRIAQSSDDTMKCFME KEKMEQLHKKLWIQAGGDRENIPSIWEAPPSSEPPNNVSTNSEWEAPTQ KDKFPKPCNWRKNEFKKWTKLASQGRGIVNFERDKISNHWIQYYRRIPH RKLLTALQLRANVYPTREFLARGRQDQYIKACRHCDADIESCAHIIGNC PVTQDARIKRHNYICELLLEEAKKKDWVVFKEPHIRDSNKELYKPDLIF VKDARALVVDVTVRYEAAKSSLEEAAAEKVRKYKHLETEVRHLTNAKDV TFVGFPLGARGKWHQDNFKLLTELGLSKSRQVKMAETFSTVALFSSVDI VHMFASRARKSMVM | 1649 |
| R2Tg with natural linker deletion c-mybB location-v1 replaced with 3GS linker (SEQ ID NO: 1024) | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLGGGS CFGCLESISQIRTATRDKKDTVTREKHPKKPFQKWMKDRAIKKGNYLRF QRLFYLDRGKLAKIILDDIECLSCDIPLSEIYSVFKTRWETTGSFKSLG DFKTYGKADNTAFRELITAKEIEKNVQEMSKGSAPGPDGITLGDVVKMD PEFSRTMEIFNLWLTTGKIPDMVRGCRTVLIPKSSKPDRLKDINNWRPI TIGSILLRLFSRIVTARLSKACPLNPRQRGFIRAAGCSENLKLLQTIIW SAKREHRPLGVVFVDIAKAFDTVSHQHIIHALQQREVDPHIVGLVSNMY ENISTYITTKRNTHTDKIQIRVGVKQGDPMSPLLFNLAMDPLLCKLEES GKGYHRGQSSITAMAFADDLVLLSDSWENMNTNISILETFCNLTGLKTQ GQKCHGFYIKPTKDSYTINDCAAWTINGTPLNMIDPGESEKYLGLQFDP WIGIARSGLSTKLDFWLQRIDQAPLKPLQKTDILKTYTIPRLIYIADHS EVKTALLETLDQKIRTAVKEWLHLPPCTCDAILYSSTRDGGLGITKLAG LIPSVQARRLHRIAQSSDDTMKCFMEKEKMEQLHKKLWIQAGGDRENIP SIWEAPPSSEPPNNVSTNSEWEAPTQKDKFPKPCNWRKNEFKKWTKLAS QGRGIVNFERDKISNHWIQYYRRIPHRKLLTALQLRANVYPTREFLARG RQDQYIKACRHCDADIESCAHIIGNCPVTQDARIKRHNYICELLLEEAK KKDWVVFKEPHIRDSNKELYKPDLIFVKDARALVVDVTVRYEAAKSSLE EAAAEKVRKYKHLETEVRHLTNAKDVTFVGFPLGARGKWHQDNFKLLTE LGLSKSRQVKMAETFSTVALFSSVDIVHMFASRARKSMVM | 1650 |

| R2Tg Mutant | Amino Acid Sequence | SEQ ID NO: |
|---|---|---|
| R2Tg with natural linker deletion c-mybB location-v2 replaced with 3GS linker (SEQ ID NO: 1024) | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLGGGS TATRDKKDTVTREKHPKKPFQKWMKDRAIKKGNYLRFQRLFYLDRGKLA KIILDDIECLSCDIPLSEIYSVFKTRWETTGSFKSLGDFKTYGKADNTA FRELITAKEIEKNVQEMSKGSAPGPDGITLGDVVKMDPEFSRTMEIFNL WLTTGKIPDMVRGCRTVLIPKSSKPDRLKDINNWRPITIGSILLRLFSR IVTARLSKACPLNPRQRGFIRAAGCSENLKLLQTIIWSAKREHRPLGVV FVDIAKAFDTVSHQHIIHALQQREVDPHIVGLVSNMYENISTYITTKRN THTDKIQIRVGVKQGDPMSPLLFNLAMDPLLCKLEESGKGYHRGQSSIT AMAFADDLVLLSDSWENMNTNISILETFCNLTGLKTQGQKCHGFYIKPT KDSYTINDCAAWTINGTPLNMIDPGESEKYLGLQFDPWIGIARSGLSTK LDFWLQRIDQAPLKPLQKTDILKTYTIPRLIYIADHSEVKTALLETLDQ KIRTAVKEWLHLPPCTCDAILYSSTRDGGLGITKLAGLIPSVQARRLHR IAQSSDDTMKCFMEKEKMEQLHKKLWIQAGGDRENIPSIWEAPPSSEPP NNVSTNSEWEAPTQKDKFPKPCNWRKNEFKKWTKLASQGRGIVNFERDK ISNHWIQYYRRIPHRKLLTALQLRANVYPTREFLARGRQDQYIKACRHC DADIESCAHIIGNCPVTQDARIKRHNYICELLLEEAKKKDWVVFKEPHI RDSNKELYKPDLIFVKDARALVVDVTVRYEAAKSSLEEAAAEKVRKYKH LETEVRHLTNAKDVTFVGFPLGARGKWHQDNFKLLTELGLSKSRQVKMA ETFSTVALFSSVDIVHMFASRARKSMVM | 1651 |
| R2Tg with natural linker deletion c-mybB location-v1 replaced with XTEN linker | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLSGSE TPGTSESATPESCFGCLESISQIRTATRDKKDTVTREKHPKKPFQKWMK DRAIKKGNYLRFQRLFYLDRGKLAKIILDDIECLSCDIPLSEIYSVFKT RWETTGSFKSLGDFKTYGKADNTAFRELITAKEIEKNVQEMSKGSAPGP DGITLGDVVKMDPEFSRTMEIFNLWLTTGKIPDMVRGCRTVLIPKSSKP DRLKDINNWRPITIGSILLRLFSRIVTARLSKACPLNPRQRGFIRAAGC SENLKLLQTIIWSAKREHRPLGVVFVDIAKAFDTVSHQHIIHALQQREV DPHIVGLVSNMYENISTYITTKRNTHTDKIQIRVGVKQGDPMSPLLFNL AMDPLLCKLEESGKGYHRGQSSITAMAFADDLVLLSDSWENMNTNISIL ETFCNLTGLKTQGQKCHGFYIKPTKDSYTINDCAAWTINGTPLNMIDPG ESEKYLGLQFDPWIGIARSGLSTKLDFWLQRIDQAPLKPLQKTDILKTY TIPRLIYIADHSEVKTALLETLDQKIRTAVKEWLHLPPCTCDAILYSST RDGGLGITKLAGLIPSVQARRLHRIAQSSDDTMKCFMEKEKMEQLHKKL WIQAGGDRENIPSIWEAPPSSEPPNNVSTNSEWEAPTQKDKFPKPCNWR KNEFKKWTKLASQGRGIVNFERDKISNHWIQYYRRIPHRKLLTALQLRA NVYPTREFLARGRQDQYIKACRHCDADIESCAHIIGNCPVTQDARIKRH NYICELLLEEAKKKDWVVFKEPHIRDSNKELYKPDLIFVKDARALVVDV TVRYEAAKSSLEEAAAEKVRKYKHLETEVRHLTNAKDVTFVGFPLGARG KWHQDNFKLLTELGLSKSRQVKMAETFSTVALFSSVDIVHMFASRARKS MVM | 1652 |
| R2Tg with natural linker deletion c-mybB location-v2 replaced with XTEN linker | MASCPKPGPPVSAGAMSLESGLTTHSVLAIERGPNSLANSGSDFGGGGL GLPLRLLRVSVGTQTSRSDWVDLVSWSHPGPTSKSQQVDLVSLFPKHRV DLLSKNDQVDLVAQFLPSKFPPNLAENDLALLVNLEFYRSDLHVYECVH FAAHWEGLSGLPEVYEQLAPQPCVGETLHSSLPRDSELFVPEEGSSEKE SEDAPKTSPPTPGKHGLEQTGEEKVMVTVPDKNPPCPCCGTRVNSVLNL IEHLKVSHGKRGVCFRCAKCGKENSNYHSVVCHFPKCRGPETEKAPAGE WICEVCNRDFTTKIGLGQHKRLAHPAVRNQERIVASQPKETSNRGAHKR CWTKEEEELLIRLEAQFEGNKNINKLIAEHITTKTAKQISDKRRLSGSE TPGTSESATPESTATRDKKDTVTREKHPKKPFQKWMKDRAIKKGNYLRF QRLFYLDRGKLAKIILDDIECLSCDIPLSEIYSVFKTRWETTGSFKSLG DFKTYGKADNTAFRELITAKEIEKNVQEMSKGSAPGPDGITLGDVVKMD PEFSRTMEIFNLWLTTGKIPDMVRGCRTVLIPKSSKPDRLKDINNWRPI TIGSILLRLFSRIVTARLSKACPLNPRQRGFIRAAGCSENLKLLQTIIW SAKREHRPLGVVFVDIAKAFDTVSHQHIIHALQQREVDPHIVGLVSNMY ENISTYITTKRNTHTDKIQIRVGVKQGDPMSPLLFNLAMDPLLCKLEES GKGYHRGQSSITAMAFADDLVLLSDSWENMNTNISILETFCNLTGLKTQ GQKCHGFYIKPTKDSYTINDCAAWTINGTPLNMIDPGESEKYLGLQFDP WIGIARSGLSTKLDFWLQRIDQAPLKPLQKTDILKTYTIPRLIYIADHS EVKTALLETLDQKIRTAVKEWLHLPPCTCDAILYSSTRDGGLGITKLAG LIPSVQARRLHRIAQSSDDTMKCFMEKEKMEQLHKKLWIQAGGDRENIP | 1653 |

-continued

| R2Tg Mutant | Amino Acid Sequence | SEQ ID NO: |
|---|---|---|
| | SIWEAPPSSEPPNNVSTNSEWEAPTQKDKFPKPCNWRKNEFKKWTKLAS QGRGIVNFERDKISNHWIQYYRRIPHRKLLTALQLRANVYPTREFLARG RQDQYIKACRHCDADIESCAHIIGNCPVTQDARIKRHNYICELLLEEAK KKDWVVFKEPHIRDSNKELYKPDLIFVKDARALVVDVTVRYEAAKSSLE EAAAEKVRKYKHLETEVRHLTNAKDVTFVGFPLGARGKWHQDNFKLLTE LGLSKSRQVKMAETFSTVALFSSVDIVHMFASRARKSMVM | |

HEK293T cells were plated in 96-well plates and grown overnight at 37° C., 5% CO2. The HEK293T cells were transfected with plasmids that expressed R2Tg (wild-type), R2 endonuclease mutant, and natural linker mutants. The transfection was carried out using the Fugene HD transfection reagent according to the manufacturer recommendations, where each well received 80 ng of plasmid DNA and 0.5 µL of transfection reagent. All transfections were performed in duplicate and the cells were incubated for 72 h prior to genomic DNA extraction.

Figure 8B:
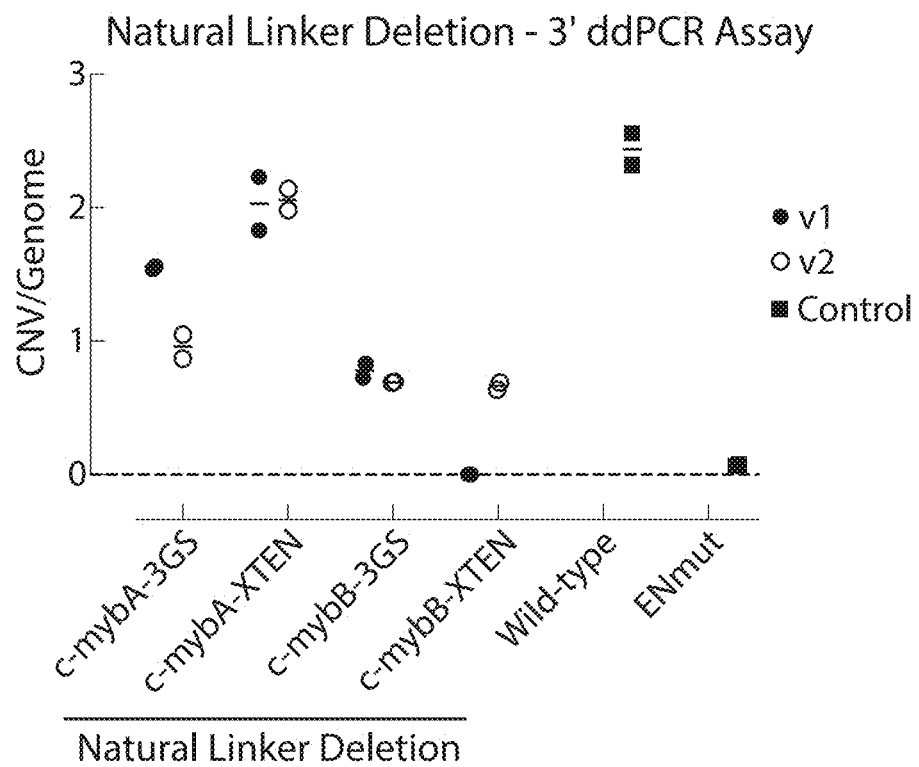

Activity of the mutants was measured by a ddPCR assay that quantified the copy number of R2Tg integrations by measuring the number of 3' junction amplicons (FIG. 8b).

Deletions that begin after the random coil following the c-myb DNA binding motif (location A, c-mybA) are well-tolerated with integration activity near that of wild-type R2Tg. The natural linker region deletion end point is nearly the same for either location v1 (N-terminal to the alpha helix preceding the −1 RNA binding motif) or v2 (C-terminal to the alpha helix preceding the −1 RNA binding motif). For the deletion beginning at location A and ending at location v1 or v2, replacement of this polypeptide stretch with the XTEN linker (SEQ ID NO: 1023) seems to retain the most amount of activity whereas replacement with the 3GS linker (SEQ ID NO: 1024) has approximately a 50% reduction in integration activity. For natural linker deletions that begin at location B (c-mybB), these configurations show a more marked reduction in integration activity when compared to wild-type or location A (c-mybA). The difference in activity may be related to the structure of the protein based on the position of the deletion that creates a non-optimal three dimensional structure of the retrotransposase through the location of the linker, length of the linker, or amino acid combination of the linker that is not optimal to connect location B to locations v1 or v2. Even though the N-terminal natural linker deletion start location mybB is a sub-optimal, the C-terminal end of the deletion was most tolerated at v2 with either the 3GS (SEQ ID NO: 1024) or XTEN linker and appears to be the preferential location for having a polypeptide preceding the RBD-1 region.

Example 8: Determination of Target Specificity of a GENE WRITER™ Endonuclease Domain This example describes using a custom genomic landing pad in human cells to determine whether there is a sequence requirement for target cleavage and subsequent integration by a GENE WRITER™ system.

Figure 9:
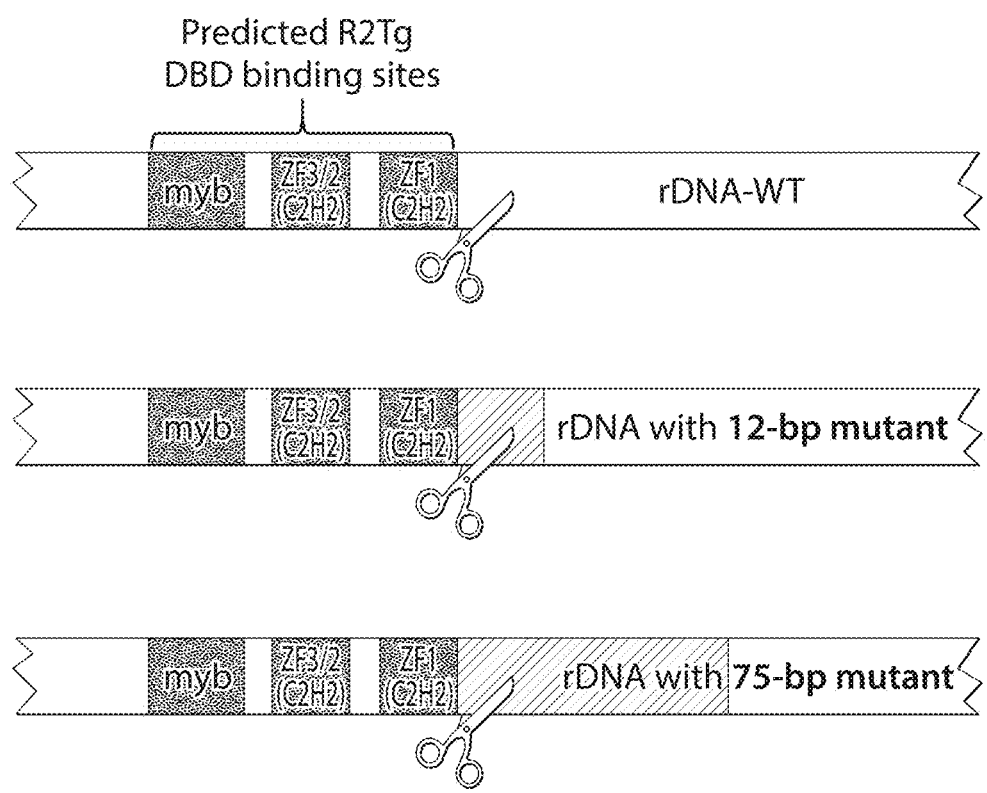
FIG. 9. Landing pads designed for testing target site mutations of R2Tg GENE WRITER™.

In this example, cell lines were created to have "landing pads" or stable integrations that mimic a region of rDNA that contain the R2 position to which R2 retrotransposases target for retrotransposition (see FIG. 9). The integrants or landing pads were designed to either have the wild-type region sequence in and around the R2 site found in rDNA, 12-bp of sequence mutation at and around the R2 cleavage site, or 75-bp of sequence mutation at and around the R2 cleavage site (Table 51). The DNA for these different landing pads was chemically synthesized and cloned into the pLenti-N-tGFP vector. The cloned landing pads into the lentiviral expression vector were confirmed and sequence verified by Sanger sequencing of the landing pad. The sequence verified plasmids (9 µg) along with the lentiviral packaging mix (9 µg, obtained from Biosettia) were transfected using LIPOFECTAMINE™ 2000 according the manufacturer instructions into a packaging cell line, LentiX-293T (Takara Bio). The transfected cells were incubated at 37° C., 10% $CO_2$ for 48 hours (including one medium change at 24 hrs) and the viral particle containing medium was collected from the cell culture dish. The collected medium was filtered through a 0.2 µm filter to remove cell debris and prepared for transduction of U2OS cells. The viral containing medium was diluted in DMEM and mixed with polybrene to prepare a dilution series for transduction of U2OS cells where the final concentration of polybrene was 8 µg/ml. The U2OS cells were grown in viral containing medium for 48 hour and then split with fresh medium. The split cells were grown to confluence and transduction efficiency of the different dilutions of virus were measured by GFP expression via flow cytometry and ddPCR detection of the genomic integrated lentivirus that contained GFP and the different rDNA landing pads (WT, 12-bp mutation, or 75-bp mutation). The GFP positive cell line from the 1:10 viral medium dilution (>99% GFP+) was chosen for subsequent experiments and cryopreserved.

To test if mutations in and around the R2 cleavage position can impact the GENE WRITER™ system activity, the R2Tg GENE WRITER™ Driver along with a plasmid that expressed a GENE WRITER™ transgene molecule were electroporated into the different landing pad cell lines. In order to test if the sequence in and around the cleavage site impacted the GENE WRITER™ polypeptide sequence activity to integrate, the homology arms for the GENE WRITER™ template molecule were designed to have 100% homology 100 bp to the left (GENE WRITER™ molecule module A) and 100 bp to the right (GENE WRITER™ molecule module F) of the cleavage position for each of the landing pads. The changes to the homology arms of the GENE WRITER™ template molecule expression plasmid were introduced by PCR and were confirmed by Sanger Sequencing. Either 73 ng of the WT R2Tg GENE WRITER™ Driver or the Endonuclease domain mutant R2Tg GENE WRITER™ Driver expression plasmids were co-nucleofected) using nucleofection program DN100 into each of the different U2OS landing pad cell lines (WT, 12-bp mutant, or 75-bp mutant) with 177 ng of plasmids that expressed the GENE WRITER™ template molecules that had 100% homology to either the WT landing pad, 12-bp mutant landing pad, or 75-bp mutant landing pad. After nucleofection, cells were grown at 37° C., 10% $CO_2$ for 3 days prior to cell lysis and genomic DNA extraction. The extracted gDNA was measured for GENE WRITER™ template molecule integration at the landing pad site by ddPCR. The DNA nicking activity was measured by detection of insertions, deletions, and/or a combination of both insertions and deletions at the landing pad through next-generation sequence analysis of an amplicon that was generated from the landing pad found in the gDNA.

Figure 10B:
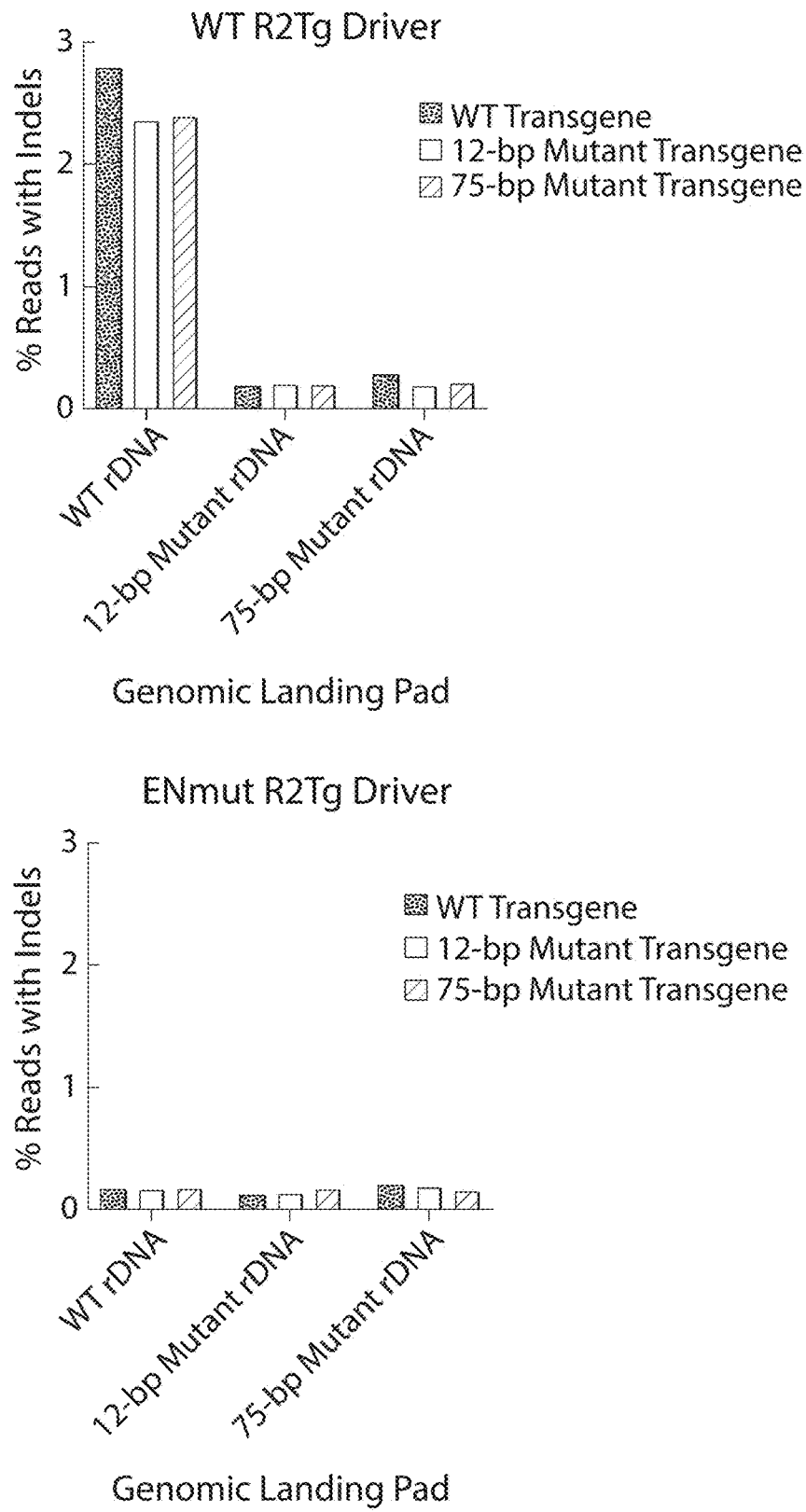
FIG. 10B. Amplicon-sequencing and NGS analysis of indels present at landing pads sites.

The integration activity of the R2Tg GENE WRITER™ is greatly reduced when the cleavage region is mutated where there is no integration of a GENE WRITER™ template molecule in either of the 12-bp or 75-bp landing pad cell lines (FIG. 10a). Furthermore, integration is not detected with GENE WRITER™ template molecules that have homology arms that correspond to either the 12-bp or 75-bp mutant landing pads. To rule out that the lost integration activity is due to incompatible homology arms, DNA nicking activity was measured by NGS analysis of the landing pad. The nicking activity is independent of the GENE WRITER™ template molecule as the WT R2Tg GENE WRITER™ driver had comparable indels at the WT landing pad with the WT, 12-bp mutant, or 75-bp mutant GENE WRITER™ template molecule (FIG. 10b). The 12-bp and 75-bp landing pads, regardless of GENE WRITER™ template molecule co-nucleofected with the WT R2Tg GENE WRITER™ did not show any reads above background that contained indels. The level of indels was similar to the GENE WRITER™ template driver containing endonuclease mutations.

In some embodiments, a GENE WRITER™ is derived from a retrotransposase with some level of target sequence specificity in the endonuclease domain. Thus, it may be desirable to retarget the GENE WRITER™ to a location in the genome that possesses homology to the natural target sequence recognized by an endonuclease domain, referred to as the endonuclease recognition motif (ERM). In some embodiments, this sub-target sequence may be contained in the region surrounding the nick site. In specific embodiments, a 13 nt sequence (TAAGGTAGCCAAA (SEQ ID NO: 1657)) based on the nick site of an R2 element, e.g., R2Tg, is used to search the human genome for suitable locations for retargeting the GENE WRITER™, wherein a heterologous DNA-binding domain is designed to localize the GENE WRITER™ to an endogenous ERM to direct endonuclease activity and subsequent retrotransposition of a template RNA. In some embodiments, the human genome site possesses 100% identity to at least 1, 2, 3, 4, 5, 6, 7, 8, 9, 10, 11, 12, or 13 nucleotides in the 13 nt motif. In further embodiments, the human genome site containing the ERM is selected from Table 52, and a DNA-binding domain fusion, e.g., ZF, TAL, or dCas9 with a custom gRNA, is designed to localize the polypeptide to the site (e.g., see Example 9). In preferred embodiments, the genome site possesses a safe harbor score of at least 5, 6, 7, 8 as defined in Pellenz et al Hum Gene Ther 30, 814-282 (2019) and shown in Table 52. In some embodiments, the template RNA (or DNA encoding the template RNA) is designed such that

TABLE 51

Exemplary Landing Pads

| Landing Pad Sequence Name | Sequence 5'-> 3' (rDNA, underline; cleavage region, bold; mutated sequence, bold-italic) |
|---|---|
| WT | GCTCACACAGGAAACAGCTATGACCATGATTACGCCAAGCTGTTGACG CGATGTGATTTCTGCCCAGTGCTCTGAATGTCAAAGTGAAGAAATTCA ATGAAGCGCGGGTAAACGGCGGGAGTAACTATGACTCTCTTAAGGTAG CCAAATGCCTCGTCATCTAATTAGTGACGCGCATGAATGGATGAACGA GATTCCCACTGTCCCTACCTACTATCCAGCGAAACCACAGCCAAGGGA AATTCACTGGCCGTCGTTTTACAACGTCGTGACTGGGAAAACCCTGGC GTTACCCAACTTAATCGCCTTGCAGCACATCC (SEQ ID NO: 1654) |
| 12-bp Mutant | GCTCACACAGGAAACAGCTATGACCATGATTACGCCAAGCTGTTGACG CGATGTGATTTCTGCCCAGTGCTCTGAATGTCAAAGTGAAGAAATTCA ATGAAGCGCGGGTAAACGGCGGGAGTAACTATGACTCTCTT*TCCAATA TGATT*TGCCTCGTCATCTAATTAGTGACGCGCATGAATGGATGAACGA GATTCCCACTGTCCCTACCTACTATCCAGCGAAACCACAGCCAAGGGA AATTCACTGGCCGTCGTTTTACAACGTCGTGACTGGGAAAACCCTGGC GTTACCCAACTTAATCGCCTTGCAGCACATCC (SEQ ID NO: 1655) |
| 75-bp Mutant | getcacacaggaaacagctatgaccatgattacgccaagctgttgacg cgatgtgatttctgcccagtgctctgaatgtcaaagtgaagaaattca atgaagcgcgggtaaacggcgggagtaactatgactctcttt*ccaata tgattccacccatggcaaattccatggcaccgtcaaggctgagaacgg gaagcttgtcatcaatggaa*actatccagcgaaaccacagccaaggga aattcactggccgtcgttttacaacgtcgtgactgggaaaaccctggc gttacccaacttaatcgccttgcagcacatcc (SEQ ID NO: 1656) | the homology arms match the flanking genomic sequences surrounding the expected nick site at the new target.

Table 52: Human Genome Sites Matching a 13 nt Stretch Around the Nicking Site of R2 Elements.

The human genome was searched for 100% identity to the full 13 nt match or 12 consecutive nucleotides ("Match"). Chromosomal location and start and end coordinates are provided for each match. Score ("Score") is a metric evaluating each site for eight desirable safe harbor characteristics.

| Chromosome | Start | End | Source | Match | Score |
|---|---|---|---|---|---|
| chr06 | 123749082 | 123749094 | NC_000006.12 | 13 | 8 |
| chr02 | 5035294 | 5035305 | NC_000002.12 | 12 | 8 |
| chr02 | 145760352 | 145760341 | NC_000002.12 | 12 | 8 |
| chr02 | 147034635 | 147034624 | NC_000002.12 | 12 | 8 |
| chr02 | 181792104 | 181792115 | NC_000002.12 | 12 | 8 |
| chr03 | 34017171 | 34017182 | NC_000003.12 | 12 | 8 |
| chr03 | 74784684 | 74784695 | NC_000003.12 | 12 | 8 |
| chr03 | 110093351 | 110093362 | NC_000003.12 | 12 | 8 |
| chr06 | 14459104 | 14459093 | NC_000006.12 | 12 | 8 |
| chr06 | 119620936 | 119620947 | NC_000006.12 | 12 | 8 |
| chr06 | 145123473 | 145123462 | NC_000006.12 | 12 | 8 |
| chr07 | 12024654 | 12024665 | NC_000007.14 | 12 | 8 |
| chr07 | 52001436 | 52001447 | NC_000007.14 | 12 | 8 |
| chr07 | 115339421 | 115339410 | NC_000007.14 | 12 | 8 |
| chr08 | 126384299 | 126384310 | NC_000008.11 | 12 | 8 |
| chr12 | 84083562 | 84083573 | NC_000012.12 | 12 | 8 |
| chrX | 117646432 | 117646421 | NC_000023.11 | 12 | 8 |
| chr02 | 106547509 | 106547521 | NC_000002.12 | 13 | 7 |
| chr02 | 226038592 | 226038604 | NC_000002.12 | 13 | 7 |
| chr03 | 102522532 | 102522520 | NC_000003.12 | 13 | 7 |
| chr03 | 110933592 | 110933604 | NC_000003.12 | 13 | 7 |
| chr03 | 119752575 | 119752563 | NC_000003.12 | 13 | 7 |
| chr03 | 172868603 | 172868615 | NC_000003.12 | 13 | 7 |
| chr03 | 191985222 | 191985210 | NC_000003.12 | 13 | 7 |
| chr05 | 6213503 | 6213515 | NC_000005.10 | 13 | 7 |
| chr05 | 58295578 | 58295566 | NC_000005.10 | 13 | 7 |
| chr05 | 129844500 | 129844512 | NC_000005.10 | 13 | 7 |
| chr06 | 1454372 | 1454360 | NC_000006.12 | 13 | 7 |
| chr06 | 48973921 | 48973909 | NC_000006.12 | 13 | 7 |
| chr08 | 18663054 | 18663066 | NC_000008.11 | 13 | 7 |
| chr08 | 93499020 | 93499032 | NC_000008.11 | 13 | 7 |
| chr08 | 119753973 | 119753985 | NC_000008.11 | 13 | 7 |
| chr09 | 86856907 | 86856919 | NC_000009.12 | 13 | 7 |
| chr12 | 29955571 | 29955583 | NC_000012.12 | 13 | 7 |
| chr12 | 118529104 | 118529092 | NC_000012.12 | 13 | 7 |
| chr13 | 65656029 | 65656041 | NC_000013.11 | 13 | 7 |
| chr22 | 34266611 | 34266623 | NC_000022.11 | 13 | 7 |
| chrX | 26651640 | 26651628 | NC_000023.11 | 13 | 7 |
| chrX | 119194351 | 119194363 | NC_000023.11 | 13 | 7 |
| chrX | 139180620 | 139180608 | NC_000023.11 | 13 | 7 |
| chr01 | 106465846 | 106465857 | NC_000001.11 | 12 | 7 |
| chr02 | 964160 | 964171 | NC_000002.12 | 12 | 7 |
| chr02 | 40018947 | 40018936 | NC_000002.12 | 12 | 7 |
| chr02 | 62845403 | 62845392 | NC_000002.12 | 12 | 7 |
| chr02 | 64834920 | 64834909 | NC_000002.12 | 12 | 7 |
| chr02 | 67969609 | 67969619 | NC_000002.12 | 12 | 7 |
| chr02 | 76183118 | 76183129 | NC_000002.12 | 12 | 7 |
| chr02 | 81819286 | 81819297 | NC_000002.12 | 12 | 7 |
| chr02 | 119597238 | 119597249 | NC_000002.12 | 12 | 7 |
| chr02 | 122897376 | 122897365 | NC_000002.12 | 12 | 7 |
| chr02 | 123603423 | 123603412 | NC_000002.12 | 12 | 7 |
| chr02 | 144644206 | 144644217 | NC_000002.12 | 12 | 7 |
| chr02 | 145221757 | 145221746 | NC_000002.12 | 12 | 7 |
| chr02 | 158367531 | 158367520 | NC_000002.12 | 12 | 7 |
| chr02 | 160092083 | 160092072 | NC_000002.12 | 12 | 7 |
| chr02 | 192245037 | 192245048 | NC_000002.12 | 12 | 7 |
| chr02 | 195223552 | 195223563 | NC_000002.12 | 12 | 7 |
| chr02 | 200351999 | 200351988 | NC_000002.12 | 12 | 7 |
| chr02 | 237068525 | 237068514 | NC_000002.12 | 12 | 7 |
| chr03 | 18724351 | 18724340 | NC_000003.12 | 12 | 7 |
| chr03 | 23969399 | 23969388 | NC_000003.12 | 12 | 7 |
| chr03 | 25177339 | 25177350 | NC_000003.12 | 12 | 7 |
| chr03 | 34880863 | 34880852 | NC_000003.12 | 12 | 7 |
| chr03 | 66233879 | 66233890 | NC_000003.12 | 12 | 7 |
| chr03 | 74527939 | 74527950 | NC_000003.12 | 12 | 7 |
| chr03 | 98583025 | 98583014 | NC_000003.12 | 12 | 7 |
| chr03 | 99278452 | 99278463 | NC_000003.12 | 12 | 7 |
| chr03 | 116060228 | 116060239 | NC_000003.12 | 12 | 7 |
| chr03 | 139468578 | 139468589 | NC_000003.12 | 12 | 7 |
| chr03 | 140064054 | 140064043 | NC_000003.12 | 12 | 7 |
| chr03 | 140438138 | 140438127 | NC_000003.12 | 12 | 7 |
| chr03 | 152457330 | 152457341 | NC_000003.12 | 12 | 7 |
| chr03 | 160950736 | 160950725 | NC_000003.12 | 12 | 7 |
| chr03 | 167207758 | 167207769 | NC_000003.12 | 12 | 7 |
| chr03 | 167722472 | 167722483 | NC_000003.12 | 12 | 7 |
| chr03 | 180475661 | 180475672 | NC_000003.12 | 12 | 7 |
| chr04 | 121590786 | 121590775 | NC_000004.12 | 12 | 7 |
| chr04 | 133719599 | 133719588 | NC_000004.12 | 12 | 7 |
| chr05 | 11564132 | 11564121 | NC_000005.10 | 12 | 7 |
| chr05 | 11970221 | 11970210 | NC_000005.10 | 12 | 7 |
| chr05 | 32814431 | 32814420 | NC_000005.10 | 12 | 7 |
| chr05 | 38003029 | 38003018 | NC_000005.10 | 12 | 7 |
| chr05 | 39758118 | 39758129 | NC_000005.10 | 12 | 7 |
| chr05 | 41221615 | 41221604 | NC_000005.10 | 12 | 7 |
| chr05 | 74838717 | 74838728 | NC_000005.10 | 12 | 7 |
| chr05 | 86444529 | 86444518 | NC_000005.10 | 12 | 7 |
| chr05 | 86617117 | 86617106 | NC_000005.10 | 12 | 7 |
| chr05 | 89438360 | 89438349 | NC_000005.10 | 12 | 7 |
| chr05 | 108102395 | 108102406 | NC_000005.10 | 12 | 7 |
| chr05 | 110231750 | 110231761 | NC_000005.10 | 12 | 7 |
| chr05 | 113996496 | 113996485 | NC_000005.10 | 12 | 7 |
| chr05 | 117233050 | 117233039 | NC_000005.10 | 12 | 7 |
| chr05 | 121622921 | 121622932 | NC_000005.10 | 12 | 7 |
| chr05 | 122520704 | 122520693 | NC_000005.10 | 12 | 7 |
| chr05 | 142330490 | 142330479 | NC_000005.10 | 12 | 7 |
| chr05 | 156359105 | 156359094 | NC_000005.10 | 12 | 7 |
| chr06 | 19187842 | 19187831 | NC_000006.12 | 12 | 7 |
| chr06 | 41103469 | 41103458 | NC_000006.12 | 12 | 7 |
| chr06 | 49856872 | 49856883 | NC_000006.12 | 12 | 7 |
| chr06 | 54896309 | 54896298 | NC_000006.12 | 12 | 7 |
| chr06 | 64416107 | 64416096 | NC_000006.12 | 12 | 7 |
| chr06 | 104438997 | 104439008 | NC_000006.12 | 12 | 7 |
| chr06 | 109349688 | 109349677 | NC_000006.12 | 12 | 7 |
| chr06 | 110631149 | 110631160 | NC_000006.12 | 12 | 7 |
| chr06 | 114751383 | 114751372 | NC_000006.12 | 12 | 7 |
| chr06 | 116514339 | 116514350 | NC_000006.12 | 12 | 7 |
| chr06 | 121606126 | 121606137 | NC_000006.12 | 12 | 7 |
| chr06 | 126139788 | 126139777 | NC_000006.12 | 12 | 7 |
| chr06 | 130852449 | 130852460 | NC_000006.12 | 12 | 7 |
| chr06 | 136843057 | 136843068 | NC_000006.12 | 12 | 7 |
| chr06 | 155559692 | 155559681 | NC_000006.12 | 12 | 7 |
| chr06 | 158099232 | 158099221 | NC_000006.12 | 12 | 7 |
| chr07 | 24339208 | 24339219 | NC_000007.14 | 12 | 7 |
| chr07 | 39519736 | 39519725 | NC_000007.14 | 12 | 7 |
| chr07 | 72228733 | 72228722 | NC_000007.14 | 12 | 7 |
| chr07 | 82955239 | 82955228 | NC_000007.14 | 12 | 7 |
| chr07 | 104990180 | 104990191 | NC_000007.14 | 12 | 7 |
| chr07 | 107698186 | 107698197 | NC_000007.14 | 12 | 7 |
| chr07 | 111002449 | 111002438 | NC_000007.14 | 12 | 7 |
| chr07 | 115191852 | 115191841 | NC_000007.14 | 12 | 7 |
| chr07 | 115572755 | 115572766 | NC_000007.14 | 12 | 7 |
| chr08 | 21126162 | 21126151 | NC_000008.11 | 12 | 7 |
| chr08 | 25928055 | 25928066 | NC_000008.11 | 12 | 7 |
| chr08 | 45036535 | 45036524 | NC_000008.11 | 12 | 7 |
| chr08 | 45248484 | 45248473 | NC_000008.11 | 12 | 7 |
| chr08 | 45502096 | 45502085 | NC_000008.11 | 12 | 7 |
| chr08 | 45763984 | 45763973 | NC_000008.11 | 12 | 7 |
| chr08 | 53335054 | 53335043 | NC_000008.11 | 12 | 7 |
| chr08 | 55581238 | 55581227 | NC_000008.11 | 12 | 7 |
| chr08 | 63169546 | 63169557 | NC_000008.11 | 12 | 7 |
| chr08 | 66553887 | 66553898 | NC_000008.11 | 12 | 7 |
| chr08 | 86283378 | 86283367 | NC_000008.11 | 12 | 7 |
| chr08 | 113060704 | 113060715 | NC_000008.11 | 12 | 7 |
| chr08 | 114537195 | 114537206 | NC_000008.11 | 12 | 7 |
| chr08 | 114886082 | 114886071 | NC_000008.11 | 12 | 7 |
| chr08 | 127206415 | 127206426 | NC_000008.11 | 12 | 7 |
| chr08 | 133590421 | 133590410 | NC_000008.11 | 12 | 7 |
| chr08 | 135425161 | 135425150 | NC_000008.11 | 12 | 7 |
| chr10 | 7034863 | 7034852 | NC_000010.11 | 12 | 7 |
| chr10 | 124304797 | 124304786 | NC_000010.11 | 12 | 7 |
| chr10 | 131502495 | 131502506 | NC_000010.11 | 12 | 7 |
| chr11 | 5557203 | 5557192 | NC_000011.10 | 12 | 7 |
| chr11 | 31242576 | 31242565 | NC_000011.10 | 12 | 7 |
| chr11 | 31419537 | 31419526 | NC_000011.10 | 12 | 7 |

| Chromosome | Start | End | Source | Match | Score |
|---|---|---|---|---|---|
| chr11 | 33169689 | 33169678 | NC_000011.10 | 12 | 7 |
| chr11 | 55948947 | 55948958 | NC_000011.10 | 12 | 7 |
| chr11 | 85654901 | 85654890 | NC_000011.10 | 12 | 7 |
| chr11 | 92588724 | 92588735 | NC_000011.10 | 12 | 7 |
| chr11 | 105227927 | 105227938 | NC_000011.10 | 12 | 7 |
| chr11 | 106302916 | 106302927 | NC_000011.10 | 12 | 7 |
| chr11 | 110594096 | 110594085 | NC_000011.10 | 12 | 7 |
| chr11 | 125228337 | 125228326 | NC_000011.10 | 12 | 7 |
| chr12 | 8769205 | 8769194 | NC_000012.12 | 12 | 7 |
| chr12 | 30438984 | 30438973 | NC_000012.12 | 12 | 7 |
| chr12 | 33556205 | 33556216 | NC_000012.12 | 12 | 7 |
| chr12 | 39419629 | 39419640 | NC_000012.12 | 12 | 7 |
| chr12 | 88509246 | 88509257 | NC_000012.12 | 12 | 7 |
| chr12 | 92878719 | 92878708 | NC_000012.12 | 12 | 7 |
| chr12 | 107034133 | 107034144 | NC_000012.12 | 12 | 7 |
| chr12 | 109455187 | 109455176 | NC_000012.12 | 12 | 7 |
| chr13 | 88827671 | 88827660 | NC_000013.11 | 12 | 7 |
| chr14 | 48126959 | 48126948 | NC_000014.9 | 12 | 7 |
| chr20 | 851155 | 851166 | NC_000020.11 | 12 | 7 |
| chr22 | 17367227 | 17367238 | NC_000022.11 | 12 | 7 |
| chrX | 20420571 | 20420582 | NC_000023.11 | 12 | 7 |
| chrX | 22545830 | 22545819 | NC_000023.11 | 12 | 7 |
| chrX | 28899719 | 28899708 | NC_000023.11 | 12 | 7 |
| chrX | 33013952 | 33013963 | NC_000023.11 | 12 | 7 |
| chrX | 103880419 | 103880408 | NC_000023.11 | 12 | 7 |
| chrX | 105612448 | 105612459 | NC_000023.11 | 12 | 7 |
| chrX | 107929443 | 107929454 | NC_000023.11 | 12 | 7 |
| chrX | 112571297 | 112571286 | NC_000023.11 | 12 | 7 |
| chrX | 127584278 | 127584267 | NC_000023.11 | 12 | 7 |
| chrX | 130836800 | 130836811 | NC_000023.11 | 12 | 7 |
| chrX | 140554200 | 140554211 | NC_000023.11 | 12 | 7 |
| chrX | 146697583 | 146697572 | NC_000023.11 | 12 | 7 |
| chr01 | 97461481 | 97461469 | NC_000001.11 | 13 | 6 |
| chr01 | 104600535 | 104600547 | NC_000001.11 | 13 | 6 |
| chr02 | 12589473 | 12589461 | NC_000002.12 | 13 | 6 |
| chr02 | 187173643 | 187173631 | NC_000002.12 | 13 | 6 |
| chr03 | 29181713 | 29181701 | NC_000003.12 | 13 | 6 |
| chr04 | 32171549 | 32171537 | NC_000004.12 | 13 | 6 |
| chr04 | 116646904 | 116646916 | NC_000004.12 | 13 | 6 |
| chr04 | 164205821 | 164205833 | NC_000004.12 | 13 | 6 |
| chr04 | 170244792 | 170244780 | NC_000004.12 | 13 | 6 |
| chr05 | 15818439 | 15818451 | NC_000005.10 | 13 | 6 |
| chr05 | 174059501 | 174059489 | NC_000005.10 | 13 | 6 |
| chr06 | 94936128 | 94936140 | NC_000006.12 | 13 | 6 |
| chr06 | 98142018 | 98142006 | NC_000006.12 | 13 | 6 |
| chr06 | 151814731 | 151814719 | NC_000006.12 | 13 | 6 |
| chr07 | 14490189 | 14490201 | NC_000007.14 | 13 | 6 |
| chr07 | 53075165 | 53075153 | NC_000007.14 | 13 | 6 |
| chr07 | 87815318 | 87815306 | NC_000007.14 | 13 | 6 |
| chr07 | 103485572 | 103485584 | NC_000007.14 | 13 | 6 |
| chr08 | 35951572 | 35951560 | NC_000008.11 | 13 | 6 |
| chr08 | 39327231 | 39327219 | NC_000008.11 | 13 | 6 |
| chr08 | 69690270 | 69690258 | NC_000008.11 | 13 | 6 |
| chr08 | 117816166 | 117816154 | NC_000008.11 | 13 | 6 |
| chr08 | 123134654 | 123134666 | NC_000008.11 | 13 | 6 |
| chr09 | 68817454 | 68817466 | NC_000009.12 | 13 | 6 |
| chr09 | 68894040 | 68894028 | NC_000009.12 | 13 | 6 |
| chr09 | 80470190 | 80470178 | NC_000009.12 | 13 | 6 |
| chr10 | 1642234 | 1642222 | NC_000010.11 | 13 | 6 |
| chr10 | 73077072 | 73077060 | NC_000010.11 | 13 | 6 |
| chr10 | 110134589 | 110134601 | NC_000010.11 | 13 | 6 |
| chr11 | 9150979 | 9150991 | NC_000011.10 | 13 | 6 |
| chr11 | 9153635 | 9153623 | NC_000011.10 | 13 | 6 |
| chr11 | 13413693 | 13413705 | NC_000011.10 | 13 | 6 |
| chr11 | 41773900 | 41773912 | NC_000011.10 | 13 | 6 |
| chr11 | 77886545 | 77886557 | NC_000011.10 | 13 | 6 |
| chr11 | 79988166 | 79988154 | NC_000011.10 | 13 | 6 |
| chr11 | 108008162 | 108008150 | NC_000011.10 | 13 | 6 |
| chr12 | 30847723 | 30847735 | NC_000012.12 | 13 | 6 |
| chr12 | 86693014 | 86693026 | NC_000012.12 | 13 | 6 |
| chr12 | 122128926 | 122128914 | NC_000012.12 | 13 | 6 |
| chr13 | 29622714 | 29622726 | NC_000013.11 | 13 | 6 |
| chr14 | 39336522 | 39336510 | NC_000014.9 | 13 | 6 |
| chr15 | 94819443 | 94819431 | NC_000015.10 | 13 | 6 |
| chr17 | 10951262 | 10951250 | NC_000017.11 | 13 | 6 |
| chr19 | 30854506 | 30854518 | NC_000019.10 | 13 | 6 |
| chr20 | 42688485 | 42688473 | NC_000020.11 | 13 | 6 |
| chrX | 38138789 | 38138801 | NC_000023.11 | 13 | 6 |
| chrX | 86361231 | 86361243 | NC_000023.11 | 13 | 6 |
| chrX | 107051786 | 107051798 | NC_000023.11 | 13 | 6 |
| chrX | 109054235 | 109054247 | NC_000023.11 | 13 | 6 |
| chr01 | 32830533 | 32830522 | NC_000001.11 | 12 | 6 |
| chr01 | 56714138 | 56714127 | NC_000001.11 | 12 | 6 |
| chr01 | 79950536 | 79950547 | NC_000001.11 | 12 | 6 |
| chr01 | 81600862 | 81600851 | NC_000001.11 | 12 | 6 |
| chr01 | 88351333 | 88351344 | NC_000001.11 | 12 | 6 |
| chr01 | 100720346 | 100720335 | NC_000001.11 | 12 | 6 |
| chr01 | 103153587 | 103153598 | NC_000001.11 | 12 | 6 |
| chr01 | 163679268 | 163679279 | NC_000001.11 | 12 | 6 |
| chr01 | 178138239 | 178138228 | NC_000001.11 | 12 | 6 |
| chr01 | 202443386 | 202443375 | NC_000001.11 | 12 | 6 |
| chr01 | 214381798 | 214381787 | NC_000001.11 | 12 | 6 |
| chr01 | 239483920 | 239483909 | NC_000001.11 | 12 | 6 |
| chr02 | 5995932 | 5995921 | NC_000002.12 | 12 | 6 |
| chr02 | 14869774 | 14869785 | NC_000002.12 | 12 | 6 |
| chr02 | 37466261 | 37466250 | NC_000002.12 | 12 | 6 |
| chr02 | 38845623 | 38845634 | NC_000002.12 | 12 | 6 |
| chr02 | 38849877 | 38849866 | NC_000002.12 | 12 | 6 |
| chr02 | 52660534 | 52660523 | NC_000002.12 | 12 | 6 |
| chr02 | 55372861 | 55372872 | NC_000002.12 | 12 | 6 |
| chr02 | 62005199 | 62005210 | NC_000002.12 | 12 | 6 |
| chr02 | 70287567 | 70287556 | NC_000002.12 | 12 | 6 |
| chr02 | 79359701 | 79359712 | NC_000002.12 | 12 | 6 |
| chr02 | 84655638 | 84655627 | NC_000002.12 | 12 | 6 |
| chr02 | 126324776 | 126324787 | NC_000002.12 | 12 | 6 |
| chr02 | 149537132 | 149537143 | NC_000002.12 | 12 | 6 |
| chr02 | 169529510 | 169529521 | NC_000002.12 | 12 | 6 |
| chr02 | 175817135 | 175817124 | NC_000002.12 | 12 | 6 |
| chr02 | 180079693 | 180079682 | NC_000002.12 | 12 | 6 |
| chr02 | 206324011 | 206324000 | NC_000002.12 | 12 | 6 |
| chr02 | 206814054 | 206814043 | NC_000002.12 | 12 | 6 |
| chr02 | 224807794 | 224807805 | NC_000002.12 | 12 | 6 |
| chr02 | 229238864 | 229238853 | NC_000002.12 | 12 | 6 |
| chr02 | 236280053 | 236280064 | NC_000002.12 | 12 | 6 |
| chr03 | 154343 | 154354 | NC_000003.12 | 12 | 6 |
| chr03 | 8511973 | 8511984 | NC_000003.12 | 12 | 6 |
| chr03 | 16880365 | 16880376 | NC_000003.12 | 12 | 6 |
| chr03 | 18087857 | 18087846 | NC_000003.12 | 12 | 6 |
| chr03 | 47168148 | 47168137 | NC_000003.12 | 12 | 6 |
| chr03 | 47937628 | 47937617 | NC_000003.12 | 12 | 6 |
| chr03 | 48992978 | 48992989 | NC_000003.12 | 12 | 6 |
| chr03 | 82163078 | 82163067 | NC_000003.12 | 12 | 6 |
| chr03 | 103449909 | 103449898 | NC_000003.12 | 12 | 6 |
| chr03 | 120049593 | 120049604 | NC_000003.12 | 12 | 6 |
| chr03 | 143783076 | 143783065 | NC_000003.12 | 12 | 6 |
| chr03 | 149601763 | 149601752 | NC_000003.12 | 12 | 6 |
| chr03 | 167891194 | 167891183 | NC_000003.12 | 12 | 6 |
| chr03 | 181054638 | 181054627 | NC_000003.12 | 12 | 6 |
| chr03 | 191545181 | 191545170 | NC_000003.12 | 12 | 6 |
| chr03 | 197899144 | 197899155 | NC_000003.12 | 12 | 6 |
| chr04 | 668375 | 668364 | NC_000004.12 | 12 | 6 |
| chr04 | 19382020 | 19382031 | NC_000004.12 | 12 | 6 |
| chr04 | 19484541 | 19484552 | NC_000004.12 | 12 | 6 |
| chr04 | 26997338 | 26997349 | NC_000004.12 | 12 | 6 |
| chr04 | 55658608 | 55658619 | NC_000004.12 | 12 | 6 |
| chr04 | 70437852 | 70437841 | NC_000004.12 | 12 | 6 |
| chr04 | 79981798 | 79981809 | NC_000004.12 | 12 | 6 |
| chr04 | 94968197 | 94968208 | NC_000004.12 | 12 | 6 |
| chr04 | 102674459 | 102674470 | NC_000004.12 | 12 | 6 |
| chr04 | 124485434 | 124485445 | NC_000004.12 | 12 | 6 |
| chr04 | 126123159 | 126123148 | NC_000004.12 | 12 | 6 |
| chr04 | 137124764 | 137124753 | NC_000004.12 | 12 | 6 |
| chr04 | 160702860 | 160702849 | NC_000004.12 | 12 | 6 |
| chr04 | 167052375 | 167052386 | NC_000004.12 | 12 | 6 |
| chr04 | 179139043 | 179139032 | NC_000004.12 | 12 | 6 |
| chr04 | 179161408 | 179161397 | NC_000004.12 | 12 | 6 |
| chr04 | 187143772 | 187143761 | NC_000004.12 | 12 | 6 |
| chr05 | 10200709 | 10200720 | NC_000005.10 | 12 | 6 |
| chr05 | 33225853 | 33225842 | NC_000005.10 | 12 | 6 |
| chr05 | 76255175 | 76255186 | NC_000005.10 | 12 | 6 |
| chr05 | 82855245 | 82855256 | NC_000005.10 | 12 | 6 |
| chr05 | 84139572 | 84139561 | NC_000005.10 | 12 | 6 |
| chr05 | 88198462 | 88198473 | NC_000005.10 | 12 | 6 |
| chr05 | 102501084 | 102501073 | NC_000005.10 | 12 | 6 |

| Chromosome | Start | End | Source | Match | Score |
|---|---|---|---|---|---|
| chr05 | 109583817 | 109583806 | NC_000005.10 | 12 | 6 |
| chr05 | 128180682 | 128180671 | NC_000005.10 | 12 | 6 |
| chr05 | 136190403 | 136190392 | NC_000005.10 | 12 | 6 |
| chr05 | 154189555 | 154189566 | NC_000005.10 | 12 | 6 |
| chr05 | 171957271 | 171957282 | NC_000005.10 | 12 | 6 |
| chr05 | 175317578 | 175317567 | NC_000005.10 | 12 | 6 |
| chr06 | 4853151 | 4853162 | NC_000006.12 | 12 | 6 |
| chr06 | 16133021 | 16133032 | NC_000006.12 | 12 | 6 |
| chr06 | 26103447 | 26103436 | NC_000006.12 | 12 | 6 |
| chr06 | 35947570 | 35947581 | NC_000006.12 | 12 | 6 |
| chr06 | 68279419 | 68279430 | NC_000006.12 | 12 | 6 |
| chr06 | 79806546 | 79806557 | NC_000006.12 | 12 | 6 |
| chr06 | 85260407 | 85260418 | NC_000006.12 | 12 | 6 |
| chr06 | 136633874 | 136633885 | NC_000006.12 | 12 | 6 |
| chr06 | 137931054 | 137931043 | NC_000006.12 | 12 | 6 |
| chr06 | 139739984 | 139739973 | NC_000006.12 | 12 | 6 |
| chr06 | 140341418 | 140341429 | NC_000006.12 | 12 | 6 |
| chr06 | 145869806 | 145869795 | NC_000006.12 | 12 | 6 |
| chr06 | 146731539 | 146731528 | NC_000006.12 | 12 | 6 |
| chr06 | 168728425 | 168728436 | NC_000006.12 | 12 | 6 |
| chr07 | 51771646 | 51771635 | NC_000007.14 | 12 | 6 |
| chr07 | 137082304 | 137082315 | NC_000007.14 | 12 | 6 |
| chr07 | 141052267 | 141052278 | NC_000007.14 | 12 | 6 |
| chr08 | 17556548 | 17556537 | NC_000008.11 | 12 | 6 |
| chr08 | 30097319 | 30097308 | NC_000008.11 | 12 | 6 |
| chr08 | 68502659 | 68502670 | NC_000008.11 | 12 | 6 |
| chr08 | 86697209 | 86697198 | NC_000008.11 | 12 | 6 |
| chr08 | 91622182 | 91622171 | NC_000008.11 | 12 | 6 |
| chr08 | 92498179 | 92498168 | NC_000008.11 | 12 | 6 |
| chr08 | 124481608 | 124481597 | NC_000008.11 | 12 | 6 |
| chr08 | 129563081 | 129563092 | NC_000008.11 | 12 | 6 |
| chr08 | 131305462 | 131305451 | NC_000008.11 | 12 | 6 |
| chr09 | 14627274 | 14627285 | NC_000009.12 | 12 | 6 |
| chr09 | 15151836 | 15151847 | NC_000009.12 | 12 | 6 |
| chr09 | 22322306 | 22322295 | NC_000009.12 | 12 | 6 |
| chr09 | 23783142 | 23783153 | NC_000009.12 | 12 | 6 |
| chr09 | 26318093 | 26318104 | NC_000009.12 | 12 | 6 |
| chr09 | 31054959 | 31054970 | NC_000009.12 | 12 | 6 |
| chr09 | 79007585 | 79007596 | NC_000009.12 | 12 | 6 |
| chr09 | 88239264 | 88239253 | NC_000009.12 | 12 | 6 |
| chr09 | 96543680 | 96543669 | NC_000009.12 | 12 | 6 |
| chr09 | 99112802 | 99112813 | NC_000009.12 | 12 | 6 |
| chr09 | 123836553 | 123836564 | NC_000009.12 | 12 | 6 |
| chr10 | 33633573 | 33633562 | NC_000010.11 | 12 | 6 |
| chr10 | 65551995 | 65551984 | NC_000010.11 | 12 | 6 |
| chr10 | 66717930 | 66717941 | NC_000010.11 | 12 | 6 |
| chr10 | 74291798 | 74291787 | NC_000010.11 | 12 | 6 |
| chr10 | 82621770 | 82621781 | NC_000010.11 | 12 | 6 |
| chr10 | 91090519 | 91090530 | NC_000010.11 | 12 | 6 |
| chr10 | 99682921 | 99682910 | NC_000010.11 | 12 | 6 |
| chr10 | 107653284 | 107653273 | NC_000010.11 | 12 | 6 |
| chr10 | 127387876 | 127387887 | NC_000010.11 | 12 | 6 |
| chr11 | 10330410 | 10330421 | NC_000011.10 | 12 | 6 |
| chr11 | 21052051 | 21052062 | NC_000011.10 | 12 | 6 |
| chr11 | 56948810 | 56948799 | NC_000011.10 | 12 | 6 |
| chr11 | 91992913 | 91992902 | NC_000011.10 | 12 | 6 |
| chr11 | 96712150 | 96712139 | NC_000011.10 | 12 | 6 |
| chr11 | 99478699 | 99478710 | NC_000011.10 | 12 | 6 |
| chr11 | 103284503 | 103284514 | NC_000011.10 | 12 | 6 |
| chr11 | 110624774 | 110624763 | NC_000011.10 | 12 | 6 |
| chr11 | 118226686 | 118226697 | NC_000011.10 | 12 | 6 |
| chr11 | 121927186 | 121927175 | NC_000011.10 | 12 | 6 |
| chr11 | 127371998 | 127372009 | NC_000011.10 | 12 | 6 |
| chr12 | 21742376 | 21742387 | NC_000012.12 | 12 | 6 |
| chr12 | 33375091 | 33375102 | NC_000012.12 | 12 | 6 |
| chr12 | 79305333 | 79305322 | NC_000012.12 | 12 | 6 |
| chr12 | 87018030 | 87018041 | NC_000012.12 | 12 | 6 |
| chr12 | 97027085 | 97027074 | NC_000012.12 | 12 | 6 |
| chr12 | 97030674 | 97030685 | NC_000012.12 | 12 | 6 |
| chr12 | 97794786 | 97794775 | NC_000012.12 | 12 | 6 |
| chr12 | 99326345 | 99326345 | NC_000012.12 | 12 | 6 |
| chr12 | 100617295 | 100617284 | NC_000012.12 | 12 | 6 |
| chr12 | 106997614 | 106997603 | NC_000012.12 | 12 | 6 |
| chr12 | 114419769 | 114419758 | NC_000012.12 | 12 | 6 |
| chr13 | 29428703 | 29428714 | NC_000013.11 | 12 | 6 |
| chr13 | 34838980 | 34838991 | NC_000013.11 | 12 | 6 |
| chr13 | 68672648 | 68672637 | NC_000013.11 | 12 | 6 |
| chr13 | 68677576 | 68677565 | NC_000013.11 | 12 | 6 |
| chr13 | 79534292 | 79534303 | NC_000013.11 | 12 | 6 |
| chr13 | 83374368 | 83374357 | NC_000013.11 | 12 | 6 |
| chr13 | 91208120 | 91208131 | NC_000013.11 | 12 | 6 |
| chr13 | 92057240 | 92057251 | NC_000013.11 | 12 | 6 |
| chr13 | 105912154 | 105912165 | NC_000013.11 | 12 | 6 |
| chr14 | 37970959 | 37970948 | NC_000014.9 | 12 | 6 |
| chr14 | 40492006 | 40491995 | NC_000014.9 | 12 | 6 |
| chr14 | 44782915 | 44782926 | NC_000014.9 | 12 | 6 |
| chr14 | 48758306 | 48758317 | NC_000014.9 | 12 | 6 |
| chr14 | 88004548 | 88004537 | NC_000014.9 | 12 | 6 |
| chr15 | 56610753 | 56610764 | NC_000015.10 | 12 | 6 |
| chr15 | 70757589 | 70757578 | NC_000015.10 | 12 | 6 |
| chr15 | 96964230 | 96964219 | NC_000015.10 | 12 | 6 |
| chr16 | 66442829 | 66442818 | NC_000016.10 | 12 | 6 |
| chr16 | 74623964 | 74623975 | NC_000016.10 | 12 | 6 |
| chr16 | 75189302 | 75189291 | NC_000016.10 | 12 | 6 |
| chr17 | 9332911 | 9332900 | NC_000017.11 | 12 | 6 |
| chr18 | 32474384 | 32474373 | NC_000018.10 | 12 | 6 |
| chr18 | 34128952 | 34128963 | NC_000018.10 | 12 | 6 |
| chr18 | 55039826 | 55039815 | NC_000018.10 | 12 | 6 |
| chr18 | 78931519 | 78931508 | NC_000018.10 | 12 | 6 |
| chr19 | 31065225 | 31065236 | NC_000019.10 | 12 | 6 |
| chr19 | 32434028 | 32434017 | NC_000019.10 | 12 | 6 |
| chr19 | 51221292 | 51221303 | NC_000019.10 | 12 | 6 |
| chr20 | 1361969 | 1361958 | NC_000020.11 | 12 | 6 |
| chr20 | 4448895 | 4448906 | NC_000020.11 | 12 | 6 |
| chr20 | 13696489 | 13696478 | NC_000020.11 | 12 | 6 |
| chr20 | 20275384 | 20275395 | NC_000020.11 | 12 | 6 |
| chr20 | 26367536 | 26367525 | NC_000020.11 | 12 | 6 |
| chr21 | 37223237 | 37223248 | NC_000021.9 | 12 | 6 |
| chr21 | 46496495 | 46496484 | NC_000021.9 | 12 | 6 |
| chr22 | 39560335 | 39560346 | NC_000022.11 | 12 | 6 |
| chrX | 986645 | 986656 | NC_000023.11 | 12 | 6 |
| chrX | 5921242 | 5921253 | NC_000023.11 | 12 | 6 |
| chrX | 6765829 | 6765840 | NC_000023.11 | 12 | 6 |
| chrX | 15504137 | 15504126 | NC_000023.11 | 12 | 6 |
| chrX | 22546280 | 22546269 | NC_000023.11 | 12 | 6 |
| chrX | 41199361 | 41199372 | NC_000023.11 | 12 | 6 |
| chrX | 43885293 | 43885282 | NC_000023.11 | 12 | 6 |
| chrX | 67874307 | 67874296 | NC_000023.11 | 12 | 6 |
| chrX | 110216026 | 110216037 | NC_000023.11 | 12 | 6 |
| chrX | 110566890 | 110566879 | NC_000023.11 | 12 | 6 |
| chrX | 111357390 | 111357379 | NC_000023.11 | 12 | 6 |
| chrX | 150589443 | 150589454 | NC_000023.11 | 12 | 6 |
| chr01 | 23207589 | 23207577 | NC_000001.11 | 13 | 5 |
| chr01 | 25897408 | 25897420 | NC_000001.11 | 13 | 5 |
| chr01 | 65491478 | 65491490 | NC_000001.11 | 13 | 5 |
| chr01 | 154831168 | 154831180 | NC_000001.11 | 13 | 5 |
| chr02 | 35254361 | 35254349 | NC_000002.12 | 13 | 5 |
| chr02 | 207969171 | 207969159 | NC_000002.12 | 13 | 5 |
| chr03 | 185371630 | 185371642 | NC_000003.12 | 13 | 5 |
| chr04 | 46469891 | 46469879 | NC_000004.12 | 13 | 5 |
| chr04 | 105058847 | 105058835 | NC_000004.12 | 13 | 5 |
| chr04 | 124730032 | 124730044 | NC_000004.12 | 13 | 5 |
| chr04 | 158619352 | 158619364 | NC_000004.12 | 13 | 5 |
| chr06 | 85949972 | 85949960 | NC_000006.12 | 13 | 5 |
| chr06 | 109604972 | 109604960 | NC_000006.12 | 13 | 5 |
| chr10 | 59089285 | 59089273 | NC_000010.11 | 13 | 5 |
| chr10 | 99263586 | 99263598 | NC_000010.11 | 13 | 5 |
| chr11 | 96315922 | 96315934 | NC_000011.10 | 13 | 5 |
| chr15 | 33186727 | 33186715 | NC_000015.10 | 13 | 5 |
| chr15 | 87091718 | 87091706 | NC_000015.10 | 13 | 5 |
| chr16 | 16972153 | 16972165 | NC_000016.10 | 13 | 5 |
| chr16 | 59986446 | 59986458 | NC_000016.10 | 13 | 5 |
| chr18 | 12587445 | 12587457 | NC_000018.10 | 13 | 5 |
| chr18 | 78691060 | 78691048 | NC_000018.10 | 13 | 5 |
| chr19 | 39627504 | 39627492 | NC_000019.10 | 13 | 5 |
| chr19 | 54674561 | 54674573 | NC_000019.10 | 13 | 5 |
| chr20 | 30512867 | 30512855 | NC_000020.11 | 13 | 5 |
| chr20 | 45173430 | 45173442 | NC_000020.11 | 13 | 5 |
| chr21 | 35062647 | 35062659 | NC_000021.9 | 13 | 5 |
| chrX | 77412877 | 77412889 | NC_000023.11 | 13 | 5 |
| chrX | 130349739 | 130349727 | NC_000023.11 | 13 | 5 |
| chr01 | 8663054 | 8663065 | NC_000001.11 | 12 | 5 |
| chr01 | 26335998 | 26336009 | NC_000001.11 | 12 | 5 |
| chr01 | 42582606 | 42582595 | NC_000001.11 | 12 | 5 |

-continued

| Chromosome | Start | End | Source | Match | Score |
|---|---|---|---|---|---|
| chr01 | 47032830 | 47032819 | NC_000001.11 | 12 | 5 |
| chr01 | 69196253 | 69196264 | NC_000001.11 | 12 | 5 |
| chr01 | 70300023 | 70300034 | NC_000001.11 | 12 | 5 |
| chr01 | 82771042 | 82771053 | NC_000001.11 | 12 | 5 |
| chr01 | 100102957 | 100102946 | NC_000001.11 | 12 | 5 |
| chr01 | 107996202 | 107996213 | NC_000001.11 | 12 | 5 |
| chr01 | 162211653 | 162211642 | NC_000001.11 | 12 | 5 |
| chr01 | 208646365 | 208646354 | NC_000001.11 | 12 | 5 |
| chr01 | 215734460 | 215734449 | NC_000001.11 | 12 | 5 |
| chr01 | 234143991 | 234144002 | NC_000001.11 | 12 | 5 |
| chr01 | 241045297 | 241045286 | NC_000001.11 | 12 | 5 |
| chr02 | 140780861 | 140780872 | NC_000002.12 | 12 | 5 |
| chr02 | 149162575 | 149162586 | NC_000002.12 | 12 | 5 |
| chr02 | 162692841 | 162692852 | NC_000002.12 | 12 | 5 |
| chr02 | 222738270 | 222738259 | NC_000002.12 | 12 | 5 |
| chr03 | 67248099 | 67248110 | NC_000003.12 | 12 | 5 |
| chr03 | 174292637 | 174292648 | NC_000003.12 | 12 | 5 |
| chr04 | 12331297 | 12331308 | NC_000004.12 | 12 | 5 |
| chr04 | 21504937 | 21504948 | NC_000004.12 | 12 | 5 |
| chr04 | 43962965 | 43962976 | NC_000004.12 | 12 | 5 |
| chr04 | 57433948 | 57433937 | NC_000004.12 | 12 | 5 |
| chr04 | 85682861 | 85682872 | NC_000004.12 | 12 | 5 |
| chr04 | 106114290 | 106114301 | NC_000004.12 | 12 | 5 |
| chr04 | 113028283 | 113028294 | NC_000004.12 | 12 | 5 |
| chr04 | 151151805 | 151151794 | NC_000004.12 | 12 | 5 |
| chr04 | 152051162 | 152051173 | NC_000004.12 | 12 | 5 |
| chr04 | 179052931 | 179052920 | NC_000004.12 | 12 | 5 |
| chr05 | 6661409 | 6661420 | NC_000005.10 | 12 | 5 |
| chr05 | 93549147 | 93549158 | NC_000005.10 | 12 | 5 |
| chr05 | 148916732 | 148916721 | NC_000005.10 | 12 | 5 |
| chr05 | 153193520 | 153193531 | NC_000005.10 | 12 | 5 |
| chr05 | 169165696 | 169165685 | NC_000005.10 | 12 | 5 |
| chr06 | 99056822 | 99056833 | NC_000006.12 | 12 | 5 |
| chr07 | 21203640 | 21203651 | NC_000007.14 | 12 | 5 |
| chr07 | 27364344 | 27364355 | NC_000007.14 | 12 | 5 |
| chr07 | 45331667 | 45331656 | NC_000007.14 | 12 | 5 |
| chr08 | 28102047 | 28102036 | NC_000008.11 | 12 | 5 |
| chr08 | 64148089 | 64148078 | NC_000008.11 | 12 | 5 |
| chr08 | 121058238 | 121058249 | NC_000008.11 | 12 | 5 |
| chr08 | 134902692 | 134902681 | NC_000008.11 | 12 | 5 |
| chr09 | 26814924 | 26814935 | NC_000009.12 | 12 | 5 |
| chr09 | 35739632 | 35739643 | NC_000009.12 | 12 | 5 |
| chr09 | 77017601 | 77017612 | NC_000009.12 | 12 | 5 |
| chr09 | 83041777 | 83041788 | NC_000009.12 | 12 | 5 |
| chr09 | 87072669 | 87072658 | NC_000009.12 | 12 | 5 |
| chr09 | 134613617 | 134613628 | NC_000009.12 | 12 | 5 |
| chr10 | 7938397 | 7938408 | NC_000010.11 | 12 | 5 |
| chr10 | 59688277 | 59688266 | NC_000010.11 | 12 | 5 |
| chr10 | 91834373 | 91834384 | NC_000010.11 | 12 | 5 |
| chr10 | 106036664 | 106036653 | NC_000010.11 | 12 | 5 |
| chr11 | 1648239 | 1648228 | NC_000011.10 | 12 | 5 |
| chr11 | 28286474 | 28286485 | NC_000011.10 | 12 | 5 |
| chr11 | 59609982 | 59609993 | NC_000011.10 | 12 | 5 |
| chr11 | 82154773 | 82154784 | NC_000011.10 | 12 | 5 |
| chr12 | 56884436 | 56884425 | NC_000012.12 | 12 | 5 |
| chr12 | 65309897 | 65309908 | NC_000012.12 | 12 | 5 |
| chr12 | 70312802 | 70312791 | NC_000012.12 | 12 | 5 |
| chr12 | 108169798 | 108169809 | NC_000012.12 | 12 | 5 |
| chr13 | 41643771 | 41643782 | NC_000013.11 | 12 | 5 |
| chr13 | 43730188 | 43730177 | NC_000013.11 | 12 | 5 |
| chr13 | 66772070 | 66772081 | NC_000013.11 | 12 | 5 |
| chr13 | 67266239 | 67266250 | NC_000013.11 | 12 | 5 |
| chr13 | 70438394 | 70438405 | NC_000013.11 | 12 | 5 |
| chr13 | 72462904 | 72462915 | NC_000013.11 | 12 | 5 |
| chr13 | 73589220 | 73589209 | NC_000013.11 | 12 | 5 |
| chr13 | 114256981 | 114256970 | NC_000013.11 | 12 | 5 |
| chr14 | 53548116 | 53548105 | NC_000014.9 | 12 | 5 |
| chr14 | 91128016 | 91128005 | NC_000014.9 | 12 | 5 |
| chr15 | 55623598 | 55623609 | NC_000015.10 | 12 | 5 |
| chr15 | 59650410 | 59650421 | NC_000015.10 | 12 | 5 |
| chr15 | 67895787 | 67895798 | NC_000015.10 | 12 | 5 |
| chr15 | 75030887 | 75030898 | NC_000015.10 | 12 | 5 |
| chr15 | 80376611 | 80376600 | NC_000015.10 | 12 | 5 |
| chr17 | 2259971 | 2259960 | NC_000017.11 | 12 | 5 |
| chr17 | 13599804 | 13599793 | NC_000017.11 | 12 | 5 |
| chr17 | 49970374 | 49970385 | NC_000017.11 | 12 | 5 |
| chr17 | 74411987 | 74411998 | NC_000017.11 | 12 | 5 |
| chr18 | 6692184 | 6692173 | NC_000018.10 | 12 | 5 |
| chr18 | 26936361 | 26936372 | NC_000018.10 | 12 | 5 |
| chr18 | 32164785 | 32164796 | NC_000018.10 | 12 | 5 |
| chr18 | 57372141 | 57372152 | NC_000018.10 | 12 | 5 |
| chr18 | 76028676 | 76028665 | NC_000018.10 | 12 | 5 |
| chr18 | 79860251 | 79860240 | NC_000018.10 | 12 | 5 |
| chr20 | 2767508 | 2767497 | NC_000020.11 | 12 | 5 |
| chr20 | 32334864 | 32334853 | NC_000020.11 | 12 | 5 |
| chr20 | 42969400 | 42969411 | NC_000020.11 | 12 | 5 |
| chr21 | 15405882 | 15405871 | NC_000021.9 | 12 | 5 |
| chr21 | 27128817 | 27128828 | NC_000021.9 | 12 | 5 |
| chr21 | 27724878 | 27724889 | NC_000021.9 | 12 | 5 |
| chr21 | 33775512 | 33775523 | NC_000021.9 | 12 | 5 |
| chr22 | 40201219 | 40201208 | NC_000022.11 | 12 | 5 |
| chrX | 24583713 | 24583724 | NC_000023.11 | 12 | 5 |
| chrX | 53003928 | 53003939 | NC_000023.11 | 12 | 5 |
| chrX | 75537169 | 75537180 | NC_000023.11 | 12 | 5 |
| chrX | 91187582 | 91187593 | NC_000023.11 | 12 | 5 |
| chr01 | 237603124 | 237603136 | NC_000001.11 | 13 | 4 |
| chr02 | 132279864 | 132279852 | NC_000002.12 | 13 | 4 |
| chr02 | 176672291 | 176672279 | NC_000002.12 | 13 | 4 |
| chr04 | 47096940 | 47096952 | NC_000004.12 | 13 | 4 |
| chr05 | 170123837 | 170123825 | NC_000005.10 | 13 | 4 |
| chr10 | 97944808 | 97944796 | NC_000010.11 | 13 | 4 |
| chr10 | 114226626 | 114226614 | NC_000010.11 | 13 | 4 |
| chr13 | 67884795 | 67884783 | NC_000013.11 | 13 | 4 |
| chr14 | 59591410 | 59591398 | NC_000014.9 | 13 | 4 |
| chr16 | 3659076 | 3659088 | NC_000016.10 | 13 | 4 |
| chr18 | 25418784 | 25418772 | NC_000018.10 | 13 | 4 |
| chrX | 45634061 | 45634049 | NC_000023.11 | 13 | 4 |
| chr01 | 3217976 | 3217987 | NC_000001.11 | 12 | 4 |
| chr01 | 92837827 | 92837816 | NC_000001.11 | 12 | 4 |
| chr01 | 112701651 | 112701662 | NC_000001.11 | 12 | 4 |
| chr01 | 166000671 | 166000660 | NC_000001.11 | 12 | 4 |
| chr01 | 178801277 | 178801288 | NC_000001.11 | 12 | 4 |
| chr02 | 177290177 | 177290166 | NC_000002.12 | 12 | 4 |
| chr02 | 218084695 | 218084706 | NC_000002.12 | 12 | 4 |
| chr02 | 236494650 | 236494639 | NC_000002.12 | 12 | 4 |
| chr04 | 42894460 | 42894471 | NC_000004.12 | 12 | 4 |
| chr04 | 66200304 | 66200315 | NC_000004.12 | 12 | 4 |
| chr06 | 35644009 | 35643998 | NC_000006.12 | 12 | 4 |
| chr06 | 35671520 | 35671531 | NC_000006.12 | 12 | 4 |
| chr09 | 95179956 | 95179945 | NC_000009.12 | 12 | 4 |
| chr09 | 122078420 | 122078431 | NC_000009.12 | 12 | 4 |
| chr09 | 132891241 | 132891252 | NC_000009.12 | 12 | 4 |
| chr09 | 134244101 | 134244112 | NC_000009.12 | 12 | 4 |
| chr10 | 46934395 | 46934384 | NC_000010.11 | 12 | 4 |
| chr10 | 48117437 | 48117448 | NC_000010.11 | 12 | 4 |
| chr10 | 102716315 | 102716304 | NC_000010.11 | 12 | 4 |
| chr12 | 31614069 | 31614080 | NC_000012.12 | 12 | 4 |
| chr13 | 18693215 | 18693204 | NC_000013.11 | 12 | 4 |
| chr14 | 30845671 | 30845660 | NC_000014.9 | 12 | 4 |
| chr14 | 94062711 | 94062722 | NC_000014.9 | 12 | 4 |
| chr17 | 10363532 | 10363543 | NC_000017.11 | 12 | 4 |
| chr17 | 59667014 | 59667025 | NC_000017.11 | 12 | 4 |
| chr17 | 68278027 | 68278038 | NC_000017.11 | 12 | 4 |
| chr18 | 44686796 | 44686785 | NC_000018.10 | 12 | 4 |
| chr18 | 55570049 | 55570060 | NC_000018.10 | 12 | 4 |
| chr20 | 37099530 | 37099519 | NC_000020.11 | 12 | 4 |
| chr21 | 14473970 | 14473981 | NC_000021.9 | 12 | 4 |
| chr21 | 28191101 | 28191112 | NC_000021.9 | 12 | 4 |
| chr01 | 85362838 | 85362827 | NC_000001.11 | 12 | 3 |
| chr14 | 106817445 | 106817434 | NC_000014.9 | 12 | 3 |
| chr17 | 12074729 | 12074718 | NC_000017.11 | 12 | 3 |
| chr21 | 8217645 | 8217657 | NC_000021.9 | 13 | 2 |
| chr21 | 8400683 | 8400695 | NC_000021.9 | 13 | 2 |
| chr21 | 8444915 | 8444927 | NC_000021.9 | 13 | 2 |
| chr01 | 65227883 | 65227872 | NC_000001.11 | 12 | 2 |
| chr17 | 31347890 | 31347879 | NC_000017.11 | 12 | 1 |

Example 9: Retargeting of a GENE WRITER™ to a Genomic Safe Harbor Site

This example describes a GENE WRITER™ comprising a heterologous DNA binding domain that redirects its activity to a genomic safe harbor site.

In this example, the GENE WRITER™ polypeptide sequence is altered to where its natural DNA binding domain is replaced, mutated/inactivated, and/or joined with another polypeptide sequence that can redirect the GENE WRITER™ system to another genomic location that is not its endogenous or natural binding site. In some instances, the polypeptide sequence that redirects the GENE WRITER™ system to a non-natural genomic location may also be attached and/or inserted to any module of the GENE WRITER™ polypeptide sequence.

Figure 12:
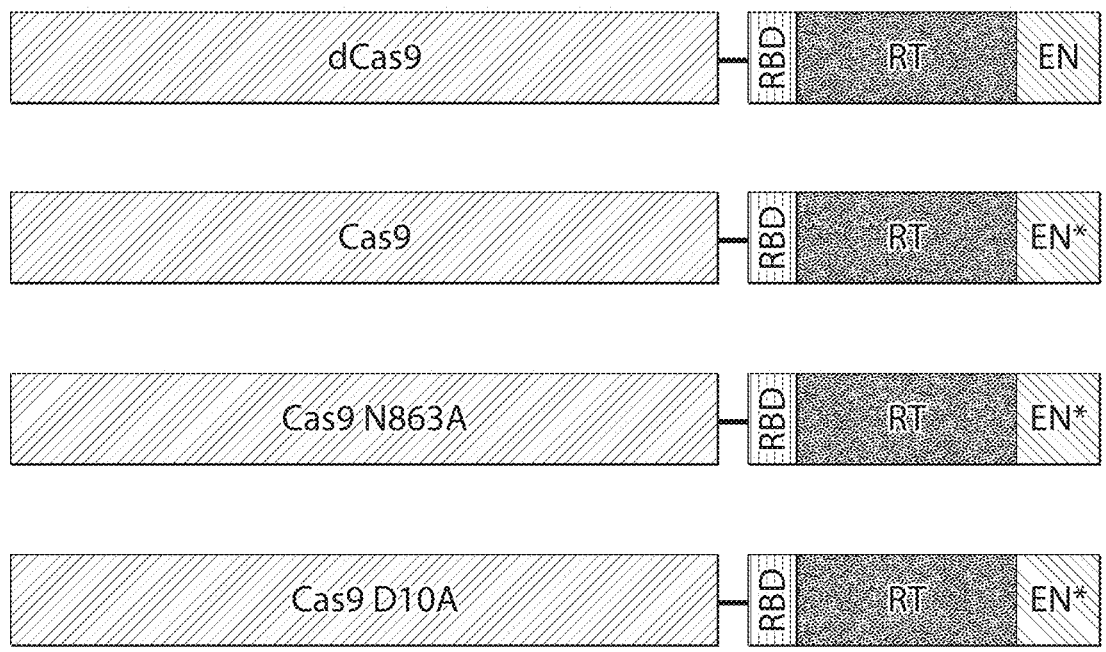
FIG. 12. Cas9 or Cas9 nickase replacement of DNA binding domain of Retrotransposase GENE WRITER™ genome editor polypeptides with or without active EN domain (*=mutant)

In some embodiments, the polypeptide sequence used to redirect the GENE WRITER™ system to a non-natural genomic target encodes for: a zinc finger, a series of adjacent, regularly, or irregularly spaced zinc fingers, a transcription activator-like effector (TALE), a series of adjacent, regularly, or irregularly spaced a transcription activator-like effectors (TALEs), Cas9, Cas9 with mutations to its catalytic residues inactivating the double-stranded DNA endonuclease activity (referred to as catalytically-dead Cas9 (dCas9)), Cas9 with a point mutation or multiple point mutations in a single catalytic domain in order to render Cas9 endonuclease only able to cleave one strand of double-stranded DNA (referred to as Cas9 nickase) (see FIG. 12).

. . .

Figure 11:
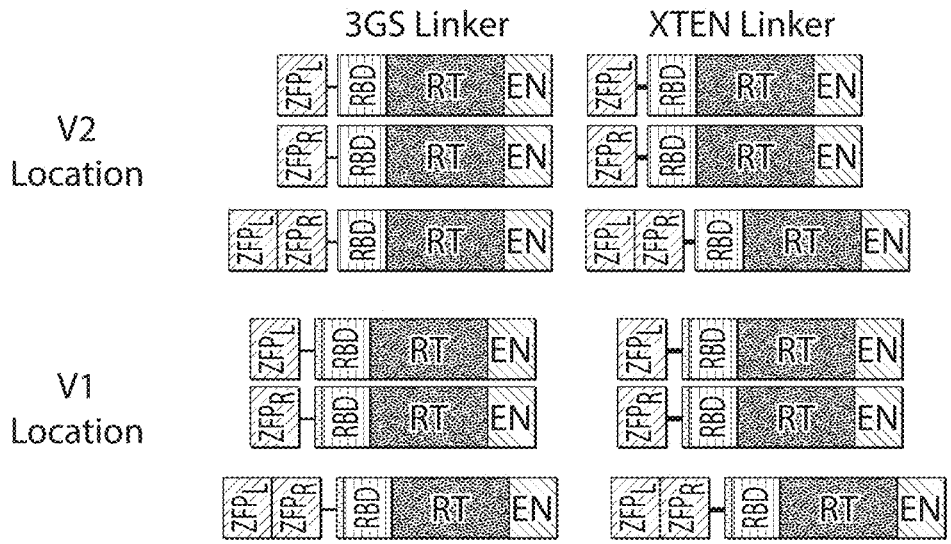
FIG. 11. AAVS1 ZFP replacement of DNA binding domain of a Retrotransposase GENE WRITER™. This Figure discloses "3GS Linker" as SEQ ID NO: 1024.
Figure 13:
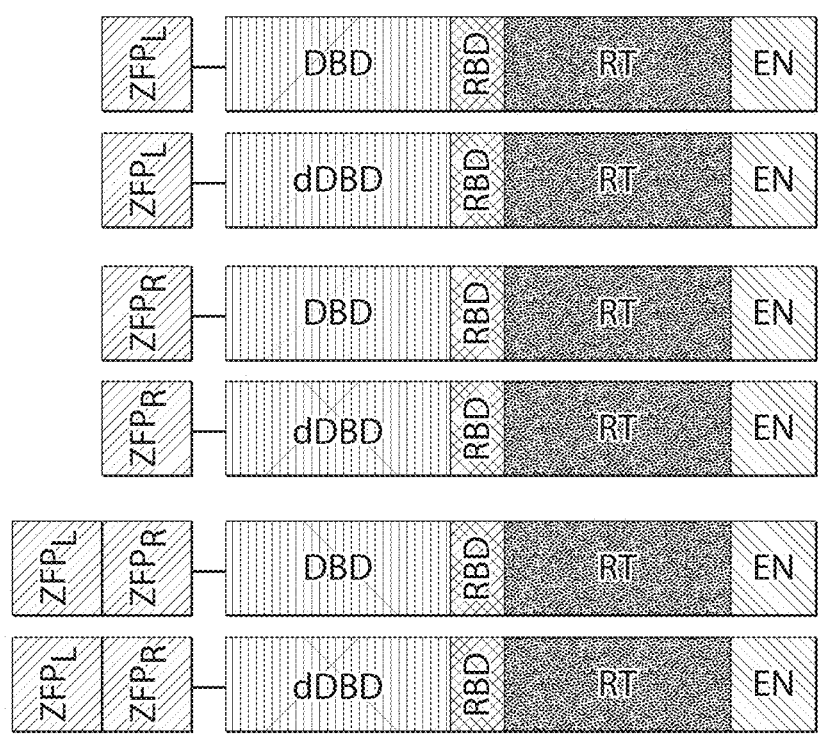
FIG. 13. AAVS1 ZFP fusion to a Retrotransposase GENE WRITER™ with or without functional DNA binding domain.

In some embodiments, the polypeptide sequence used to re-direct the GENE WRITER™ system targets a genomic safe-harbor location (e.g., AAVS1 site on human chromosome 19) (Pellenz, S., et. al., Human Gene Therapy, 30 (7), 814-828, 2019), see FIGS. 11 and 13. In further embodiments, the polypeptide sequence used to re-direct the GENE WRITER™ polypeptide sequence is used in conjunction with a nucleic acid that targets the genomic safe harbor location (e.g., the polypeptide sequence for catalytic dead Cas9 along with a single-guide RNA targeting the AAVS1 site on chromosome 19).

TABLE 53

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
|---|---|
| AAVS1 Left ZFP attached at v2 location of DBD of R2Tg with 3GS linker (SEQ ID NO: 1024) | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS*GGGSTATRDKKDTVTREKHPKKPFQKWMKDRAI KKGNYLRFQRLFYLDRGKLAKIILDDIECLSCDIPLSEIYSVFKTRWETTGSF KSLGDFKTYGKADNTAFRELITAKEIEKNVQEMSKGSAPGPDGITLGDVVKMD PEFSRTMEIFNLWLTTGKIPDMVRGCRTVLIPKSSKPDRLKDINNWRPITIGS ILLRLFSRIVTARLSKACPLNPRQRGFIRAAGCSENLKLLQTIIWSAKREHRP LGVVFVDIAKAFDTVSHQHIIHALQQREVDPHIVGLVSNMYENISTYITTKRN THTDKIQIRVGVKQGDPMSPLLFNLAMDPLLCKLEESGKGYHRGQSSITAMAF ADDLVLLSDSWENMNTNISILETFCNLTGLKTQGQKCHGFYIKPTKDSYTIND CAAWTINGTPLNMIDPGESEKYLGLQFDPWIGIARSGLSTKLDFWLQRIDQAP LKPLQKTDILKTYTIPRLIYIADHSEVKTALLETLDQKIRTAVKEWLHLPPCT CDAILYSSTRDGGLGITKLAGLIPSVQARRLHRIAQSSDDTMKCFMEKEKMEQ LHKKLWIQAGGDRENIPSIWEAPPSSEPPNNVSTNSEWEAPTQKDKFPKPCNW RKNEFKKWTKLASQGRGIVNFERDKISNHWIQYYRRIPHRKLLTALQLRANVY PTREFLARGRODQYIKACRHCDADIESCAHIIGNCPVTQDARIKRHNYICELL EEAAAEKVRKYKHLETEVRHLTNAKDVTFVGFPLGARGKWHQDNFKLLTELGL SKSRQVKMAETFSTVALFSSVDIVHMFASRARKSMVM (SEQ ID NO: 1658) |
| AAVS1 Left ZFP attached at v2 location of DBD of R2Tg with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS*SGSETPGTSESATPESTATRDKKDTVTREKHPK KPFQKWMKDRAIKKGNYLRFQRLFYLDRGKLAKIILDDIECLSCDIPLSEIYS VFKTRWETTGSFKSLGDFKTYGKADNTAFRELITAKEIEKNVQEMSKGSAPGP DGITLGDVVKMDPEFSRTMEIFNLWLTTGKIPDMVRGCRTVLIPKSSKPDRLK DINNWRPITIGSILLRLFSRIVTARLSKACPLNPRQRGFIRAAGCSENLKLLQ TIIWSAKREHRPLGVVFVDIAKAFDTVSHQHIIHALQQREVDPHIVGLVSNMY ENISTYITTKRNTHTDKIQIRVGVKQGDPMSPLLFNLAMDPLLCKLEESGKGY HRGQSSITAMAFADDLVLLSDSWENMNTNISILETFCNLTGLKTQGQKCHGFY IKPTKDSYTINDCAAWTINGTPLNMIDPGESEKYLGLQFDPWIGIARSGLSTK LDFWLQRIDQAPLKPLQKTDILKTYTIPRLIYIADHSEVKTALLETLDQKIRT AVKEWLHLPPCTCDAILYSSTRDGGLGITKLAGLIPSVQARRLHRIAQSSDDT MKCFMEKEKMEQLHKKLWIQAGGDRENIPSIWEAPPSSEPPNNVSTNSEWEAP TQKDKFPKPCNWRKNEFKKWTKLASQGRGIVNFERDKISNHWIQYYRRIPHRK LLTALQLRANVYPTREFLARGRODQYIKACRHCDADIESCAHIIGNCPVTQDA RIKRHNYICELLLEEAKKKDWVVFKEPHIRDSNKELYKPDLIFVKDARALVVD VTVRYEAAKSSLEEAAAEKVRKYKHLETEVRHLTNAKDVTFVGFPLGARGKWH QDNFKLLTELGLSKSRQVKMAETFSTVALFSSVDIVHMFASRARKSMVM (SEQ ID NO: 1659) |
| AAVS1 Left ZFP attached at v1 location of DBD of R2Tg with 3GS linker (SEQ ID NO: 1024) | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS*GGGSCFGCLESISQIRTATRDKKDTVTREKHPK KPFQKWMKDRAIKKGNYLRFQRLFYLDRGKLAKIILDDIECLSCDIPLSEIYS VFKTRWETTGSFKSLGDFKTYGKADNTAFRELITAKEIEKNVQEMSKGSAPGP DGITLGDVVKMDPEFSRTMEIFNLWLTTGKIPDMVRGCRTVLIPKSSKPDRLK DINNWRPITIGSILLRLFSRIVTARLSKACPLNPRQRGFIRAAGCSENLKLLQ TIIWSAKREHRPLGVVFVDIAKAFDTVSHQHIIHALQQREVDPHIVGLVSNMY ENISTYITTKRNTHTDKIQIRVGVKQGDPMSPLLFNLAMDPLLCKLEESGKGY |

TABLE 53-continued

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
| --- | --- |
| | HRGQSSITAMAFADDLVLLSDSWENMNTNISILETFCNLTGLKTQGQKCHGFY IKPTKDSYTINDCAAWTINGTPLNMIDPGESEKYLGLQFDPWIGIARSGLSTK LDFWLQRIDQAPLKPLQKTDILKTYTIPRLIYIADHSEVKTALLETLDQKIRT AVKEWLHLPPCTCDAILYSSTRDGGLGITKLAGLIPSVQARRLHRIAQSSDDT MKCFMEKEKMEQLHKKLWIQAGGDRENIPSIWEAPPSSEPPNNVSTNSEWEAP TQKDKFPKPCNWRKNEFKKWTKLASQGRGIVNFERDKISNHWIQYYRRIPHRK LLTALQLRANVYPTREFLARGRQDQYIKACRHCDADIESCAHIIGNCPVTQDA RIKRHNYICELLLEEAKKKDWVVFKEPHIRDSNKELYKPDLIFVKDARALVVD VTVRYEAAKSSLEEAAAEKVRKYKHLETEVRHLTNAKDVTFVGFPLGARGKWH QDNFKLLTELGLSKSRQVKMAETFSTVALFSSVDIVHMFASRARKSMVM (SEQ ID NO: 1660) |
| AAVS1 Left ZFP attached at v1 location of DBD of R2Tg with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGSS* SGSETPGTSESATPES CFGCLESISQIRTATRD KKDTVTREKHPKKPFQKWMKDRAIKKGNYLRFQRLFYLDRGKLAKIILDDIEC LSCDIPLSEIYSVFKTRWETTGSFKSLGDFKTYGKADNTAFRELITAKEIEKN VQEMSKGSAPGPDGITLGDVVKMDPEFSRTMEIFNLWLTTGKIPDMVRGCRTV LIPKSSKPDRLKDINNWRPITIGSILLRLFSRIVTARLSKACPLNPRQRGFIR AAGCSENLKLLQTIIWSAKREHRPLGVVFVDIAKAFDTVSHQHIIHALQQREV DPHIVGLVSNMYENISTYITTKRNTHTDKIQIRVGVKQGDPMSPLLFNLAMDP LLCKLEESGKGYHRGQSSITAMAFADDLVLLSDSWENMNTNISILETFCNLTG LKTQGQKCHGFYIKPTKDSYTINDCAAWTINGTPLNMIDPGESEKYLGLQFDP WIGIARSGLSTKLDFWLQRIDQAPLKPLQKTDILKTYTIPRLIYIADHSEVKT ALLETLDQKIRTAVKEWLHLPPCTCDAILYSSTRDGGLGITKLAGLIPSVQAR RLHRIAQSSDDTMKCFMEKEKMEQLHKKLWIQAGGDRENIPSIWEAPPSSEPP NNVSTNSEWEAPTQKDKFPKPCNWRKNEFKKWTKLASQGRGIVNFERDKISNH WIQYYRRIPHRKLLTALQLRANVYPTREFLARGRQDQYIKACRHCDADIESCA HIIGNCPVTQDARIKRHNYICELLLEEAKKKDWVVFKEPHIRDSNKELYKPDL IFVKDARALVVDVTVRYEAAKSSLEEAAAEKVRKYKHLETEVRHLTNAKDVTF VGFPLGARGKWHQDNFKLLTELGLSKSRQVKMAETFSTVALFSSVDIVHMFAS RARKSMVM (SEQ ID NO: 1661) |
| AAVS1 Right ZFP attached at v2 location of DBD of R2Tg with 3GS linker (SEQ ID NO: 1024) | *MGIHGVPAAMAERPFQCRICMRNFSQSSNLARHIRTHTGEKPFACDICGRKFA RTDYLVDHTKIHTGSQKPFQCRICMRNFSYNTHLTRHIRTHTGEKPFACDICG RKFAQGYNLAGHTKIHLRGS* GGGS TATRDKKDTVTREKHPKKPFQKWMKDRAI KKGNYLRFQRLFYLDRGKLAKIILDDIECLSCDIPLSEIYSVFKTRWETTGSF KSLGDFKTYGKADNTAFRELITAKEIEKNVQEMSKGSAPGPDGITLGDVVKMD PEFSRTMEIFNLWLTTGKIPDMVRGCRTVLIPKSSKPDRLKDINNWRPITIGS ILLRLFSRIVTARLSKACPLNPRQRGFIRAAGCSENLKLLQTIIWSAKREHRP LGVVFVDIAKAFDTVSHQHIIHALQQREVDPHIVGLVSNMYENISTYITTKRN THTDKIQIRVGVKQGDPMSPLLFNLAMDPLLCKLEESGKGYHRGQSSITAMAF ADDLVLLSDSWENMNTNISILETFCNLTGLKTQGQKCHGFYIKPTKDSYTIND CAAWTINGTPLNMIDPGESEKYLGLQFDPWIGIARSGLSTKLDFWLQRIDQAP LKPLQKTDILKTYTIPRLIYIADHSEVKTALLETLDQKIRTAVKEWLHLPPCT CDAILYSSTRDGGLGITKLAGLIPSVQARRLHRIAQSSDDTMKCFMEKEKMEQ LHKKLWIQAGGDRENIPSIWEAPPSSEPPNNVSTNSEWEAPTQKDKFPKPCNW RKNEFKKWTKLASQGRGIVNFERDKISNHWIQYYRRIPHRKLLTALQLRANVY PTREFLARGRQDQYIKACRHCDADIESCAHIIGNCPVTQDARIKRHNYICELL LEEAKKKDWVVFKEPHIRDSNKELYKPDLIFVKDARALVVDVTVRYEAAKSSL EEAAAEKVRKYKHLETEVRHLTNAKDVTFVGFPLGARGKWHQDNFKLLTELGL SKSRQVKMAETFSTVALFSSVDIVHMFASRARKSMVM (SEQ ID NO: 1662) |
| AAVS1 Right ZFP attached at v2 location of DBD of R2Tg with XTEN linker | *MGIHGVPAAMAERPFQCRICMRNFSQSSNLARHIRTHTGEKPFACDICGRKFA RTDYLVDHTKIHTGSQKPFQCRICMRNFSYNTHLTRHIRTHTGEKPFACDICG RKFAQGYNLAGHTKIHLRGS* SGSETPGTSESATPES TATRDKKDTVTREKHPK KPFQKWMKDRAIKKGNYLRFQRLFYLDRGKLAKIILDDIECLSCDIPLSEIYS VFKTRWETTGSFKSLGDFKTYGKADNTAFRELITAKEIEKNVQEMSKGSAPGP DGITLGDVVKMDPEFSRTMEIFNLWLTTGKIPDMVRGCRTVLIPKSSKPDRLK DINNWRPITIGSILLRLFSRIVTARLSKACPLNPRQRGFIRAAGCSENLKLLQ TIIWSAKREHRPLGVVFVDIAKAFDTVSHQHIIHALQQREVDPHIVGLVSNMY ENISTYITTKRNTHTDKIQIRVGVKQGDPMSPLLFNLAMDPLLCKLEESGKGY HRGQSSITAMAFADDLVLLSDSWENMNTNISILETFCNLTGLKTQGQKCHGFY IKPTKDSYTINDCAAWTINGTPLNMIDPGESEKYLGLQFDPWIGIARSGLSTK LDFWLQRIDQAPLKPLQKTDILKTYTIPRLIYIADHSEVKTALLETLDQKIRT AVKEWLHLPPCTCDAILYSSTRDGGLGITKLAGLIPSVQARRLHRIAQSSDDT MKCFMEKEKMEQLHKKLWIQAGGDRENIPSIWEAPPSSEPPNNVSTNSEWEAP TQKDKFPKPCNWRKNEFKKWTKLASQGRGIVNFERDKISNHWIQYYRRIPHRK |

TABLE 53-continued

Re-targeted Gene Writer™ constructs. Examples shown are to re-target R2Tg Gene Writer™ polypeptide sequence to the AAVS1 site using ZF or Cas9 domains.

| Gene Writer™ Polypeptide Name | Polypeptide Sequence (Re-targeting polypeptide sequence, italic; Linker, bold underline) |
|---|---|
| | LLTALQLRANVYPTREFLARGRQDQYIKACRHCDADIESCAHIIGNCPVTQDA RIKRHNYICELLLEEAKKKDWVVFKEPHIRDSNKELYKPDLIFVKDARALVVD VTVRYEAAKSSLEEAAAEKVRKYKHLETEVRHLTNAKDVTFVGFPLGARGKWH QDNFKLLTELGLSKSRQVKMAETFSTVALFSSVDIVHMFASRARKSMVM (SEQ ID NO: 1663) |
| AAVS1 Right ZFP attached at v1 location of DBD of R2Tg with 3GS linker (SEQ ID NO: 1024) | *MGIHGVPAAMAERPFQCRICMRNFSQSSNLARHIRTHTGEKPFACDICGRKFA RTDYLVDHTKIHTGSQKPFQCRICMRNFSYNTHLTRHIRTHTGEKPFACDICG RKFAQGYNLAGHTKIHLRGS*GGGSCFGCLESISQIRTATRDKKDTVTREKHPK KPFQKWMKDRAIKKGNYLRFQRLFYLDRGKLAKIILDDIECLSCDIPLSEIYS VFKTRWETTGSFKSLGDFKTYGKADNTAFRELITAKEIEKNVQEMSKGSAPGP DGITLGDVVKMDPEFSRTMEIFNLWLTTGKIPDMVRGCRTVLIPKSSKPDRLK DINNWRPITIGSILLRLFSRIVTARLSKACPLNPRQRGFIRAAGCSENLKLLQ TIIWSAKREHRPLGVVFVDIAKAFDTVSHQHIIHALQQREVDPHIVGLVSNMY ENISTYITTKRNTHTDKIQIRVGVKQGDPMSPLLFNLAMDPLLCKLEESGKGY HRGQSSITAMAFADDLVLLSDSWENMNTNISILETFCNLTGLKTQGQKCHGFY IKPTKDSYTINDCAAWTINGTPLNMIDPGESEKYLGLQFDPWIGIARSGLSTK LDFWLQRIDQAPLKPLQKTDILKTYTIPRLIYIADHSEVKTALLETLDQKIRT AVKEWLHLPPCTCDAILYSSTRDGGLGITKLAGLIPSVQARRLHRIAQSSDDT MKCFMEKEKMEQLHKKLWIQAGGDRENIPSIWEAPPSSEPPNNVSTNSEWEAP TQKDKFPKPCNWRKNEFKKWTKLASQGRGIVNFERDKISNHWIQYYRRIPHRK LLTALQLRANVYPTREFLARGRQDQYIKACRHCDADIESCAHIIGNCPVTQDA RIKRHNYICELLLEEAKKKDWVVFKEPHIRDSNKELYKPDLIFVKDARALVVD VTVRYEAAKSSLEEAAAEKVRKYKHLETEVRHLTNAKDVTFVGFPLGARGKWH QDNFKLLTELGLSKSRQVKMAETFSTVALFSSVDIVHMFASRARKSMVM (SEQ ID NO: 1664) |
| AAVS1 Right ZFP attached at v1 location of DBD of R2Tg with XTEN linker | *MGIHGVPAAMAERPFQCRICMRNFSQSSNLARHIRTHTGEKPFACDICGRKFA RTDYLVDHTKIHTGSQKPFQCRICMRNFSYNTHLTRHIRTHTGEKPFACDICG RKFAQGYNLAGHTKIHLRGS*SGSETPGTSESATPESCFGCLESISQIRTATRD KKDTVTREKHPKKPFQKWMKDRAIKKGNYLRFQRLFYLDRGKLAKIILDDIEC LSCDIPLSEIYSVFKTRWETTGSFKSLGDFKTYGKADNTAFRELITAKEIEKN VQEMSKGSAPGPDGITLGDVVKMDPEFSRTMEIFNLWLTTGKIPDMVRGCRTV LIPKSSKPDRLKDINNWRPITIGSILLRLFSRIVTARLSKACPLNPRQRGFIR AAGCSENLKLLQTIIWSAKREHRPLGVVFVDIAKAFDTVSHQHITHALQQREV DPHIVGLVSNMYENISTYITTKRNTHTDKIQIRVGVKQGDPMSPLLFNLAMDP LLCKLEESGKGYHRGQSSITAMAFADDLVLLSDSWENMNTNISILETFCNLTG LKTQGQKCHGFYIKPTKDSYTINDCAAWTINGTPLNMIDPGESEKYLGLQFDP WIGIARSGLSTKLDFWLQRIDQAPLKPLQKTDILKTYTIPRLIYIADHSEVKT ALLETLDQKIRTAVKEWLHLPPCTCDAILYSSTRDGGLGITKLAGLIPSVQAR RLHRIAQSSDDTMKCFMEKEKMEQLHKKLWIQAGGDRENIPSIWEAPPSSEPP NNVSTNSEWEAPTQKDKFPKPCNWRKNEFKKWTKLASQGRGIVNFERDKISNH WIQYYRRIPHRKLLTALQLRANVYPTREFLARGRQDQYIKACRHCDADIESCA HIIGNCPVTQDARIKRHNYICELLLEEAKKKDWVVFKEPHIRDSNKELYKPDL IFVKDARALVVDVTVRYEAAKSSLEEAAAEKVRKYKHLETEVRHLTNAKDVTF VGFPLGARGKWHQDNFKLLTELGLSKSRQVKMAETFSTVALFSSVDIVHMFAS RARKSMVM (SEQ ID NO: 1665) |
| AAVS1 Left and Right ZFP (separated by XTEN linker) attached at v2 location of DBD of R2Tg with 3GS linker (SEQ ID NO: 1024) | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS*SGSETPGTSESATPES*GIHGVPAAMAERPFQCR ICMRNFSQSSNLARHIRTHTGEKPFACDICGRKFARTDYLVDHTKIHTGSQKP FQCRICMRNFSYNTHLTRHIRTHTGEKPFACDICGRKFAQGYNLAGHTKIHLR GS*GGGSTATRDKKDTVTREKHPKPFQKWMKDRAIKKGNYLRFQRLFYLDRGK LAKIILDDIECLSCDIPLSEIYSVFKTRWETTGSFKSLGDFKTYGKADNTAFR ELITAKEIEKNVQEMSKGSAPGPDGITLGDVVKMDPEFSRTMEIFNLWLTTGK IPDMVRGCRTVLIPKSSKPDRLKDINNWRPITIGSILLRLFSRIVTARLSKAC PLNPRQRGFIRAAGCSENLKLLQTIIWSAKREHRPLGVVFVDIAKAFDTVSHQ HIIHALQQREVDPHIVGLVSNMYENISTYITTKRNTHTDKIQIRVGVKQGDPM SPLLFNLAMDPLLCKLEESGKGYHRGQSSITAMAFADDLVLLSDSWENMNTNI SILETFCNLTGLKTQGQKCHGFYIKPTKDSYTINDCAAWTINGTPLNMIDPGE SEKYLGLQFDPWIGIARSGLSTKLDFWLQRIDQAPLKPLQKTDILKTYTIPRL IYIADHSEVKTALLETLDQKIRTAVKEWLHLPPCTCDAILYSSTRDGGLGITK LAGLIPSVQARRLHRIAQSSDDTMKCFMEKEKMEQLHKKLWIQAGGDRENIPS IWEAPPSSEPPNNVSTNSEWEAPTQKDKFPKPCNWRKNEFKKWTKLASQGRGI VNFERDKISNHWIQYYRRIPHRKLLTALQLRANVYPTREFLARGRQDQYIKAC RHCDADIESCAHIIGNCPVTQDARIKRHNYICELLLEEAKKKDWVVFKEPHIR DSNKELYKPDLIFVKDARALVVDVTVRYEAAKSSLEEAAAEKVRKYKHLETEV RHLTNAKDVTFVGFPLGARGKWHQDNFKLLTELGLSKSRQVKMAETFSTVALF SSVDIVHMFASRARKSMVM (SEQ ID NO: 1666) |

TABLE 53-continued

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
| --- | --- |
| AAVS1 Left and Right ZFP (separated by XTEN linker) attached at v2 location of DBD of R2Tg with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS*SGSETPGTSESATPES*GIHGVPAAMAERPFQCR ICMRNFSQSSNLARHIRTHTGEKPFACDICGRKFARTDYLVDHTKIHTGSQKP FQCRICMRNFSYNTHLTRHIRTHTGEKPFACDICGRKFAQGYNLAGHTKIHLR GSS*SGSETPGTSESATPESTATRDKKDTVTREKHPKKPFQKWMKDRAIKKGNYL RFQRLFYLDRGKLAKIILDDIECLSCDIPLSEIYSVFKTRWETTGSFKSLGDF KTYGKADNTAFRELITAKEIEKNVQEMSKGSAPGPDGITLGDVVKMDPEFSRT MEIFNLWLTTGKIPDMVRGCRTVLIPKSSKPDRLKDINNWRPITIGSILLRLF SRIVTARLSKACPLNPRQRGFIRAAGCSENLKLLQTIIWSAKREHRPLGVVFV DIAKAFDTVSHQHIIHALQQREVDPHIVGLVSNMYENISTYITTKRNTHTDKI QIRVGVKQGDPMSPLLFNLAMDPLLCKLEESGKGYHRGQSSITAMAFADDLVL LSDSWENMNTNISILETFCNLTGLKTQGQKCHGFYIKPTKDSYTINDCAAWTI NGTPLNMIDPGESEKYLGLQFDPWIGIARSGLSTKLDFWLQRIDQAPLKPLQK TDILKTYTIPRLIYIADHSEVKTALLETLDQKIRTAVKEWLHLPPCTCDAILY SSTRDGGLGITKLAGLIPSVQARRLHRIAQSSDDTMKCFMEKEKMEQLHKKLW IQAGGDRENIPSIWEAPPSSEPPNNVSTNSEWEAPTQKDKFPKPCNWRKNEFK KWTKLASQGRGIVNFERDKISNHWIQYYRRIPHRKLLTALQLRANVYPTREFL ARGRQDQYIKACRHCDADIESCAHIIGNCPVTQDARIKRHNYICELLLEEAKK KDWVVFKEPHIRDSNKELYKPDLIFVKDARALVVDVTVRYEAAKSSLEEAAAE KVRKYKHLETEVRHLTNAKDVTFVGFPLGARGKWHQDNFKLLTELGLSKSRQV KMAETFSTVALFSSVDIVHMFASRARKSMVM (SEQ ID NO: 1667) |
| AAVS1 Left ZFP attached to N-terminus of R2Tg with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS*SGSETPGTSESATPESASCPKPGPPVSAGAMSL ESGLTTHSVLAIERGPNSLANSGSDFGGGGLGLPLRLLRVSVGTQTSRSDWVD LVSWSHPGPTSKSQQVDLVSLFPKHRVDLLSKNDQVDLVAQFLPSKFPPNLAE NDLALLVNLEFYRSDLHVYECVHFAAHWEGLSGLPEVYEQLAPQPCVGETLHS SLPRDSELFVPEEGSSEKESEDAPKTSPPTPGKHGLEQTGEEKVMVTVPDKNP PCPCCGTRVNSVLNLIEHLKVSHGKRGVCFRCAKCGKENSNYHSVVCHFPKCR GPETEKAPAGEWICEVCNRDFTTKIGLGQHKRLAHPAVRNQERIVASQPKETS NRGAHKRCWTKEEEELLIRLEAQFEGNKNINKLIAEHITTKTAKQISDKRRLL SRKPAEEPREEPGTCHHTRRAAASLRTEPEMSHHAQAEDRDNGPGRRPLPGRA AAGGRTMDEIRRHPDKGNGQQRPTKQKSEEQLQAYYKKTLEERLSAGALNTFP RAFKQVMEGRDIKLVINQTAQDCFGCLESISQIRTATRDKKDTVTREKHPKKP FQKWMKDRAIKKGNYLRFQRLFYLDRGKLAKIILDDIECLSCDIPLSEIYSVF KTRWETTGSFKSLGDFKTYGKADNTAFRELITAKEIEKNVQEMSKGSAPGPDG ITLGDVVKMDPEFSRTMEIFNLWLTTGKIPDMVRGCRTVLIPKSSKPDRLKDI NNWRPITIGSILLRLFSRIVTARLSKACPLNPRQRGFIRAAGCSENLKLLQTI IWSAKREHRPLGVVFVDIAKAFDTVSHQHITHALQQREVDPHIVGLVSNMYEN ISTYITTKRNTHTDKIQIRVGVKQGDPMSPLLFNLAMDPLLCKLEESGKGYHR GQSSITAMAFADDLVLLSDSWENMNTNISILETFCNLTGLKTQGQKCHGFYIK PTKDSYTINDCAAWTINGTPLNMIDPGESEKYLGLQFDPWIGIARSGLSTKLD FWLQRIDQAPLKPLQKTDILKTYTIPRLIYIADHSEVKTALLETLDQKIRTAV KEWLHLPPCTCDAILYSSTRDGGLGITKLAGLIPSVQARRLHRIAQSSDDTMK CFMEKEKMEQLHKKLWIQAGGDRENIPSIWEAPPSSEPPNNVSTNSEWEAPTQ KDKFPKPCNWRKNEFKKWTKLASQGRGIVNFERDKISNHWIQYYRRIPHRKLL TALQLRANVYPTREFLARGRQDQYIKACRHCDADIESCAHIIGNCPVTQDARI VRYEAAKSSLEEAAAEKVRKYKHLETEVRHLTNAKDVTFVGFPLGARGKWHQD NFKLLTELGLSKSRQVKMAETFSTVALFSSVDIVHMFASRARKSMVM (SEQ ID NO: 1668) |
| AAVS1 Right ZFP attached to N-terminus of R2Tg with XTEN linker | *MGIHGVPAAMAERPFQCRICMRNFSQSSNLARHIRTHTGEKPFACDICGRKFA RTDYLVDHTKIHTGSQKPFQCRICMRNFSYNTHLTRHIRTHTGEKPFACDICG RKFAQGYNLAGHTKIHLRGS*SGSETPGTSESATPESASCPKPGPPVSAGAMSL ESGLTTHSVLAIERGPNSLANSGSDFGGGGLGLPLRLLRVSVGTQTSRSDWVD LVSWSHPGPTSKSQQVDLVSLFPKHRVDLLSKNDQVDLVAQFLPSKFPPNLAE NDLALLVNLEFYRSDLHVYECVHFAAHWEGLSGLPEVYEQLAPQPCVGETLHS SLPRDSELFVPEEGSSEKESEDAPKTSPPTPGKHGLEQTGEEKVMVTVPDKNP PCPCCGTRVNSVLNLIEHLKVSHGKRGVCFRCAKCGKENSNYHSVVCHFPKCR GPETEKAPAGEWICEVCNRDFTTKIGLGQHKRLAHPAVRNQERIVASQPKETS NRGAHKRCWTKEEEELLIRLEAQFEGNKNINKLIAEHITTKTAKQISDKRRLL SRKPAEEPREEPGTCHHTRRAAASLRTEPEMSHHAQAEDRDNGPGRRPLPGRA AAGGRTMDEIRRHPDKGNGQQRPTKQKSEEQLQAYYKKTLEERLSAGALNTFP RAFKQVMEGRDIKLVINQTAQDCFGCLESISQIRTATRDKKDTVTREKHPKKP FQKWMKDRAIKKGNYLRFQRLFYLDRGKLAKIILDDIECLSCDIPLSEIYSVF KTRWETTGSFKSLGDFKTYGKADNTAFRELITAKEIEKNVQEMSKGSAPGPDG ITLGDVVKMDPEFSRTMEIFNLWLTTGKIPDMVRGCRTVLIPKSSKPDRLKDI NNWRPITIGSILLRLFSRIVTARLSKACPLNPRQRGFIRAAGCSENLKLLQTI IWSAKREHRPLGVVFVDIAKAFDTVSHQHIIHALQQREVDPHIVGLVSNMYEN ISTYITTKRNTHTDKIQIRVGVKQGDPMSPLLFNLAMDPLLCKLEESGKGYHR |

TABLE 53-continued

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
|---|---|
| | GQSSITAMAFADDLVLLSDSWENMNTNISILETFCNLTGLKTQGQKCHGFYIK PTKDSYTINDCAAWTINGTPLNMIDPGESEKYLGLQFDPWIGIARSGLSTKLD FWLQRIDQAPLKPLQKTDILKTYTIPRLIYIADHSEVKTALLETLDQKIRTAV KEWLHLPPCTCDAILYSSTRDGGLGITKLAGLIPSVQARRLHRIAQSSDDTMK CFMEKEKMEQLHKKLWIQAGGDRENIPSIWEAPPSSEPPNNVSTNSEWEAPTQ KDKFPKPCNWRKNEFKKWTKLASQGRGIVNFERDKISNHWIQYYRRIPHRKLL TALQLRANVYPTREFLARGRQDQYIKACRHCDADIESCAHIIGNCPVTQDARI VRYEAAKSSLEEAAAEKVRKYKHLETEVRHLTNAKDVTFVGFPLGARGKWHQD NFKLLTELGLSKSRQVKMAETFSTVALFSSVDIVHMFASRARKSMVM (SEQ ID NO: 1669) |
| AAVS1 Left and Right ZFP attached to N-terminus of R2Tg with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS* SGSETPGTSESATPES *GIHGVPAAMAERPFQCR ICMRNFSQSSNLARHIRTHTGEKPFACDICGRKFARTDYLVDHTKIHTGSQKP FQCRICMRNFSYNTHLTRHIRTHTGEKPFACDICGRKFAQGYNLAGHTKIHLR GS* SGSETPGTSESATPES ASCPKPGPPVSAGAMSLESGLTTHSVLAIERGPNS LANSGSDFGGGGLGLPLRLLRVSVGTQTSRSDWVDLVSWSHPGPTSKSQQVDL VSLFPKHRVDLLSKNDQVDLVAQFLPSKFPPNLAENDLALLVNLEFYRSDLHV YECVHFAAHWEGLSGLPEVYEQLAPQPCVGETLHSSLPRDSELFVPEEGSSEK ESEDAPKTSPPTPGKHGLEQTGEEKVMVTVPDKNPPCPCCGTRVNSVLNIEH LKVSHGKRGVCFRCAKCGKENSNYHSVVCHFPKCRGPETEKAPAGEWICEVCN RDFTTKIGLGQHKRLAHPAVRNQERIVASQPKETSNRGAHKRCWTKEEEELLI RLEAQFEGNKNINKLIAEHITTKTAKQISDKRRLLSRKPAEEPREEPGTCHHT RRAAASLRTEPEMSHHAQAEDRDNGPGRRPLPGRAAAGGRTMDEIRRHPDKGN GQQRPTKQKSEEQLQAYYKKTLEERLSAGALNTFPRAFKQVMEGRDIKLVINQ TAQDCFGCLESISQIRTATRDKKDTVTREKHPKKPFQKWMKDRAIKKGNYLRF QRLFYLDRGKLAKIILDDIECLSCDIPLSEIYSVFKTRWETTGSFKSLGDFKT YGKADNTAFRELITAKEIEKNVQEMSKGSAPGPDGITLGDVVKMDPEFSRTME IFNLWLTTGKIPDMVRGCRTVLIPKSSKPDRLKDINNWRPITIGSILLRLFSR IVTARLSKACPLNPRQRGFIRAAGCSENLKLLQTIIWSAKREHRPLGVVFVDI AKAFDTVSHQHIIHALQQREVDPHIVGLVSNMYENISTYITTKRNTHTDKIQI RVGVKQGDPMSPLLFNLAMDPLLCKLEESGKGYHRGQSSITAMAFADDLVLLS DSWENMNTNISILETFCNLTGLKTQGQKCHGFYIKPTKDSYTINDCAAWTING TPLNMIDPGESEKYLGLQFDPWIGIARSGLSTKLDFWLQRIDQAPLKPLQKTD ILKTYTIPRLIYIADHSEVKTALLETLDQKIRTAVKEWLHLPPCTCDAILYSS TRDGGLGITKLAGLIPSVQARRLHRIAQSSDDTMKCFMEKEKMEQLHKKLWIQ AGGDRENIPSIWEAPPSSEPPNNVSTNSEWEAPTQKDKFPKPCNWRKNEFKKW TKLASQGRGIVNFERDKISNHWIQYYRRIPHRKLLTALQLRANVYPTREFLAR GRQDQYIKACRHCDADIESCAHIIGNCPVTQDARIKRHNYICELLLEEAKKKD RKYKHLETEVRHLTNAKDVTFVGFPLGARGKWHQDNFKLLTELGLSKSRQVKM AETFSTVALFSSVDIVHMFASRARKSMVM (SEQ ID NO: 1670) |
| AAVS1 Left ZFP attached to N-terminus of R2Tg containing DBD inactivation mutations with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS* SGSETPGTSESATPES ASCPKPGPPVSAGAMSL ESGLTTHSVLAIERGPNSLANSGSDFGGGGLGLPLRLLRVSVGTQTSRSDWVD LVSWSHPGPTSKSQQVDLVSLFPKHRVDLLSKNDQVDLVAQFLPSKFPPNLAE NDLALLVNLEFYRSDLHVYECVHFAAHWEGLSGLPEVYEQLAPQPCVGETLHS SLPRDSELFVPEEGSSEKESEDAPKTSPPTPGKHGLEQTGEEKVMVTVPDKNP PSPSSGTRVNSVLNLIEHLKVSHGKRGVCFRCAKCGKENSNYHSVVCHFPKCR GPETEKAPAGEWISEVSNRDFTTKIGLGQHKRLAHPAVRNQERIVASQPKETS NRGAHKACATKEEEELLIRLEAQFEGNKNINKLIAEHITTKTAKQISDKRRLL SRKPAEEPREEPGTCHHTRRAAASLRTEPEMSHHAQAEDRDNGPGRRPLPGRA AAGGRTMDEIRRHPDKGNGQQRPTKQKSEEQLQAYYKKTLEERLSAGALNTFP RAFKQVMEGRDIKLVINQTAQDCFGCLESISQIRTATRDKKDTVTREKHPKKP FQKWMKDRAIKKGNYLRFQRLFYLDRGKLAKIILDDIECLSCDIPLSEIYSVF KTRWETTGSFKSLGDFKTYGKADNTAFRELITAKEIEKNVQEMSKGSAPGPDG ITLGDVVKMDPEFSRTMEIFNLWLTTGKIPDMVRGCRTVLIPKSSKPDRLKDI NNWRPITIGSILLRLFSRIVTARLSKACPLNPRQRGFIRAAGCSENLKLLQTI IWSAKREHRPLGVVFVDIAKAFDTVSHQHIIHALQQREVDPHIVGLVSNMYEN ISTYITTKRNTHTDKIQIRVGVKQGDPMSPLLFNLAMDPLLCKLEESGKGYHR GQSSITAMAFADDLVLLSDSWENMNTNISILETFCNLTGLKTQGQKCHGFYIK PTKDSYTINDCAAWTINGTPLNMIDPGESEKYLGLQFDPWIGIARSGLSTKLD FWLQRIDQAPLKPLQKTDILKTYTIPRLIYIADHSEVKTALLETLDQKIRTAV KEWLHLPPCTCDAILYSSTRDGGLGITKLAGLIPSVQARRLHRIAQSSDDTMK CFMEKEKMEQLHKKLWIQAGGDRENIPSIWEAPPSSEPPNNVSTNSEWEAPTQ KDKFPKPCNWRKNEFKKWTKLASQGRGIVNFERDKISNHWIQYYRRIPHRKLL TALQLRANVYPTREFLARGRQDQYIKACRHCDADIESCAHIIGNCPVTQDARI VRYEAAKSSLEEAAAEKVRKYKHLETEVRHLTNAKDVTFVGFPLGARGKWHQD NFKLLTELGLSKSRQVKMAETFSTVALFSSVDIVHMFASRARKSMVM (SEQ ID NO: 1671) |

TABLE 53-continued

Re-targeted Gene Writer™ constructs. Examples shown are to re-target R2Tg Gene Writer™ polypeptide sequence to the AAVS1 site using ZF or Cas9 domains.

| Gene Writer™ Polypeptide Name | Polypeptide Sequence (Re-targeting polypeptide sequence, italic; Linker, bold underline) |
|---|---|
| AAVS1 Right ZFP attached to N-terminus of R2Tg containing DBD inactivation mutations with XTEN linker | *MGIHGVPAAMAERPFQCRICMRNFSQSSNLARHIRTHTGEKPFACDICGRKFA RTDYLVDHTKIHTGSQKPFQCRICMRNFSYNTHLTRHIRTHTGEKPFACDICG RKFAQGYNLAGHTKIHLRGS* SGSETPGTSESATPES ASCPKPGPPVSAGAMSL ESGLTTHSVLAIERGPNSLANSGSDFGGGGLGLPLRLLRVSVGTQTSRSDWVD LVSWSHPGPTSKSQQVDLVSLFPKHRVDLLSKNDQVDLVAQFLPSKFPPNLAE NDLALLVNLEFYRSDLHVYECVHFAAHWEGLSGLPEVYEQLAPQPCVGETLHS SLPRDSELFVPEEGSSEKESEDAPKTSPPTPGKHGLEQTGEEKVMVTVPDKNP PSPSSGTRVNSVLNLIEHLKVSHGKRGVCFRCAKCGKENSNYHSVVCHFPKCR GPETEKAPAGEWISEVSNRDFTTKIGLGQHKRLAHPAVRNQERIVASQPKETS NRGAHKACATKEEEELLIRLEAQPEGNKNINKLIAEHITTKTAKQISDKRRLL SRKPAEEPREEPGTCHHTRRAAASLRTEPEMSHHAQAEDRDNGPGRRPLPGRA AAGGRTMDEIRRHPDKGNGQQRPTKQKSEEQLQAYYKKTLEERLSAGALNTFP RAFKQVMEGRDIKLVINQTAQDCFGCLESISQIRTATRDKKDTVTREKHPKKP FQKWMKDRAIKKGNYLRFQRLFYLDRGKLAKIILDDIECLSCDIPLSEIYSVF KTRWETTGSFKSLGDFKTYGKADNTAFRELITAKEIEKNVQEMSKGSAPGPDG ITLGDVVKMDPEFSRTMEIFNLWLTTGKIPDMVRGCRTVLIPKSSKPDRLKDI NNWRPITIGSILLRLFSRIVTARLSKACPLNPRQRGFIRAAGCSENLKLLQTI IWSAKREHRPLGVVFVDIAKAFDTVSHQHIIHALQQREVDPHIVGLVSNMYEN ISTYITTKRNTHTDKIQIRVGVKQGDPMSPLLFNLAMDPLLCKLEESGKGYHR GQSSITAMAFADDLVLLSDSWENMNTNISILETFCNLTGLKTQGQKCHGFYIK PTKDSYTINDCAAWTINGTPLNMIDPGESEKYLGLQFDPWIGIARSGLSTKLD FWLQRIDQAPLKPLQKTDILKTYTIPRLIYIADHSEVKTALLETLDQKIRTAV KEWLHLPPCTCDAILYSSTRDGGLGITKLAGLIPSVQARRLHRIAQSSDDTMK CFMEKEKMEQLHKKLWIQAGGDRENIPSIWEAPPSSEPPNNVSTNSEWEAPTQ KDKFPKPCNWRKNEFKKWTKLASQGRGIVNFERDKISNHWIQYYRRIPHRKLL TALQLRANVYPTREFLARGRQDQYIKACRHCDADIESCAHIIGNCPVTQDARI KRHNYICELLLEEAKKKDWVVFKEPHIRDSNKELYKPDLIFVKDARALVVDVT VRYEAAKSSLEEAAAEKVRKYKHLETEVRHLTNAKDVTFVGFPLGARGKWHQD NFKLLTELGLSKSRQVKMAETFSTVALFSSVDIVHMFASRARKSMVM (SEQ ID NO: 1672) |
| AAVS1 Left and Right ZFP attached to N-terminus of R2Tg containing DBD inactivation mutations with XTEN linker | *MGIHGVPAAMAERPFQCRICMRNFSYNWHLQRHIRTHTGEKPFACDICGRKFA RSDHLTTHTKIHTGSQKPFQCRICMRNFSHNYARDCHIRTHTGEKPFACDICG RKFAQNSTRIGHTKIHLRGS* SGSETPGTSESATPES *GIHGVPAAMAERPFQCR ICMRNFSQSSNLARHIRTHTGEKPFACDICGRKFARTDYLVDHTKIHTGSQKP FQCRICMRNFSYNTHLTRHIRTHTGEKPFACDICGRKFAQGYNLAGHTKIHLR GSS* SGSETPGTSESATPES ASCPKPGPPVSAGAMSLESGLTTHSVLAIERGPNS LANSGSDFGGGGLGLPLRLLRVSVGTQTSRSDWVDLVSWSHPGPTSKSQQVDL VSLFPKHRVDLLSKNDQVDLVAQFLPSKFPPNLAENDLALLVNLEFYRSDLHV YECVHFAAHWEGLSGLPEVYEQLAPQPCVGETLHSSLPRDSELFVPEEGSSEK ESEDAPKTSPPTPGKHGLEQTGEEKVMVTVPDKNPPSPSSGTRVNSVLNLIEH LKVSHGKRGVCFRCAKCGKENSNYHSVVCHFPKCRGPETEKAPAGEWISEVSN RDFTTKIGLGQHKRLAHPAVRNQERIVASQPKETSNRGAHKACATKEEEELLI RLEAQFEGNKNINKLIAEHITTKTAKQISDKRRLLSRKPAEEPREEPGTCHHT RRAAASLRTEPEMSHHAQAEDRDNGPGRRPLPGRAAAGGRTMDEIRRHPDKGN GQQRPTKOKSEEQLQAYYKKTLEERLSAGALNTFPRAFKQVMEGRDIKLVINQ TAQDCFGCLESISQIRTATRDKKDTVTREKHPKKPFQKWMKDRAIKKGNYLRF QRLFYLDRGKLAKIILDDIECLSCDIPLSEIYSVFKTRWETTGSFKSLGDFKT YGKADNTAFRELITAKEIEKNVQEMSKGSAPGPDGITLGDVVKMDPEFSRTME IFNLWLTTGKIPDMVRGCRTVLIPKSSKPDRLKDINNWRPITIGSILLRLFSR IVTARLSKACPLNPRQRGFIRAAGCSENLKLLQTIIWSAKREHRPLGVVFVDI AKAFDTVSHQHIIHALQQREVDPHIVGLVSNMYENISTYITTKRNTHTDKIQI RVGVKQGDPMSPLLFNLAMDPLLCKLEESGKGYHRGQSSITAMAFADDLVLLS DSWENMNTNISILETFCNLTGLKTQGQKCHGFYIKPTKDSYTINDCAAWTING TPLNMIDPGESEKYLGLQFDPWIGIARSGLSTKLDFWLQRIDQAPLKPLQKTD ILKTYTIPRLIYIADHSEVKTALLETLDQKIRTAVKEWLHLPPCTCDAILYSS TRDGGLGITKLAGLIPSVQARRLHRIAQSSDDTMKCFMEKEKMEQLHKKLWIQ AGGDRENIPSIWEAPPSSEPPNNVSTNSEWEAPTQKDKFPKPCNWRKNEFKKW TKLASQGRGIVNFERDKISNHWIQYYRRIPHRKLLTALQLRANVYPTREFLAR GRQDQYIKACRHCDADIESCAHIIGNCPVTQDARIKRHNYICELLLEEAKKKD WVVFKEPHIRDSNKELYKPDLIFVKDARALVVDVTVRYEAAKSSLEEAAAEKV RKYKHLETEVRHLTNAKDVTFVGFPLGARGKWHQDNFKLLTELGLSKSRQVKM AETFSTVALFSSVDIVHMFASRARKSMVM (SEQ ID NO: 1673) |
| *S. pyogenes* Cas9 attached at v2 location of DBD of R2Tg with XTEN33aa linker | *MAPKKKRKVGIHGVPAADKKYSIGLDIGTNSVGWAVITDEYKVPSKKFKVLGN TDRHSIKKNLIGALLFDSGETAEATRLKRTARRRYTRRKNRICYLQEIFSNEM AKVDDSFFHRLEESFLVEEDKKHERHPIFGNIVDEVAYHEKYPTIYHLRKKLV DSTDKADLRLIYLALAHMIKFRGHFLIEGDLNPDNSDVDKLFIQLVQTYNQLF EENPINASGVDAKAILSARLSKSRRLENLIAQLPGEKKNGLFGNLIALSLGLT PNFKSNFDLAEDAKLQLSKDTYDDDLDNLLAQIGDQYADLFLAAKNLSDAILL SDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNG SIPHQIHLGELHAILRRQEDFYPFLKDNREKIEKILTFRIPYYVGPLARGNSR* |

TABLE 53-continued

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
|---|---|
| | *FAWMTRKSEETITPWNFEEVVDKGASAQSFIERMTNFDKNLPNEKVLPKHSLL YEYFTVYNELTKVKYVTEGMRKPAFLSGEQKKAIVDLLFKTNRKVTVKQLKED YFKKIECFDSVEISGVEDRFNASLGTYHDLLKIIKDKDFLDNEENEDILEDIV LTLTLFEDREMIEERLKTYAHLFDDKVMKQLKRRRYTGWGRLSRKLINGIRDK QSGKTILDFLKSDGFANRNFMQLIHDDSLTFKEDIQKAQVSGQGDSLHEHIAN LAGSPAIKKGILQTVKVVDELVKVMGRHKPENIVIEMARENQTTQKGQKNSRE RMKRIEEGIKELGSQILKEHPVENTQLQNEKLYLYYLQNGRDMYVDQELDINR LSDYDVDAIVPQSFLKDDSIDNKVLTRSDKNRGKSDNVPSEEVVKKMKNYWRQ LLNAKLITQRKFDNLTKAERGGLSELDKAGFIKRQLVETRQITKHVAQILDSR MNTKYDENDKLIREVKVITLKSKLVSDFRKDFQFYKVREINNYHHAHDAYLNA VVGTALIKKYPKLESEFVYGDYKVYDVRKMIAKSEQEIGKATAKYFFYSNIMN FFKTEITLANGEIRKRPLIETNGETGEIVWDKGRDFATVRKVLSMPQVNIVKK TEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSL FELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDL SQLGGD*SGGSSGGSSGSETPGTSESATPESSGGSSGGSS**TATRDKKDTVTREK HPKKPFQKWMKDRAIKKGNYLRFQRLFYLDRGKLAKIILDDIECLSCDIPLSE IYSVFKTRWETTGSFKSLGDFKTYGKADNTAFRELITAKEIEKNVQEMSKGSA PGPDGITLGDVVKMDPEFSRTMEIFNLWLTTGKIPDMVRGCRTVLIPKSSKPD RLKDINNWRPITIGSILLRLFSRIVTARLSKACPLNPRQRGFIRAAGCSENLK LLQTIIWSAKREHRPLGVVFVDIAKAFDTVSHQHIIHALQQREVDPHIVGLVS NMYENISTYITTKRNTHTDKIQIRVGVKQGDPMSPLLFNLAMDPLLCKLEESG KGYHRGQSSITAMAFADDLVLLSDSWENMNTNISILETFCNLTGLKTQGQKCH GFYIKPTKDSYTINDCAAWTINGTPLNMIDPGESEKYLGLQFDPWIGIARSGL STKLDFWLQRIDQAPLKPLQKTDILKTYTIPRLIYIADHSEVKTALLETLDQK IRTAVKEWLHLPPCTCDAILYSSTRDGGLGITKLAGLIPSVQARRLHRIAQSS DDTMKCFMEKEKMEQLHKKLWIQAGGDRENIPSIWEAPPSSEPPNNVSTNSEW EAPTQKDKFPKPCNWRKNEFKKWTKLASQGRGIVNFERDKISNHWIQYYRRIP HRKLLTALQLRANVYPTREFLARGRQDQYIKACRHCDADIESCAHIIGNCPVT QDARIKRHNYICELLLEEAKKKDWVVFKEPHIRDSNKELYKPDLIFVKDARAL VVDVTVRYEAAKSSLEEAAAEKVRKYKHLETEVRHLTNAKDVTFVGFPLGARG KWHQDNFKLLTELGLSKSRQVKMAETFSTVALFSSVDIVHMFASRARKSMVM* (SEQ ID NO: 1674) |
| *S. pyogenes* Cas9 containing catalytic mutations (dCas9) attached at v2 location of DBD of R2Tg with XTEN33aa linker | *MAPKKKRKVGIHGVPAADKKYSIGLAIGTNSVGWAVITDEYKVPSKKFKVLGN TDRHSIKKNLIGALLFDSGETAEATRLKRTARRRYTRRKNRICYLQEIFSNEM AKVDDSFFHRLEESFLVEEDKKHERHPIFGNIVDEVAYHEKYPTIYHLRKKLV DSTDKADLRLIYLALAHMIKFRGHFLIEGDLNPDNSDVDKLFIQLVQTYNQLF EENPINASGVDAKAILSARLSKSRRLENLIAQLPGEKKNGLFGNLIALSLGLT PNFKSNFDLAEDAKLQLSKDTYDDDLDNLLAQIGDQYADLFLAAKNLSDAILL SDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNG SIPHQIHLGELHAILRRQEDFYPFLKDNREKIEKILTFRIPYYVGPLARGNSR FAWMTRKSEETITPWNFEEVVDKGASAQSFIERMTNFDKNLPNEKVLPKHSLL YEYFTVYNELTKVKYVTEGMRKPAFLSGEQKKAIVDLLFKTNRKVTVKQLKED YFKKIECFDSVEISGVEDRFNASLGTYHDLLKIIKDKDFLDNEENEDILEDIV LTLTLFEDREMIEERLKTYAHLFDDKVMKQLKRRRYTGWGRLSRKLINGIRDK QSGKTILDFLKSDGFANRNFMQLIHDDSLTFKEDIQKAQVSGQGDSLHEHIAN LAGSPAIKKGILQTVKVVDELVKVMGRHKPENIVIEMARENQTTQKGQKNSRE RMKRIEEGIKELGSQILKEHPVENTQLQNEKLYLYYLQNGRDMYVDQELDINR LSDYDVDAIVPQSFLKDDSIDNKVLTRSDKNRGKSDNVPSEEVVKKMKNYWRQ LLNAKLITQRKFDNLTKAERGGLSELDKAGFIKRQLVETRQITKHVAQILDSR MNTKYDENDKLIREVKVITLKSKLVSDFRKDFQFYKVREINNYHHAHDAYLNA VVGTALIKKYPKLESEFVYGDYKVYDVRKMIAKSEQEIGKATAKYFFYSNIMN FFKTEITLANGEIRKRPLIETNGETGEIVWDKGRDFATVRKVLSMPQVNIVKK TEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSL FELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDL SQLGGD*SGGSSGGSSGSETPGTSESATPESSGGSSGGSS**TATRDKKDTVTREK HPKKPFQKWMKDRAIKKGNYLRFQRLFYLDRGKLAKIILDDIECLSCDIPLSE IYSVFKTRWETTGSFKSLGDFKTYGKADNTAFRELITAKEIEKNVQEMSKGSA PGPDGITLGDVVKMDPEFSRTMEIFNLWLTTGKIPDMVRGCRTVLIPKSSKPD LLQTIIWSAKREHRPLGVVFVDIAKAFDTVSHQHIIHALQQREVDPHIVGLVS NMYENISTYITTKRNTHTDKIQIRVGVKQGDPMSPLLFNLAMDPLLCKLEESG KGYHRGQSSITAMAFADDLVLLSDSWENMNTNISILETFCNLTGLKTQGQKCH GFYIKPTKDSYTINDCAAWTINGTPLNMIDPGESEKYLGLQFDPWIGIARSGL STKLDFWLQRIDQAPLKPLQKTDILKTYTIPRLIYIADHSEVKTALLETLDQK IRTAVKEWLHLPPCTCDAILYSSTRDGGLGITKLAGLIPSVQARRLHRIAQSS DDTMKCFMEKEKMEQLHKKLWIQAGGDRENIPSIWEAPPSSEPPNNVSTNSEW* |

TABLE 53-continued

Re-targeted Gene Writer™ constructs. Examples shown are to re-target R2Tg Gene Writer™ polypeptide sequence to the AAVS1 site using ZF or Cas9 domains.

| Gene Writer™ Polypeptide Name | Polypeptide Sequence (Re-targeting polypeptide sequence, italic; Linker, bold underline) |
|---|---|
| | EAPTQKDKFPKPCNWRKNEFKKWTKLASQGRGIVNFERDKISNHWIQYYRRIP<br>HRKLLTALQLRANVYPTREFLARGRQDQYIKACRHCDADIESCAHIIGNCPVT<br>VVDVTVRYEAAKSSLEEAAAEKVRKYKHLETEVRHLTNAKDVTFVGFPLGARG<br>KWHQDNFKLLTELGLSKSRQVKMAETFSTVALFSSVDIVHMFASRARKSMVM<br>(SEQ ID NO: 1675) |
| *S. pyogenes* Cas9 D10A nickase mutant attached at v2 location of DBD of R2Tg with XTEN33aa linker | *MAPKKKRKVGIHGVPAADKKYSIGLAIGTNSVGWAVITDEYKVPSKKFKVLGN<br>TDRHSIKKNLIGALLFDSGETAEATRLKRTARRRYTRRKNRICYLQEIFSNEM<br>AKVDDSFFHRLEESFLVEEDKKHERHPIFGNIVDEVAYHEKYPTIYHLRKKLV<br>DSTDKADLRLIYLALAHMIKFRGHFLIEGDLNPDNSDVDKLFIQLVQTYNQLF<br>EENPINASGVDAKAILSARLSKSRRLENLIAQLPGEKKNGLFGNLIALSLGLT<br>PNFKSNFDLAEDAKLQLSKDTYDDDLDNLLAQIGDQYADLFLAAKNLSDAILL<br>SDILRVNTEITKAPLSASMIKRYDEHHQDLTLLKALVRQQLPEKYKEIFFDQS<br>KNGYAGYIDGGASQEEFYKFIKPILEKMDGTEELLVKLNREDLLRKQRTFDNG<br>SIPHQIHLGELHAILRRQEDFYPFLKDNREKIEKILTFRIPYYVGPLARGNSR<br>FAWMTRKSEETITPWNFEEVVDKGASAQSFIERMTNFDKNLPNEKVLPKHSLL<br>YEYFTVYNELTKVKYVTEGMRKPAFLSGEQKKAIVDLLFKTNRKVTVKQLKED<br>YFKKIECFDSVEISGVEDRFNASLGTYHDLLKIIKDKDFLDNEENEDILEDIV<br>LTLTLFEDREMIEERLKTYAHLFDDKVMKQLKRRRYTGWGRLSRKLINGIRDK<br>QSGKTILDFLKSDGFANRNFMQLIHDDSLTFKEDIQKAQVSGQGDSLHEHIAN<br>LAGSPAIKKGILQTVKVVDELVKVMGRHKPENIVIEMARENQTTQKGQKNSRE<br>RMKRIEEGIKELGSQILKEHPVENTQLQNEKLYLYYLQNGRDMYVDQELDINR<br>LSDYDVDHIVPQSFLKDDSIDNKVLTRSDKNRGKSDNVPSEEVVKKMKNYWRQ<br>LLNAKLITQRKFDNLTKAERGGLSELDKAGFIKRQLVETRQITKHVAQILDSR<br>MNTKYDENDKLIREVKVITLKSKLVSDFRKDFQFYKVREINNYHHAHDAYLNA<br>VVGTALIKKYPKLESEFVYGDYKVYDVRKMIAKSEQEIGKATAKYFFYSNIMN<br>FFKTEITLANGEIRKRPLIETNGETGEIVWDKGRDFATVRKVLSMPQVNIVKK<br>TEVQTGGFSKESILPKRNSDKLIARKKDWDPKKYGGFDSPTVAYSVLVVAKVE<br>KGKSKKLKSVKELLGITIMERSSFEKNPIDFLEAKGYKEVKKDLIIKLPKYSL<br>FELENGRKRMLASAGELQKGNELALPSKYVNFLYLASHYEKLKGSPEDNEQKQ<br>LFVEQHKHYLDEIIEQISEFSKRVILADANLDKVLSAYNKHRDKPIREQAENI<br>IHLFTLTNLGAPAAFKYFDTTIDRKRYTSTKEVLDATLIHQSITGLYETRIDL<br>SQLGGD*SGGSSGGSSGSETPGTSESATPESSGGSSGGSS*TATRDKKDTVTREK<br>HPKKPFQKWMKDRAIKKGNYLRFQRLFYLDRGKLAKIILDDIECLSCDIPLSE<br>IYSVFKTRWETTGSFKSLGDFKTYGKADNTAFRELITAKEIEKNVQEMSKGSA<br>PGPDGITLGDVVKMDPEFSRTMEIFNLWLTTGKIPDMVRGCRTVLIPKSSKPD<br>RLKDINNWRPITIGSILLRLFSRIVTARLSKACPLNPRQRGFIRAAGCSENLK<br>LLQTIIWSAKREHRPLGVVFVDIAKAFDTVSHQHIIHALQQREVDPHIVGLVS<br>NMYENISTYITTKRNTHTDKIQIRVGVKQGDPMSPLLFNLAMDPLLCKLEESG<br>KGYHRGQSSITAMAFADDLVLLSDSWENMNTNISILETFCNLTGLKTQGQKCH<br>GFYIKPTKDSYTINDCAAWTINGTPLNMIDPGESEKYLGLQFDPWIGIARSGL<br>STKLDFWLQRIDQAPLKPLQKTDILKTYTIPRLIYIADHSEVKTALLETLDQK<br>IRTAVKEWLHLPPCTCDAILYSSTRDGGLGITKLAGLIPSVQARRLHRIAQSS<br>DDTMKCFMEKEKMEQLHKKLWIQAGGDRENIPSIWEAPPSSEPPNNVSTNSEW<br>EAPTQKDKFPKPCNWRKNEFKKWTKLASQGRGIVNFERDKISNHWIQYYRRIP<br>HRKLLTALQLRANVYPTREFLARGRQDQYIKACRHCDADIESCAHIIGNCPVT<br>QDARIKRHNYICELLLEEAKKKDWVVFKEPHIRDSNKELYKPDLIFVKDARAL<br>VVDVTVRYEAAKSSLEEAAAEKVRKYKHLETEVRHLTNAKDVTFVGFPLGARG<br>KWHQDNFKLLTELGLSKSRQVKMAETFSTVALFSSVDIVHMFASRARKSMVM<br>(SEQ ID NO: 1676) |
| *S. pyogenes* Cas9 N863A nickase mutant attached at v2 location of DBD of R2Tg with XTEN33aa linker | *MAPKKKRKVGIHGVPAADKKYSIGLDIGTNSVGWAVITDEYKVPSKKFKVLGN<br>TDRHSIKKNLIGALLFDSGETAEATRLKRTARRRYTRRKNRICYLQEIFSNEM<br>AKVDDSFFHRLEESFLVEEDKKHERHPIFGNIVDEVAYHEKYPTIYHLRKKLV<br>DSTDKADLRLIYLALAHMIKFRGHFLIEGDLNPDNSDVDKLFIQLVQTYNQLF<br>EENPINASGVDAKAILSARLSKSRRLENLIAQLPGEKKNGLFGNLIALSLGLT<br>PNFKSNFDLAEDAKLQLSKDTYDDDLDNLLAQIGDQYADLFLAAKNLSDAILL<br>SDILRVNTEITKAPLSASMIKRYDEHHQDLTLLKALVRQQLPEKYKEIFFDQS<br>KNGYAGYIDGGASQEEFYKFIKPILEKMDGTEELLVKLNREDLLRKQRTFDNG<br>SIPHQIHLGELHAILRRQEDFYPFLKDNREKIEKILTFRIPYYVGPLARGNSR<br>FAWMTRKSEETITPWNFEEVVDKGASAQSFIERMTNFDKNLPNEKVLPKHSLL<br>YEYFTVYNELTKVKYVTEGMRKPAFLSGEQKKAIVDLLFKTNRKVTVKQLKED<br>YFKKIECFDSVEISGVEDRFNASLGTYHDLLKIIKDKDFLDNEENEDILEDIV<br>LTLTLFEDREMIEERLKTYAHLFDDKVMKQLKRRRYTGWGRLSRKLINGIRDK<br>QSGKTILDFLKSDGFANRNFMQLIHDDSLTFKEDIQKAQVSGQGDSLHEHIAN<br>LAGSPAIKKGILQTVKVVDELVKVMGRHKPENIVIEMARENQTTQKGQKNSRE<br>RMKRIEEGIKELGSQILKEHPVENTQLQNEKLYLYYLQNGRDMYVDQELDINR<br>LSDYDVDHIVPQSFLKDDSIDNKVLTRSDKARGKSDNVPSEEVVKKMKNYWRQ<br>LLNAKLITQRKFDNLTKAERGGLSELDKAGFIKRQLVETRQITKHVAQILDSR<br>MNTKYDENDKLIREVKVITLKSKLVSDFRKDFQFYKVREINNYHHAHDAYLNA<br>VVGTALIKKYPKLESEFVYGDYKVYDVRKMIAKSEQEIGKATAKYFFYSNIMN<br>FFKTEITLANGEIRKRPLIETNGETGEIVWDKGRDFATVRKVLSMPQVNIVKK<br>TEVQTGGFSKESILPKRNSDKLIARKKDWDPKKYGGFDSPTVAYSVLVVAKVE* |

TABLE 53-continued

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
|---|---|
| | *KGKSKKLKSVKELLGITIMERSSFEKNPIDFLEAKGYKEVKKDLIIKLPKYSL FELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDL SQLGGD*SGGSSGGSSGSETPGTSESATPESSGGSSGGSS*TATRDKKDTVTREK HPKKPFQKWMKDRAIKKGNYLRFQRLFYLDRGKLAKIILDDIECLSCDIPLSE IYSVFKTRWETTGSFKSLGDFKTYGKADNTAFRELITAKEIEKNVQEMSKGSA PGPDGITLGDVVKMDPEFSRTMEIFNLWLTTGKIPDMVRGCRTVLIPKSSKPD LLQTIIWSAKREHRPLGVVFVDIAKAFDTVSHQHIIHALQQREVDPHIVGLVS NMYENISTYITTKRNTHTDKIQIRVGVKQGDPMSPLLFNLAMDPLLCKLEESG KGYHRGQSSITAMAFADDLVLLSDSWENMNTNISILETFCNLTGLKTQGQKCH GFYIKPTKDSYTINDCAAWTINGTPLNMIDPGESEKYLGLQFDPWIGIARSGL STKLDFWLQRIDQAPLKPLQKTDILKTYTIPRLIYIADHSEVKTALLETLDQK IRTAVKEWLHLPPCTCDAILYSSTRDGGLGITKLAGLIPSVQARRLHRIAQSS DDTMKCFMEKEKMEQLHKKLWIQAGGDRENIPSIWEAPPSSEPPNNVSTNSEW EAPTQKDKFPKPCNWRKNEFKKWTKLASQGRGIVNFERDKISNHWIQYYRRIP HRKLLTALQLRANVYPTREFLARGRQDQYIKACRHCDADIESCAHIIGNCPVT QDARIKRHNYICELLLEEAKKKDWVVFKEPHIRDSNKELYKPDLIFVKDARAL VVDVTVRYEAAKSSLEEAAAEKVRKYKHLETEVRHLTNAKDVTFVGFPLGARG KWHQDNFKLLTELGLSKSRQVKMAETFSTVALFSSVDIVHMFASRARKSMVM (SEQ ID NO: 1677) |
| *S. pyogenes* Cas9 D10A nickase mutant attached at v2 location of DBD of R2Tg containing EN mutation with XTEN33aa linker | *MAPKKKRKVGIHGVPAADKKYSIGLAIGTNSVGWAVITDEYKVPSKKFKVLGN TDRHSIKKNLIGALLFDSGETAEATRLKRTARRRYTRRKNRICYLQEIFSNEM AKVDDSFFHRLEESFLVEEDKKHERHPIFGNIVDEVAYHEKYPTIYHLRKKLV DSTDKADLRLIYLALAHMIKFRGHFLIEGDLNPDNSDVDKLFIQLVQTYNQLF EENPINASGVDAKAILSARLSKSRRLENLIAQLPGEKKNGLFGNLIALSLGLT PNFKSNFDLAEDAKLQLSKDTYDDDLDNLLAQIGDQYADLFLAAKNLSDAILL SDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNG SIPHQIHLGELHAILRRQEDFYPFLKDNREKIEKILTFRIPYYVGPLARGNSR FAWMTRKSEETITPWNFEEVVDKGASAQSFIERMTNFDKNLPNEKVLPKHSLL YEYFTVYNELTKVKYVTEGMRKPAFLSGEQKKAIVDLLFKTNRKVTVKQLKED YFKKIECFDSVEISGVEDRFNASLGTYHDLLKIIKDKDFLDNEENEDILEDIV LTLTLFEDREMIEERLKTYAHLFDDKVMKQLKRRRYTGWGRLSRKLINGIRDK QSGKTILDFLKSDGFANRNFMQLIHDDSLTFKEDIQKAQVSGQGDSLHEHIAN LAGSPAIKKGILQTVKVVDELVKVMGRHKPENIVIEMARENQTTQKGQKNSRE LSDYDVDHIVPQSFLKDDSIDNKVLTRSDKNRGKSDNVPSEEVVKKMKNYWRQ LLNAKLITQRKFDNLTKAERGGLSELDKAGFIKRQLVETRQITKHVAQILDSR MNTKYDENDKLIREVKVITLKSKLVSDFRKDFQFYKVREINNYHHAHDAYLNA VVGTALIKKYPKLESEFVYGDYKVYDVRKMIAKSEQEIGKATAKYFFYSNIMN FFKTEITLANGEIRKRPLIETNGETGEIVWDKGRDFATVRKVLSMPQVNIVKK TEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSL FELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDL SQLGGD*SGGSSGGSSGSETPGTSESATPESSGGSSGGSS*TATRDKKDTVTREK HPKKPFQKWMKDRAIKKGNYLRFQRLFYLDRGKLAKIILDDIECLSCDIPLSE IYSVFKTRWETTGSFKSLGDFKTYGKADNTAFRELITAKEIEKNVQEMSKGSA PGPDGITLGDVVKMDPEFSRTMEIFNLWLTTGKIPDMVRGCRTVLIPKSSKPD RLKDINNWRPITIGSILLRLFSRIVTARLSKACPLNPRQRGFIRAAGCSENLK LLQTIIWSAKREHRPLGVVFVDIAKAFDTVSHQHIIHALQQREVDPHIVGLVS NMYENISTYITTKRNTHTDKIQIRVGVKQGDPMSPLLFNLAMDPLLCKLEESG KGYHRGQSSITAMAFADDLVLLSDSWENMNTNISILETFCNLTGLKTQGQKCH GFYIKPTKDSYTINDCAAWTINGTPLNMIDPGESEKYLGLQFDPWIGIARSGL STKLDFWLQRIDQAPLKPLQKTDILKTYTIPRLIYIADHSEVKTALLETLDQK IRTAVKEWLHLPPCTCDAILYSSTRDGGLGITKLAGLIPSVQARRLHRIAQSS DDTMKCFMEKEKMEQLHKKLWIQAGGDRENIPSIWEAPPSSEPPNNVSTNSEW EAPTQKDKFPKPCNWRKNEFKKWTKLASQGRGIVNFERDKISNHWIQYYRRIP HRKLLTALQLRANVYPTREFLARGRQDQYIKACRHCDADIESCAHIIGNCPVT QDARIKRHNYICELLLEEAKKKDWVVFKEPHIRDSNKELYKPALIFVKDARAL VVDVTVRYEAAKSSLEEAAAEKVRKYKHLETEVRHLTNAKDVTFVGFPLGARG KWHQDNFKLLTELGLSKSRQVKMAETFSTVALFSSVDIVHMFASRARKSMVM (SEQ ID NO: 1678)* |

TABLE 53-continued

Re-targeted Gene Writer ™ constructs. Examples shown are to re-target R2Tg Gene Writer ™ polypeptide sequence to the AAVS1 site using ZF or Cas9 domains.

| Gene Writer ™ Polypeptide Name | Polypeptide Sequence (Re-targeting polypeptide sequence, italic; Linker, bold underline) |
|---|---|
| S. pyogenes Cas9 N863A nickase mutant attached at v2 location of DBD of R2Tg containing EN mutation with XTEN33aa linker | *MAPKKKRKVGIHGVPAADKKYSIGLDIGTNSVGWAVITDEYKVPSKKFKVLGN TDRHSIKKNLIGALLFDSGETAEATRLKRTARRRYTRRKNRICYLQEIFSNEM AKVDDSFFHRLEESFLVEEDKKHERHPIFGNIVDEVAYHEKYPTIYHLRKKLV DSTDKADLRLIYLALAHMIKFRGHFLIEGDLNPDNSDVDKLFIQLVQTYNQLF EENPINASGVDAKAILSARLSKSRRLENLIAQLPGEKKNGLFGNLIALSLGLT PNFKSNFDLAEDAKLQLSKDTYDDDLDNLLAQIGDQYADLFLAAKNLSDAILL SDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNG SIPHQIHLGELHAILRRQEDFYPFLKDNREKIEKILTFRIPYYVGPLARGNSR FAWMTRKSEETITPWNFEEVVDKGASAQSFIERMTNFDKNLPNEKVLPKHSLL YEYFTVYNELTKVKYVTEGMRKPAFLSGEQKKAIVDLLFKTNRKVTVKQLKED YFKKIECFDSVEISGVEDRFNASLGTYHDLLKIIKDKDFLDNEENEDILEDIV LTLTLFEDREMIEERLKTYAHLFDDKVMKQLKRRRYTGWGRLSRKLINGIRDK QSGKTILDFLKSDGFANRNFMQLIHDDSLTFKEDIQKAQVSGQGDSLHEHIAN LAGSPAIKKGILQTVKVVDELVKVMGRHKPENIVIEMARENQTTQKGQKNSRE RMKRIEEGIKELGSQILKEHPVENTQLQNEKLYLYYLQNGRDMYVDQELDINR LSDYDVDHIVPQSFLKDDSIDNKVLTRSDKARGKSDNVPSEEVVKKMKNYWRQ LLNAKLITQRKFDNLTKAERGGLSELDKAGFIKRQLVETRQITKHVAQILDSR MNTKYDENDKLIREVKVITLKSKLVSDFRKDFQFYKVREINNYHHAHDAYLNA VVGTALIKKYPKLESEFVYGDYKVYDVRKMIAKSEQEIGKATAKYFFYSNIMN FFKTEITLANGEIRKRPLIETNGETGEIVWDKGRDFATVRKVLSMPQVNIVKK TEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSL FELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDL SQLGGD*SGGSSGGSSGSETPGTSESATPESSGGSSGGSSTATRDKKDTVTREK HPKKPFQKWMKDRAIKKGNYLRFQRLFYLDRGKLAKIILDDIECLSCDIPLSE IYSVFKTRWETTGSFKSLGDFKTYGKADNTAFRELITAKEIEKNVQEMSKGSA PGPDGITLGDVVKMDPEFSRTMEIFNLWLTTGKIPDMVRGCRTVLIPKSSKPD RLKDINNWRPITIGSILLRLFSRIVTARLSKACPLNPRQRGFIRAAGCSENLK LLQTIIWSAKREHRPLGVVFVDIAKAFDTVSHQHIIHALQQREVDPHIVGLVS NMYENISTYITTKRNTHTDKIQIRVGVKQGDPMSPLLFNLAMDPLLCKLEESG KGYHRGQSSITAMAFADDLVLLSDSWENMNTNISILETFCNLTGLKTQGQKCH GFYIKPTKDSYTINDCAAWTINGTPLNMIDPGESEKYLGLQFDPWIGIARSGL STKLDFWLQRIDQAPLKPLQKTDILKTYTIPRLIYIADHSEVKTALLETLDQK IRTAVKEWLHLPPCTCDAILYSSTRDGGLGITKLAGLIPSVQARRLHRIAQSS DDTMKCFMEKEKMEQLHKKLWIQAGGDRENIPSIWEAPPSSEPPNNVSTNSEW EAPTQKDKFPKPCNWRKNEFKKWTKLASQGRGIVNFERDKISNHWIQYYRRIP HRKLLTALQLRANVYPTREFLARGRQDQYIKACRHCDADIESCAHIIGNCPVT QDARIKRHNYICELLLEEAKKKDWVVFKEPHIRDSNKELYKPALIFVKDARAL VVDVTVRYEAAKSSLEEAAAEKVRKYKHLETEVRHLTNAKDVTFVGFPLGARG KWHQDNFKLLTELGLSKSRQVKMAETFSTVALFSSVDIVHMFASRARKSMVM* (SEQ ID NO: 1679) |
| S. pyogenes Cas9 attached at v2 location of DBD of R2Tg containing EN mutation with XTEN33aa linker | *MAPKKKRKVGIHGVPAADKKYSIGLDIGTNSVGWAVITDEYKVPSKKFKVLGN TDRHSIKKNLIGALLFDSGETAEATRLKRTARRRYTRRKNRICYLQEIFSNEM AKVDDSFFHRLEESFLVEEDKKHERHPIFGNIVDEVAYHEKYPTIYHLRKKLV DSTDKADLRLIYLALAHMIKFRGHFLIEGDLNPDNSDVDKLFIQLVQTYNQLF EENPINASGVDAKAILSARLSKSRRLENLIAQLPGEKKNGLFGNLIALSLGLT PNFKSNFDLAEDAKLQLSKDTYDDDLDNLLAQIGDQYADLFLAAKNLSDAILL SDILRVNTEITKAPLSASMIKRYDEHHQDLTLLKALVRQQLPEKYKEIFFDQS KNGYAGYIDGGASQEEFYKFIKPILEKMDGTEELLVKLNREDLLRKQRTFDNG SIPHQIHLGELHAILRRQEDFYPFLKDNREKIEKILTFRIPYYVGPLARGNSR FAWMTRKSEETITPWNFEEVVDKGASAQSFIERMTNFDKNLPNEKVLPKHSLL YEYFTVYNELTKVKYVTEGMRKPAFLSGEQKKAIVDLLFKTNRKVTVKQLKED YFKKIECFDSVEISGVEDRFNASLGTYHDLLKIIKDKDFLDNEENEDILEDIV LTLTLFEDREMIEERLKTYAHLFDDKVMKQLKRRRYTGWGRLSRKLINGIRDK QSGKTILDFLKSDGFANRNFMQLIHDDSLTFKEDIQKAQVSGQGDSLHEHIAN LAGSPAIKKGILQTVKVVDELVKVMGRHKPENIVIEMARENQTTQKGQKNSRE RMKRIEEGIKELGSQILKEHPVENTQLQNEKLYLYYLQNGRDMYVDQELDINR LSDYDVDHIVPQSFLKDDSIDNKVLTRSDKNRGKSDNVPSEEVVKKMKNYWRQ LLNAKLITQRKFDNLTKAERGGLSELDKAGFIKRQLVETRQITKHVAQILDSR MNTKYDENDKLIREVKVITLKSKLVSDFRKDFQFYKVREINNYHHAHDAYLNA VVGTALIKKYPKLESEFVYGDYKVYDVRKMIAKSEQEIGKATAKYFFYSNIMN FFKTEITLANGEIRKRPLIETNGETGEIVWDKGRDFATVRKVLSMPQVNIVKK TEVQTGGFSKESILPKRNSDKLIARKKDWDPKKYGGFDSPTVAYSVLVVAKVE KGKSKKLKSVKELLGITIMERSSFEKNPIDFLEAKGYKEVKKDLIIKLPKYSL FELENGRKRMLASAGELQKGNELALPSKYVNFLYLASHYEKLKGSPEDNEQKQ LFVEQHKHYLDEIIEQISEFSKRVILADANLDKVLSAYNKHRDKPIREQAENI IHLFTLTNLGAPAAFKYFDTTIDRKRYTSTKEVLDATLIHQSITGLYETRIDL SQLGGD*SGGSSGGSSGSETPGTSESATPESSGGSSGGSSTATRDKKDTVTREK |

TABLE 53-continued

Re-targeted Gene Writer ™ constructs. Examples shown are to re-target
R2Tg Gene Writer ™ polypeptide sequence to the AAVS1 site using ZF or
Cas9 domains.

| Gene Writer ™ Polypeptide Name | Polypeptide Sequence (Re-targeting polypeptide sequence, italic; Linker, bold underline) |
|---|---|
| | HPKKPFQKWMKDRAIKKGNYLRFQRLFYLDRGKLAKIILDDIECLSCDIPLSE IYSVFKTRWETTGSFKSLGDFKTYGKADNTAFRELITAKEIEKNVQEMSKGSA PGPDGITLGDVVKMDPEFSRTMEIFNLWLTTGKIPDMVRGCRTVLIPKSSKPD RLKDINNWRPITIGSILLRLFSRIVTARLSKACPLNPRQRGFIRAAGCSENLK LLQTIIWSAKREHRPLGVVFVDIAKAFDTVSHQHIIHALQQREVDPHIVGLVS NMYENISTYITTKRNTHTDKIQIRVGVKQGDPMSPLLFNLAMDPLLCKLEESG KGYHRGQSSITAMAFADDLVLLSDSWENMNTNISILETFCNLTGLKTQGQKCH GFYIKPTKDSYTINDCAAWTINGTPLNMIDPGESEKYLGLQFDPWIGIARSGL STKLDFWLQRIDQAPLKPLQKTDILKTYTIPRLIYIADHSEVKTALLETLDQK IRTAVKEWLHLPPCTCDAILYSSTRDGGLGITKLAGLIPSVQARRLHRIAQSS DDTMKCFMEKEKMEQLHKKLWIQAGGDRENIPSIWEAPPSSEPPNNVSTNSEW EAPTQKDKFPKPCNWRKNEFKKWTKLASQGRGIVNFERDKISNHWIQYYRRIP HRKLLTALQLRANVYPTREFLARGRQDQYIKACRHCDADIESCAHIIGNCPVT QDARIKRHNYICELLLEEAKKKDWVVFKEPHIRDSNKELYKPALIFVKDARAL VVDVTVRYEAAKSSLEEAAAEKVRKYKHLETEVRHLTNAKDVTFVGFPLGARG KWHQDNFKLLTELGLSKSRQVKMAETFSTVALFSSVDIVHMFASRARKSMVM (SEQ ID NO: 1680) |

Example 10: Inactivation of an Endogenous Nucleolar Localization Signal in a GENE WRITER™

This example describes a GENE WRITER™ in which an endogenous nucleolar localization signal has been inactivated to reduce intracellular targeting of the protein to the nucleolus.

In this example, the nucleolar localization signal (NoLS) of a retrotransposase is computationally predicted using a published algorithm that was trained on validated proteins that localize to the nucleolus (Scott, M. S., et al, Nucleic Acids Research, 38 (21), 7388-7399 (2010)). The predicted NoLS sequence is based on both amino acid sequence, amino acid sequence context, and predicted secondary structure of the retrotransposase. The identified sequence is typically rich with basic amino acids (Scott, M. S., et al, Nucleic Acids Research, 38 (21), 7388-7399 (2010)) and when these residues are mutated to a simple side-chain, non-basic, amino acids or removed from the retrotransposase polypeptide chain then it can prevent localization to the nucleolus (Yang, C. P., et. al., Journal of Biomedical Science, 22 (1), 1-15. (2015), Martin, R. M., et. al., Nucleus, 6 (4), 314-325 (2015)). In some embodiments, the NoLS sequence is located in the amino acid region of a retrotransposase that is between the reverse transcriptase polymerase motif and the restriction-like endonuclease motifs. The predicted NoLS region contains lysine, arginine, histidine, and/or glutamine amino acids where nucleolar localization is inactivated by mutation of one or more of these residues to an alanine amino acid residue and/or one or more of these amino acids are removed from the polypeptide chain of the retrotransposase. In some embodiments, the amino acid sequence of the GENE WRITER™ driver of R2Tg found upstream of the RLE is mutated such that lysines (K) are substituted for alanines (A), e.g., the predicted NoLS of R2Tg (amino acids 1,128-1,154 of polypeptide sequence), (APTQKDKFPKPCNWRKNEFKKWTKLAS (SEQ ID NO: 1681)) is mutated at 1, 2, 3, 4, 5, 6, or 7 residues to produce an inactivated NoLS (APTQADAFPAPCNWRANEFAAWTALAS (SEQ ID NO: 1682)).

Example 11: Application of Second-Strand Nicking in a GENE WRITER™ System

This example describes a GENE WRITER™ system in which retrotransposition is paired with targeted second-strand nicking activity in order to increase the efficiency of integration events. The second strand nick can be achieved by (1) a Cas9 nickase fused to a GENE WRITER™ system, in which the GENE WRITER™ introduces one nick through its endonuclease domain (EN), and the fused nickase Cas9 places another nick on either the top and bottom DNA strands (FIG. 7A), or (2) a GeneWriter system in which the active EN domain introduces a nick, and a Cas9 nickase introduces a second nick on either top or bottom strand of the DNA, upstream or downstream of the GENE WRITER™ induced nick (FIG. 7B).

Figure 7A:
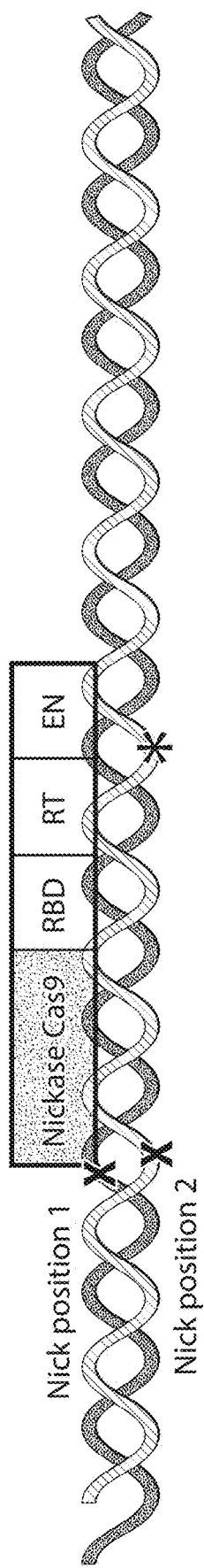
FIGS. 7A and 7B are diagrams showing an exemplary second strand nicking process.
Figure 7B:
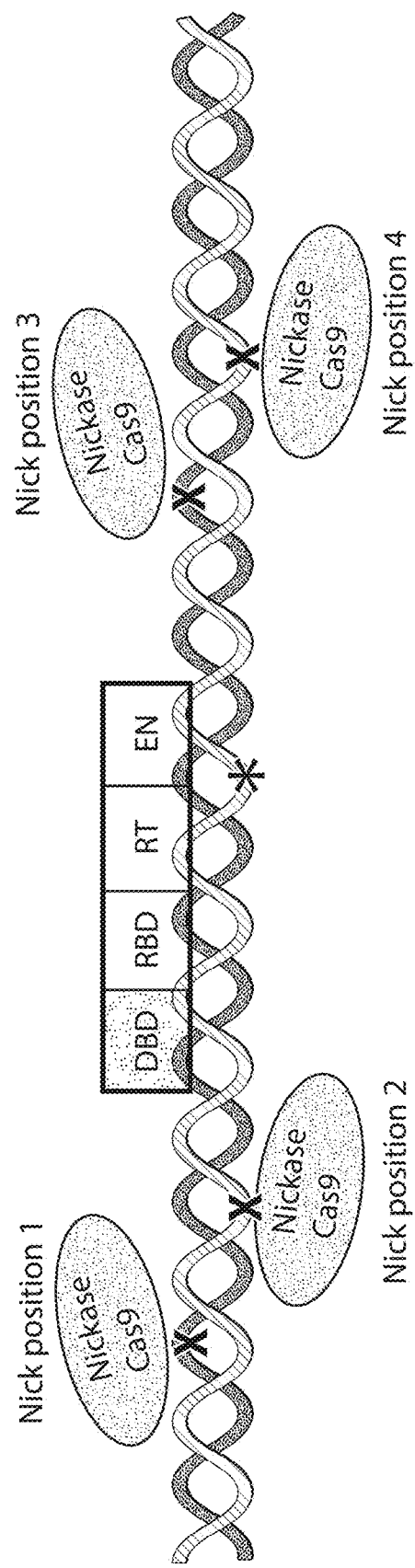

In the first part of this example, a Cas9 nickase is fused to a GENE WRITER™ protein (FIG. 7A). The Cas9 is targeted to a DNA sequence through a gRNA. The GENE WRITER™ protein introduces a DNA nick through its EN domain, and an additional nick is generated through the nickase Cas9 activity. This additional nick can be targeted to the top or bottom strands of the DNA surrounding the GENE WRITER™ introduced nick (FIG. 8A). Constructs designed and tested include (see schematic FIG. 14A):
  Cas9-N863A-R2tg (RBD*, RT, EN)
  Cas9-H840A-R2tg (RBD*, RT, EN)
  Cas9-D10A-R2tg (RBD*, RT, EN)
  dCas9-R2tg (RBD*, RT, EN)

The DNA binding domain is the nickase Cas9 that directs the GENE WRITER™ molecule to a DNA target through a gRNA. The RNA binding domain (RBD) in this set of GENE WRITER™ constructs is inactivated with a point mutation (RBD*). As a donor for insertion, constructs in which the R2Tg RNA binding domain is inactive use a gRNA that is extended at its 3' end to include donor sequence for genome modification (FIG. 14B). These modifications include nucleotide substitutions, nucleotide deletions and nucleotide insertions. In this first set of experiments, the above constructs-R2Tg (RBD*, RT, EN) and dCas9-R2Tg (RBD*, RT, EN) fusions with a 3' extended gRNA template targeting the AAVS1 locus are delivered to U2OS cells through nucleofection in SE buffer using program DN100. gRNAs used include gRNAs for each construct that target either the bottom or top strand of DNA. After nucleofection, cells are grown in complete medium for 3 days. gDNA is harvested on day 3, and amplicon sequencing followed by computational analysis using CRISPResso (indel analysis tool) are performed. 3' extended gRNA mediated insertions, deletions or nucleotide substitutions are observed upon delivery of dCas9-R2Tg (RBD*, RT, EN), and increased in frequency when delivering Nickase-Cas9-R2Tg (RBD*, RT, EN) constructs.

In the second part of this example, a Cas9 nickase is fused to a GENE WRITER™ protein (FIG. 7A). The Cas9 is targeted to a DNA sequence through a gRNA. The GENE WRITER™ protein introduces a DNA nick through its EN domain, and an additional nick is generated through the nickase Cas9 activity. This additional nick can be targeted to the top or bottom strands of the DNA surrounding the GENE WRITER™ introduced nick (FIG. 7A). In contrast to the constructs listed above, the RNA binding domain of R2Tg is active (FIG. 15A), and the template used for genome modification is a transgene flanked by UTRs (FIG. 15B). Constructs include (see schematic FIG. 15A):
  Cas9-N863A-R2tg (RBD, RT, EN)
  Cas9-H840A-R2tg (RBD, RT, EN)
  Cas9-D10A-R2tg (RBD, RT, EN)
  dCas9-R2tg (RBD, RT, EN)

The transgene flanked by UTRs requires homology arms at the site of nicking. To determine the site of nicking for the accurate design of homology arms for the donor transgene DNA, the above listed constructs are nucleofected into 200k U2OS cells with a gRNA targeting the AAVS1 locus using pulse code DN100. After nucleofection, cells are grown in complete medium for 3 days. gDNA is harvested on day 3, and amplicon sequencing followed by computational analysis using CRISPResso as an indel analysis tool are performed. The nicking site of the EN domain is identified from the indels the EN domain produces at the AAVS1 site. Homology arms of 100 bp flanking the EN nicking site are designed and included in the transgene. To achieve genome modification, Cas9-R2Tg fusion constructs listed above are nucleofected into U2OS cells, along with a gRNA targeting either the top or bottom strand of the AAVS1 locus, and the appropriate transgenes harboring homology to the previously determined nicking site. After nucleofection, cells are grown in complete medium for 3 days. gDNA is harvested on day 3, and ddPCR is performed to detect transgene integration at the AAVS1 site. Integrations are observed upon delivery of dCas9-R2Tg (RBD, RT, EN), and increased in frequency when delivering Nickase-Cas9-R2Tg (RBD, RT, EN) constructs.

Figure 16A:
FIGS. 16A-16C. Schematic of constructs.
Figure 16B:
Figure 16C:
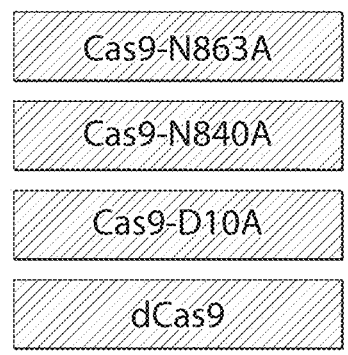

In another example, a GENE WRITER™ protein is targeted to DNA through its DNA binding domain (FIG. 7B). The GENE WRITER™ protein will introduce a DNA nick at a DNA strand. In addition, a Cas9 nickase is used to generate a second nick either on the top or bottom strands of the DNA, upstream or downstream of the first nick. In this example, a GENE WRITER™ plasmid targeting the AAVS1 site (FIG. 16A) and with a UTR flanked transgene with homology to the AAVS1 site (FIG. 16B) is nucleofected into 200k U2OS cells using pulse code DN100. The following Cas9 constructs are transfected alongside the GENE WRITER™ plasmids (FIG. 16C):
  Cas9-N863A
  Cas9-H840A
  Cas9-D10A
  dCas9

All Cas9 constructs are co-nucleofected with gRNAs targeting the AAVS1 locus on either the top or bottom strands, upstream or downstream of the GENE WRITER™ introduced nick. After nucleofection, cells are grown in complete medium for 3 days. gDNA is harvested on day 3, and ddPCR is performed to detect transgene integration at the AAVS1 site. Integrations are observed upon delivery of dCas9 and increased in frequency when delivering Nickase-Cas9 constructs.

Example 12: Improved Expression of GENE WRITER™ Polypeptide by Heterologous UTRs This example describes the use of heterologous UTRs to enhance the intracellular expression of the GENE WRITER™ polypeptide.

Figure 17A:
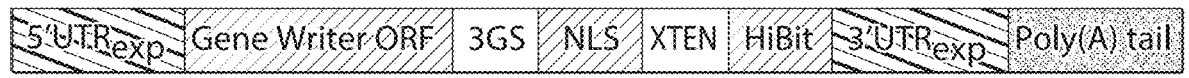
FIGS. 17A and 17B. The schematics for mRNA encoding GENE WRITER™ (FIG. 17A). The native untranslated regions (UTRs) were replaced by 5' and 3' UTRs optimized for the protein expression (shown as 5' UTRexp and 3' UTRexp). The GENE WRITER™ protein expression was assayed by HiBit assay by probing HiBit tag expression (FIG. 17B). This Figure discloses "3GS" as SEQ ID NO: 1024.
Figure 17B:
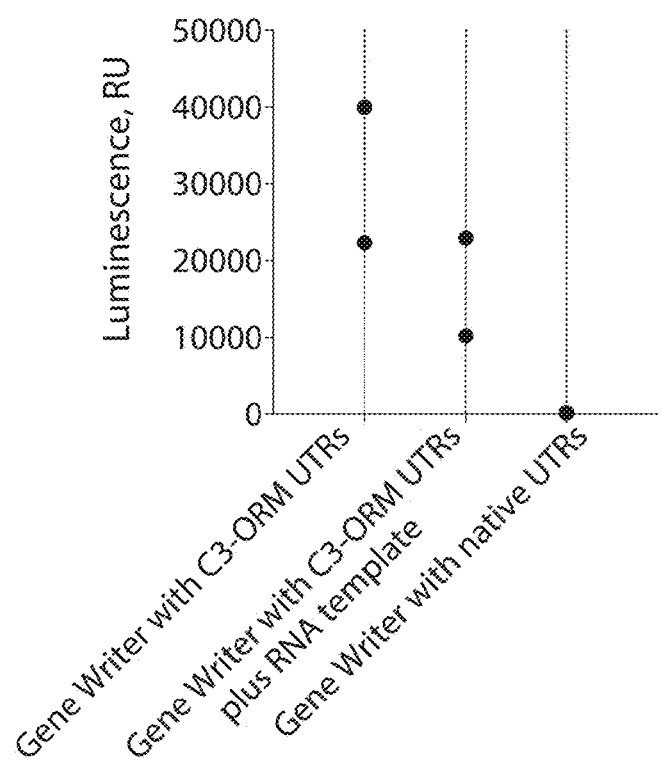

In this example, the GENE WRITER™ polypeptide was expressed from mRNA (FIG. 17). In the plasmid template for the mRNA production, the native retrotransposon UTRs were replaced with UTRs optimized for the protein expression (C3 5'UTR and ORM 3' UTR from Asrani et al., RNA biology 15, 756-762 (2018) or 5' and 3' UTRs from Richter et al., Cell 168, 1114-1125 (2017)). The plasmid included the T7 promoter followed by the 5'UTR, the retrotransposon coding sequence, the 3' UTR, 3GS linker (SEQ ID NO: 1024), SV40 nuclear localization signal (NLS), XTEN linker, HiBit sequence and 96-100 nucleotide long poly(A) tail (SEQ ID NO: 1683). The plasmid was linearized by enzymatic restriction resulting in blunt end or 5' overhang downstream of poly(A) tail and used for in vitro transcription (IVT) using T7 polymerase (NEB). Following the IVT step the RNA was treated with DNase I (NEB). After the buffer exchange step the enzymatic capping reaction was performed using Vaccinia capping enzyme (NEB) and 2'-O-methyltransferase (NEB) in the presence of GTP and SAM (NEB). The capped RNA was concentrated and buffer exchanged. 50,000 HEK293T cells were transfected with 0.5 µg with the GENE WRITER™ mRNA in the presence or in the absence of the RNA template in 1:1 molar ratio using Neon transfection system (1150 V per pulse, 20 msec per pulse, 2 pulses in 10 µL tips in 96 well format). The RNA template was in vitro transcribed from plasmid as described in Example 14 (Improved GENE WRITER™ components for RNA-based delivery).

Figure 18:
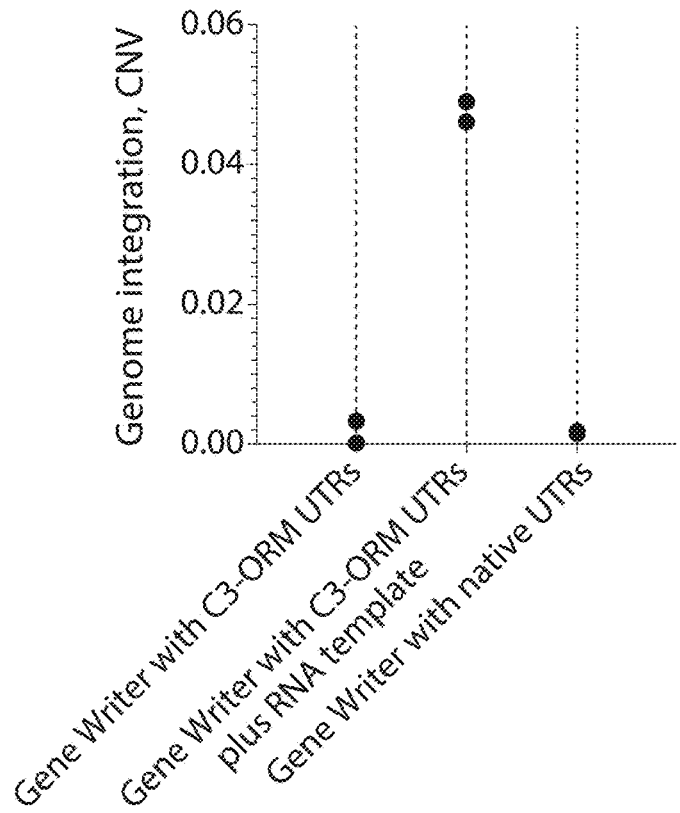
FIG. 18. Genome integration induced by GENE WRITER™ protein with its native UTRs and UTRs optimized for the protein expression. The GENE WRITING™ activity with non-native UTRs is stimulated by the presence of the RNA template bearing the retrotransposon native UTRs.

After transfection HEK293T cells were grown for 5 hours before assaying the GENE WRITER™ expression by probing its HiBit tag expression using standard protocol www.promega.com/-/media/files/resources/protocols/technical-manuals/500/nano-glo-hibit-lytic-detection-system-technical-manual.pdf?la=en. Protein expression was found to be greatly improved by the use of 5' and 3' UTR$_{exp}$ from C3-ORM as compared to using the native UTRs from R2Tg (FIG. 17). The genome integration was assayed 3 days post-transfection using 3' ddPCR (FIG. 18).

Example 13: Improved GENE WRITER™ Components for Mixed RNA and DNA Delivery

This example describes improvements to the RNA molecule encoding a GENE WRITER™ polypeptide that enhance expression and allow for increased efficiency of retrotransposition when used with a GENE WRITER™ template encoded on plasmid DNA.

In this example, the polypeptide component of the GENE WRITER™ system is expressed from mRNA described in Example 12 (Improved expression of GENE WRITER™ polypeptide by heterologous UTRs). The plasmid template was synthesized such that the reporter gene (cGFP) was flanked by R2Tg untranslated regions (UTRs) and 100 bp of homology to its rDNA target. The template expression was driven by the mammalian CMV promoter. We introduced the plasmid into HEK393T cells using the FuGENE® HD transfection reagent. HEK293T cells were seeded in 96-well plates at 10,000 cells/well 24 hours before transfection. On the transfection day, 0.5 µl transfection reagent and 80 ng DNA was mixed in 10 µl Opti-MEM and incubated for 15 minutes at room temperature. The transfection mixture was then added to the medium of the seeded cells. Cells were detached and used for the electroporation of 0.5 µg of mRNA per well using Neon transfection system (1150 V per pulse, 20 msec per pulse, 2 pulses in 10 µL tips in 96 well format).

HEK293T cells were transfected with the following test agents:
1. mRNA coding for the polypeptide described above
2. Plasmid encoding template RNA described above
3. Combination of 1 and 2. The plasmid was pre-lipofected 24 hrs before mRNA transfection as described above.

Figure 19:
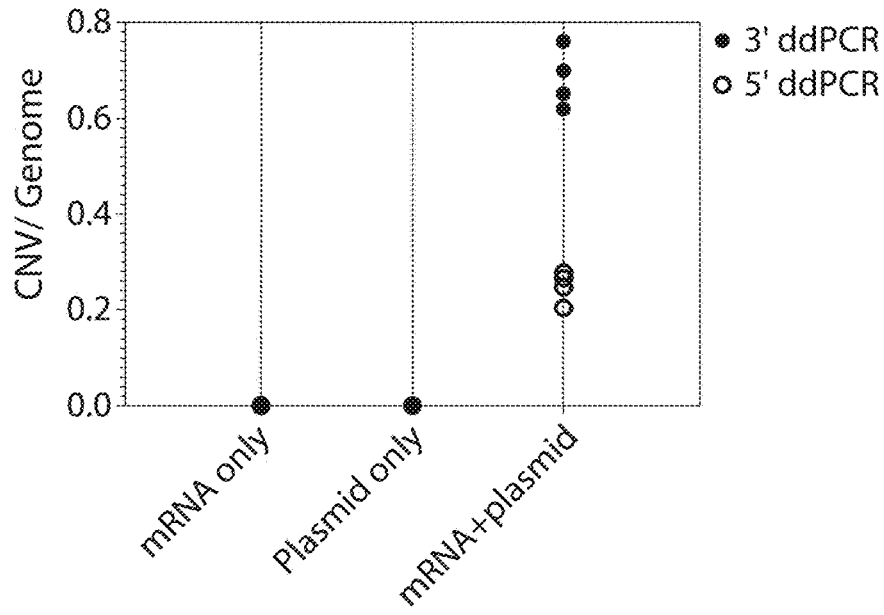
FIG. 19. Delivery of GENE WRITER™ system using mRNA encoding the polypeptide and plasmid DNA encoding the RNA template for retrotransposition.

After transfection, HEK293T cells were cultured for 1-3 days and then assayed for site-specific genome editing. Genomic DNA was isolated from each group of HEK293 cells. ddPCR was performed to confirm integration and assess integration efficiency. Taqman probes and primers were designed as described in PCT/US2019/048607 to amplify the expected product across 5' and 3' ends of integration junctions. The results of the ddPCR copy number analysis (in comparison to reference gene RPP30) are shown in FIG. 19. The genome integration in the presence of the mRNA and the template plasmid achieved a mean copy number of 0.683 integrants/genome when targeting 3' junction and of 0.249 integrants/genome when targeting 5' junction. The mRNA only transfection resulted in a mean copy number of 0.002 integrants/genome, in comparison to 0.0004 integrants/genome for the plasmid only transfection.

Example 14: Improved GENE WRITER™ Components for RNA-Based Delivery

This example describes improvements to the RNA molecule encoding a GENE WRITER™ polypeptide that enhance expression and allow for increased efficiency of retrotransposition when co-delivered with a GENE WRITER™ RNA template.

In this example, the polypeptide component of the GENE WRITER™ system is expressed from mRNA described in Example 12 (Improved expression of GENE WRITER™ polypeptide by heterologous UTRs). The plasmid template for the RNA template production included T7 promoter followed by the IRES-expressing reporter gene (cGFP) flanked by R2Tg untranslated regions (UTRs) and 100 bp of homology to its rDNA target. The plasmid template was linearized by enzymatic restriction resulting in blunt end or 5' overhang downstream of the RNA template sequence and used for in vitro transcription (IVT) using T7 RNA polymerase (NEB). Following the IVT step the RNA was treated with DNase I (NEB) and either enzymatically polyadenylated by poly(A) polymerase (NEB) or not. After the buffer exchange step the enzymatic capping reaction was performed using Vaccinia capping enzyme (NEB) and 2'-O-methyltransferase (NEB) in the presence of GTP and SAM (NEB). The capped RNA was concentrated and buffer exchanged. 50,000 HEK293T cells were co-transfected with 0.5 to 1 µg of the GeneWriter mRNA and the RNA template in 1:4 to 1:12 molar ratios. The Neon transfection system was used for the RNA transfection (1150 V per pulse, 20 msec per pulse, 2 pulses in 10 µL tips in 96 well format).

After transfection, HEK293T cells were cultured for at least 1 day and then assayed for site-specific genome editing. Genomic DNA was isolated from each group of HEK293 cells. ddPCR was performed to confirm integration and assess integration efficiency. Taqman probes and primers were designed as described in PCT/US2019/048607 to amplify the expected product across 5' and 3' ends of integration junctions. The mean copy number of 0.498 integrants/genome was achieved in the presence of the 0.5 µg of mRNA and 1:8 molar ratio of GENE WRITER™ mRNA to the RNA template when the RNA template was enzymatically polyadenylated, in comparison to that of 0.031 integrants/genome when the RNA transgene was not polyadenylated.

Example 15: GENE WRITER™ Genome Editor Polypeptides that Deliver Genetic Cargo Containing Introns This example describes the use of a GENE WRITER™ system to integrate genetic cargo that contains introns by using RNA-based delivery to tune expression of the gene of interest from its newly introduced genomic locus.

In this example, GENE WRITING™ technology uses an RNA template encoding a protein of interest including its native or non-native introns. For example, intron 6 of the triose phosphate isomerase (TPI) gene (Nott et al., 2003) will be used as one of the non-native introns in these experiments.

The presence of introns in the genomic copy of a gene and their removal by splicing has been reported to affect nearly every aspect of the gene expression, including its transcription rate, the mRNA processing, export, cell localization, translation and decay (reviewed in Shaul International Journal of Biochemistry and Cell Biology 91B, 145-155 (2017)). The introns can be inserted into different parts of the RNA template (FIG. 21) and depending on the intron location their role in gene expression can differ.

An intron in the 5' $UTR_{exp}$, close to the transcription start site, introduces activating chromatin modifications (Bieberstein et al., Cell Reports 2, 62-68 (2012)), improves accuracy of transcription start site recognition and facilitates PolII recruitment (Laxa et al., Plant Physiology 172, 313-327 (2016)), increases rates of transcription initiation (Kwek et al., Nature Structural Biology 9, 800-805 (2002)) and elongation (Lin et al., Nature Structural and Molecular Biology 15, 819-826 (2008)), and improve the productive elongation in the sense relative to the antisense orientation (Almada et al., Nature 499, 360-363 (2013)).

An intron in the 3' $UTR_{exp}$ limits the mRNA expression to one protein molecule per mRNA: the exon junction complex (EJC) left by spliceosome downstream of stop codon is recognized by the nonsense-mediated decay (NMD) machinery and therefore the mRNA is marked for deletion at the end of the pioneering round of translation (Zhang et al., RNA 4, 801-815 (1998)).

The ability to employ introns in a therapeutic gene may, however, be limited by splicing that occurs prior to integration of the template. For example, an intron in the forward orientation would be spliced out when an RNA template was encoded and delivered on a DNA plasmid, since transcription in the same direction would yield a template RNA that would be spliced prior to integration, thus failing to incorporate the intron in the genome. Additionally, lentivirus constructs designed to deliver a transgene must encode a sequence with an intron in the reverse orientation, since the viral packaging process would result in intron splicing and absence of the intron in packaged viral particles (Miller et al. J Virol 62, 4337-45 (1988)). However, the reverse orientation has also been thought to result in a reduction in viral titer and transduction (Uchida et al., Nat Commun 10, 4479 (2019)). It is worth noting that since the GENE WRITER™ template can be generated through in vitro transcription and delivered directly as RNA, the problem of pre-integration splicing of desired introns can be avoided. In some embodiments, the GENE WRITER™ template may thus contain one or more introns in same-sense orientation with the transcript, which is generated by IVT and delivered to the target cell as RNA.

Figure 21:
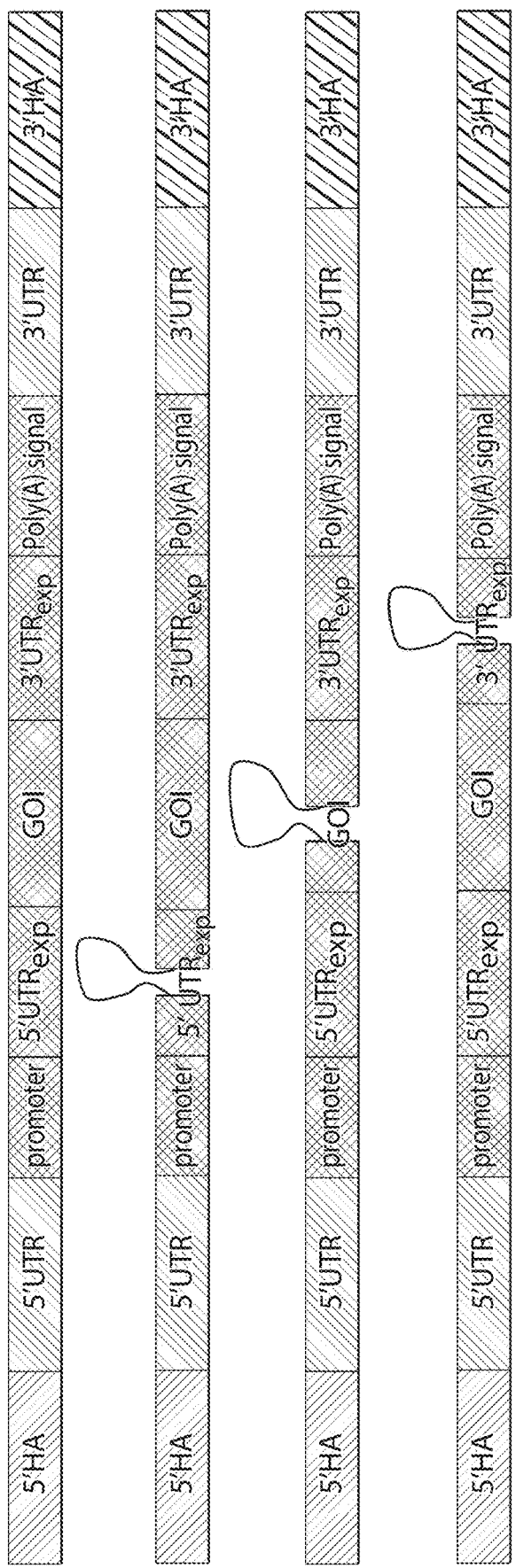
FIG. 21. Possible location of an intron (or introns) within the RNA template. Introns are shown by curved lines. 5'HA: 5' homology arm; 3' HA: 3' homology arm; 5' UTR: Retrotransposon-specific 5'UTR; 3' UTR: Retrotransposon-specific 3' UTR; GOI: gene of interest. Orange blocks correspond to the sequence designed to be expressed from the genomic location harboring its own cell specific promoter, poly(A) signal and UTRs for the protein expression (5' and 3' UTR$_{exp}$). The sequence can be oriented in the sense (shown above) or the antisense orientation related to retrotransposon UTRs and homology arms. The intron can be located within GOI, or within UTR$_{exp}$.

An intron in any location depicted in FIG. 21 will recruit U1 snRNP that protects mRNA from the premature cleavage and polyadenylation (Kaida et al., Nature 468 664-681 (2010); Berg et al., Cell 150, 53-64 (2012)). In addition, the EJC interacts with components of the TREX (transcription-export) complex and increases the rate of mRNA export from nucleus to cytoplasm 6-10-fold in comparison to the constructs lacking introns (Valencia et al., PNAS 105, 3386-3391 (2008)). It was also demonstrated that the binding of the polypyrimidine tract-binding protein, a splicing regulator protein, mediates a significant increase in the half-life of the spliced transcripts (Lu & Cullen, RNA 9, 618-630 (2003); Millevoi et al., Nucleic Acid Research 37, 4672-4683 (2009)). The efficiency of the mRNA translation was shown to be increased by the presence of the SR proteins (serine-arginine rich proteins, involved in RNA splicing) (Sanford et al., Genes & Development 18, 755-768 (2004); Sato et al., Molecular Cell 29, 255-262 (2008)) and the EJC proteins and its peripheral factors (Nott et al., Genes & Development 18, 210-222 (2004)).

In this example both the template RNAs harboring an intron or introns and GENE WRITER™ polypeptide are delivered to the cells as in vitro transcribed capped RNAs as described in Example 14 (Improved GENE WRITER™ components for RNA-based delivery). One to three days post-transfection the GOI expression and the genomic integration are assayed.

In some embodiments, the genome integration and/or protein expression will be higher for the intron-containing RNA template.

Example 16: Engineering of the Retrotransposon 5' UTR to Improve Efficiency of Integration This example describes the deletion, replacement, or mutation of the 5'UTR of a retrotransposon to increase integration efficiency.

Figure 27A:
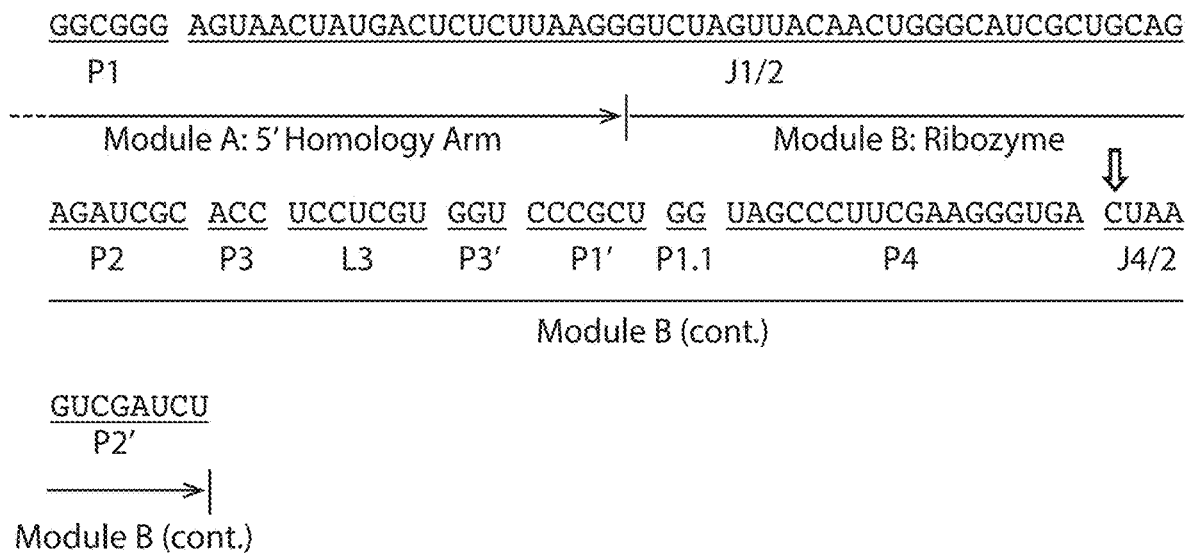
FIGS. 27A and 27B.
Figure 27B:
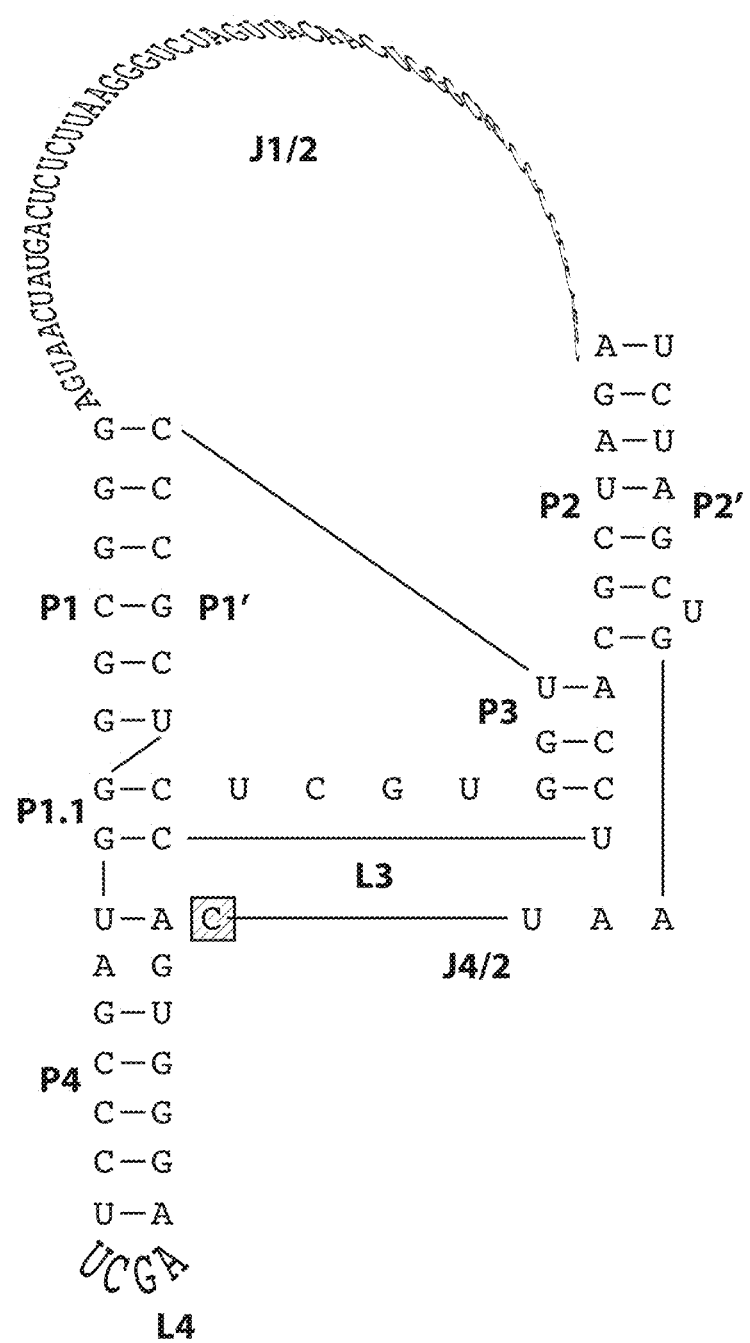
Figure 28:
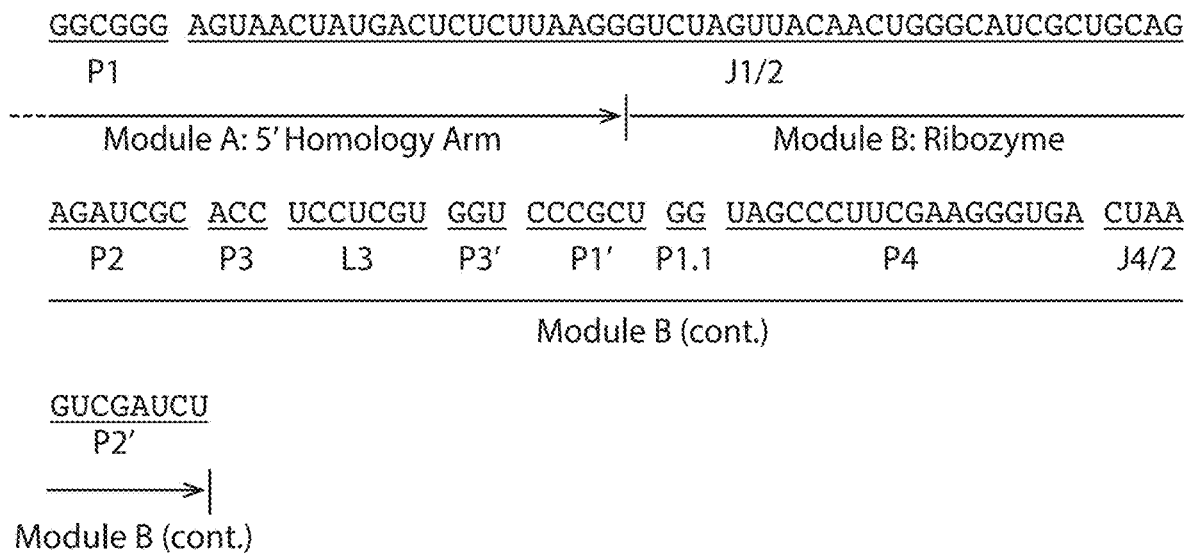
FIG. 28. Sequence map of Ribozyme of R2 element from *Taeniopygia guttata* (R2Tg) in context of modules of GENE WRITER™ transgene molecule RNA. The Ribozyme features are denoted as: P, based paired region; P', based pair region complement strand; L, loop at end of P region; J, nucleotides joining base paired regions. Figure discloses SEQ ID NO: 1734.
Figure 29:
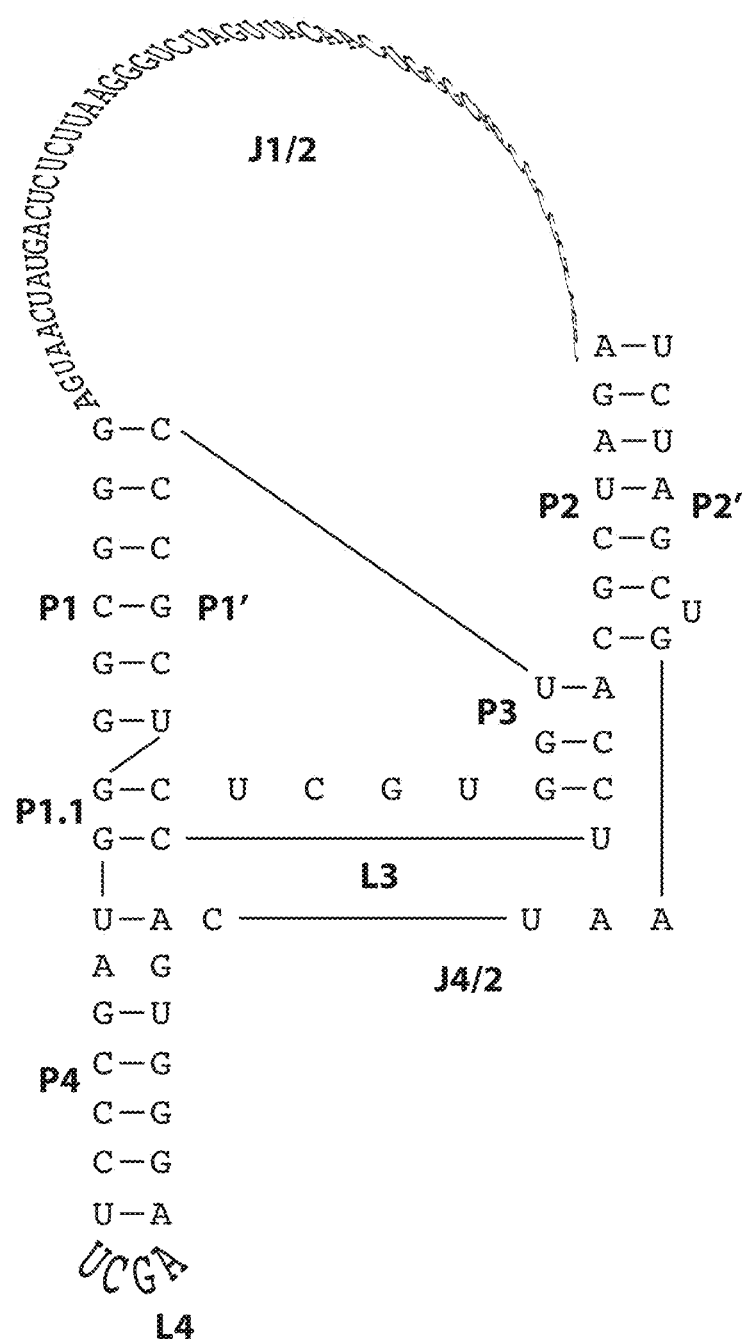
FIG. 29. Prediction of ribozyme secondary structure of R2 element from *Taeniopygia guttata*. Figure discloses SEQ ID NO: 1734.

The 5'UTR region of non-LTR retrotransposons has multiple functions including self-cleaving ribozyme activity, which has been shown in certain elements and is predicted in additional retrotransposons (see modules B and C of FIG. 27-28) (Ruminski et al. J Biol Chem 286, 41286-41295 (2011)). Ribozymal activity is predicted to cleave the RNA within or upstream of the 5'UTR. Either increasing or restricting this activity and structural component of the 5'UTR may benefit retrotransposition efficiency. A prediction of the ribozyme structure of R2Tg is provided in FIG. 29.

Figure 20:
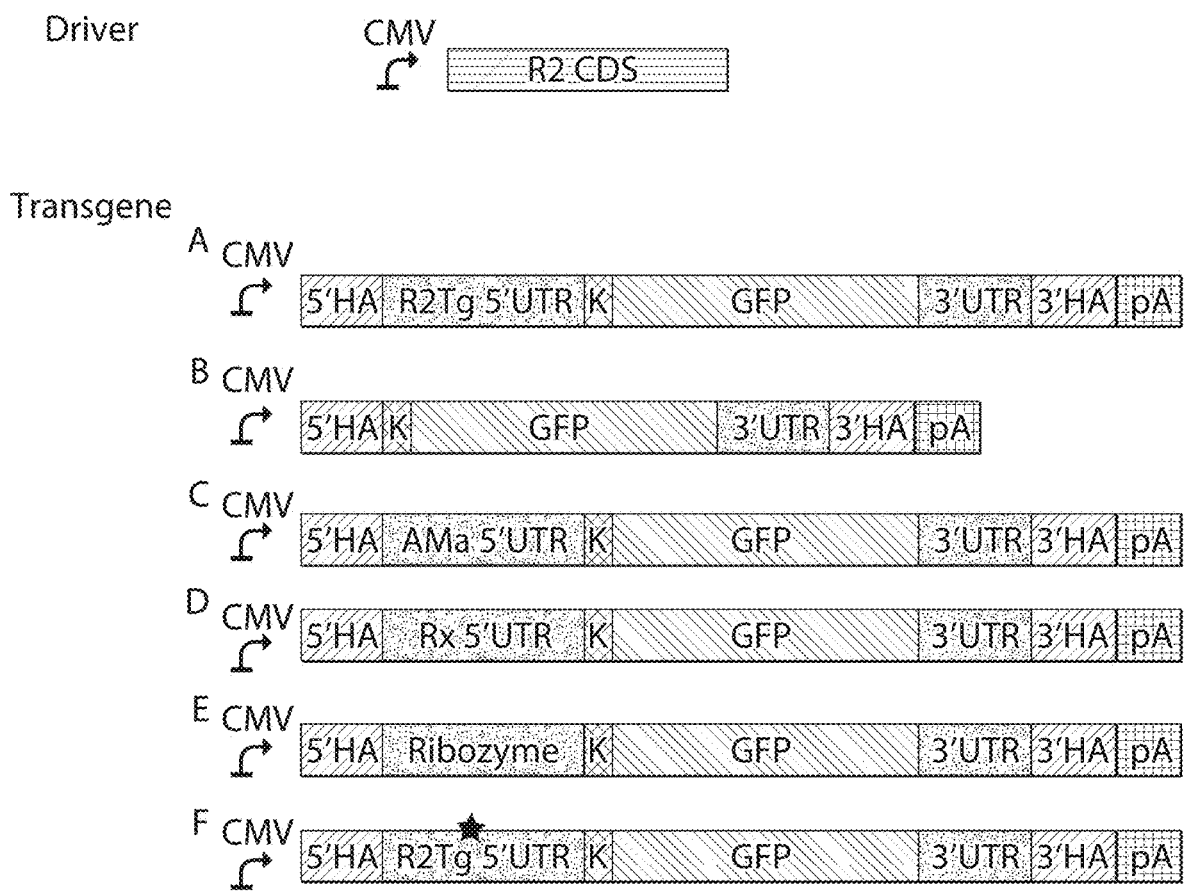
FIG. 20. Diagrams of example 5'UTR engineering strategies. HA=homology arm; K=Kozak sequence; pA=poly A signal; AMa=A. maritima; Rx=other species of retrotransposon.

In order to evaluate engineering of the 5'UTR, constructs were designed to enhance or diminish these activities (FIG. 20). In case (A), the natural 5'UTR of R2Tg is used to integrate in trans as in previous experiments. Case (B) illustrates deletion of the 5'UTR. (C) and (D) represent cases in which the 5'UTR from the original species (in this case R2Tg from *T. guttata*) has been replaced by the 5'UTR of a retrotransposon from a distinct species. Case (C) provides an example in which the 5'UTR from *A. maritima* R2 has replaced that of R2Tg. (D) represents the generic case in which UTRs from additional species may be substituted ("Rx"), such as that from *B. mori, D. ananasse, F. auricularia, L. polyphemus, N. giraulti,* or *O. latipes*, or from a retrotransposon selected from a Table herein, or any of Tables 1-3 of PCT/US2019/048607, herein incorporated by reference in its entirety. Case (E) represents the substitution of a ribozyme, such as a hammerhead ribozyme, e.g., RiboJ (Lou et al Nat Biotechnol 30, 1137-1142 (2012)). Case (F) represents the inactivation of the 5'UTR of R2Tg through point mutations, e.g., 75C>T in the 5' UTR (FIG. 20.B, position indicated by shaded box). 5'UTR sequences are expected to be modular to any insertion sequence mediated by the retrotransposon.

Each case is evaluated as in previous examples by transfection of GENE WRITER™ polypeptide plasmid with template plasmid and evaluation of integration frequency via ddPCR. In some embodiments, substitution or mutation of the 5' UTR results in increased efficiency of integration.

Example 17: Modifying the 5' and 3' Ends of GENE WRITER™ RNA Components to Improve RNA Stability This example describes the addition of non-coding sequences to the 5' and 3' ends of RNA in order to improve stability in a mammalian cell.

The decay of eukaryotic RNAs in cells are mostly carried out by exoribonucleases. In this example, the half-life of RNAs is prolonged by introducing protective sequences and/or modifications at their 5' and 3' ends. The most common natural way of protecting the RNA ends is by introduction of 5' cap structure and 3' poly(A) tail. In this example, the polypeptide component of the GENE WRITER™ system is expressed from mRNA described in Example 12 (Improved expression of GENE WRITER™ polypeptide by heterologous UTRs). The plasmid template for the RNA template production included T7 promoter followed by the IRES-expressing reporter gene (cGFP) flanked by R2Tg untranslated regions (UTRs) and 100 bp of homology to its rDNA target. The plasmid template was linearized by enzymatic restriction resulting in blunt end or 5' overhang downstream of the RNA template sequence and used for in vitro transcription (IVT) using T7 polymerase (NEB). Following the IVT step the RNA was treated with DNase I (NEB) and either enzymatically polyadenylated by poly(A) polymerase (NEB) or not. After the buffer exchange step the enzymatic capping reaction resulting in cap 1 structure was performed as described in Example 14 (Improved GENE WRITER™ components for RNA-based delivery) or not performed. The template RNA was concentrated and buffer exchanged. 50,000 HEK293T cells were co-transfected with 0.5 µg with the GeneWriter mRNA and the RNA template in 1:1 to 1:8 molar ratios using Neon transfection system (1150 V per pulse, 20 msec per pulse, 2 pulses in 10 µL tips in 96 well format).

Figure 22:
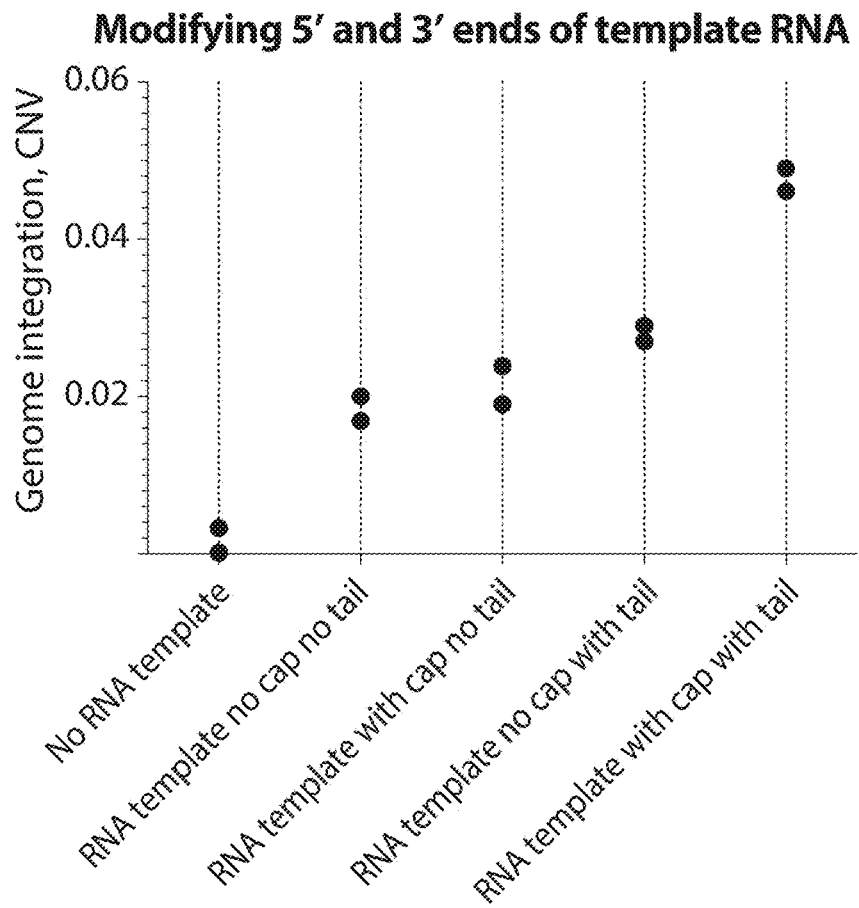
FIG. 22. Genome integration in HEK293T cells as reported by 3' ddPCR assay. The GENE WRITER™ mRNA at 0.5 μg/well was co-transfected with the RNA templates with or without enzymatically added cap 1 and the poly(A) tail. The GENE WRITER™ mRNA to RNA transgene ratio was 1:1.

After transfection, HEK293T cells were cultured for 1-3 days and then assayed for site-specific genome editing. Genomic DNA was isolated from each group of HEK293 cells. ddPCR was performed to confirm integration and assess integration efficiency. Taqman probes and primers were designed as described in PCT/US2019/048607 to amplify the expected product across 3' end of integration junctions. The genome integration was improved when the enzymatically capped and poly(A) tailed template was used (FIG. 22).

The mean copy number of 0.498 integrants/genome was achieved in the presence of the 0.5 µg of mRNA and 1:8 molar ratio of mRNA: RNA template when the RNA template was enzymatically polyadenylated, in comparison to that of 0.031 integrants/genome when the RNA transgene was not enzymatically polyadenylated.

3' End Modifications of RNAs.

It has been reported that the interactions between poly(A) tail shorter than 15-20 nts and the poly(A) binding protein (PABP) are destabilized resulting in the fast degradation of the RNA (Chang et al., Molecular Cell 53, 1044-1052 (2014); Subtelny et al., Nature 508, 66-71 (2014)). To determine the suitable lengths of the poly(A) tail of the template RNA we will test its lengths of 30, 40, 50, 60, 70, 80, 90 and 100 nucleotides. The IVT templates will be produced by PCR using reverse primers encoding the poly (A) tails of the abovementioned length. The IVT, DNase I treatment and capping of GENE WRITER™ and the RNA template will be performed as described in Example 14 (Improved GENE WRITER™ components for RNA-based delivery). After one to three days post-transfection the genomic integration will be assayed. In some embodiments, the genome integration will be higher for the RNA template tailed with a poly(A) tail of a suitable length.

In a cell the RNA degradation is initiated by shortening its poly(A) tail by deadenylases. Since the deadenylases are 3'-5' exoribonucleases favoring the poly(A) stretches, the terminal uridine, cytidine and most often guanine detected in the natural poly(A) tails of many mRNA were proposed to protect the poly(A) tail from its shortening (Chang et al., Molecular Cell 53, 1044-1052 (2014)). We will assay the GENE WRITER™ and template RNAs with the encoded poly(A) tail with terminal G or C, or intermittent Gs or Cs (similar to that used in Lim et al., Science 361, 701-704 (2018)) according as described before.

Some of the RNAs have been described to evolve alternative ways of protections their 3' ends. A specific 16-nucleotide long stem-loop structure flanked with unpaired 5 nucleotides on both sides has been reported to protect the 3' end of mRNA encoding H2a.X histone (Mannironi et al., Nucleic Acid Research 17, 9113-9126 (1989)). It has been shown that the heterologous mRNA ending with the histone stem-loop structure is cell cycle-regulated (Harris et al., Molecular Cellular Biology 11, 2416-2424 (1991); Stauber et al., EMBO Journal 5, 3297-3303 (1986)). The stem-loop structure is recognized and protected by the Stem-Loop Binding Protein (SLBP). The protein accumulates shortly before cells enter S-phase and is rapidly degraded at the end of S-phase (Whifield et al., Molecular Cellular Biology 20, 4188-4198 (2000)). The stem-loop element will be inserted to the 3' end of the GENE WRITER™ mRNA and the RNA templates and tested as described above to induce cell-cycle specific genome integration events.

Some viral and long non-coding RNAs have evolved to protect their 3' ends with triple-helical structures (Brown et al., PNAS 109, 19202-19207 (2012)). Additionally, the structural elements of tRNA, Y RNA and vault RNA (reviewed in Labno et al., *Biochemica et Biophysica Acta* 1863, 3125-3147 (2016)) have been reported to extend half-life of these non-coding RNAs. We will insert the structures to protect the 3' end of the RNA templates and probe their efficiencies in GENE WRITING™ system as described above.

Finally, we will incorporate dNTP, 2'O-Methylated NTPs or phosphorothioate-NTP at the 3' of the RNA transgenes to increase the half-life of these molecules by protecting the 3' end of the RNA from exoribonucleases. We will incorporate single modified nucleotides or their stretches by extending the 3'end of the RNA by the DNA polymerases (for example, Klenow fragment) capable of extending an RNA sequence by adding modified nucleotides (Shcherbakova & Brenowitz, Nature Protocols 3, 288-302 (2008)).

A single nucleotide chemical modification of the 3' end of the RNA can be done by first oxidation of 3' terminal end of ribose sugar with sodium periodate to form a reactive aldehyde followed by conjugation of an aldehyde-reactive modified nucleotide. Alternatively, T4 DNA or T4 RNA ligases can be used for the splinted ligation (Moore & Query, Methods in Enzymology 317, 109-123 (2000)) of the stretches of modified nucleotides to the 3' end of the RNAs.

Chemical ligation of two fragments is also possible. The phosphodiester bond linkage between two RNA substrates can be formed either by activating the phosphomonoester group using a reactive imidazolide or by using a condensing reagent such as cyanogen bromide. A disadvantage of chemical ligation is that it can also result in the creation of a 2'-5' phosphodiester linkage, together with the desired 3'-5' phosphodiester linkages.

5' End Modifications of RNAs

In addition to the cap 1 structure described in Example 14 (Improved GENE WRITER™ components for RNA-based delivery) other 5' end protection groups will be explored. Particularly, we will use hypermethylated (Wurth et al. Nucleic Acid Res 42, 8663-8677 (2014)), phosphorothioate (Kuhn et al., Gene Therapy 17, 961-971 (2010)), NAD+-derived (Kiledjian, Trends in Cell Biology 28, 454-464 (2018)) and modified (for example, biotinylated: Bednarek et al., Phil Trans R Soc B 373, 20180167 (2018)) cap analogs for co-transcriptional capping.

We will also label the 5' of the RNA with 5'-[γ-thio] triphosphate to create a reactive sulfur group and chemically modify the 5' end with the protective modifications using a haloacetamide derivative of the modified group.

The proposed modifications to protect 3' and 5' end of the RNA will be introduced in RNA templates and/or GENE WRITER™ mRNA (if compatible with translation). The genome integration efficiencies of the RNAs will be tested as described in Example 14 (Improved GENE WRITER™ components for RNA-based delivery).

Example 18: Use of Modified RNA Bases in a GENE WRITER™ System

This example describes GENE WRITER™ systems comprising modified RNA bases to potentially improve features of the system, e.g., increase efficiency of integration, decrease cellular response to foreign nucleic acids. For the GENE WRITER™ polypeptide, the proposed modifications pertaining to the coding region are compatible with translation. For the RNA template, the proposed modifications are compatible with reverse transcription.

Figure 23:
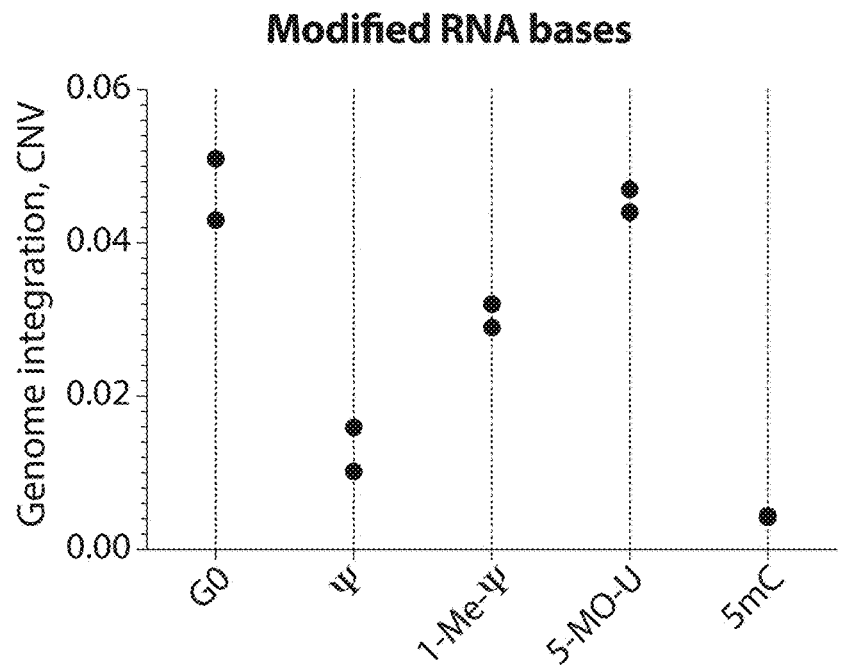
FIG. 23. Genome integration detected by 3' ddPCR induced by expression of GENE WRITER™ mRNA produced with either unmodified (G0) or modified nucleotides (pseudouridine (Ψ), 1-N-methylpseudouridine (1-Me-Ψ), 5-methoxyuridine (5-MO-U) or 5-methylcytidine (5mC)). 1 μg of GENE WRITER™ mRNA per well was used. The non-modified RNA template was used. The GENE WRITER™ RNA to the RNA template were co-transfected in 1:8 molar ratio.

In this example, mRNA encoding the GENE WRITER™ polypeptide was in vitro transcribed with a 100% replacement of the corresponding rNTP with one of the modified rNTPs: pseudouridine (Ψ), 1-N-methylpseudouridine (1-Me-Ψ), 5-methoxyuridine (5-MO-U) or 5-methylcytidine (5mC). Otherwise, the RNA preparation, purification and cell transfections were performed as described in the Example 14 (Improved GENE WRITER™ components for RNA-based delivery). The gene integration capacity of the modified mRNAs was compared with that of the non-modified mRNA (GO) using ddPCR, with all polypeptide mRNAs being paired with an unmodified template RNA (FIG. 23). Integration was detected when the polypeptide was encoded using each modified rNTP, with the highest signal coming from 5-MO-U and the lowest from 5mC. This demonstrates that the GENE WRITER™ polypeptide component is functional when expressed from mRNA containing modified bases.

Figure 5:
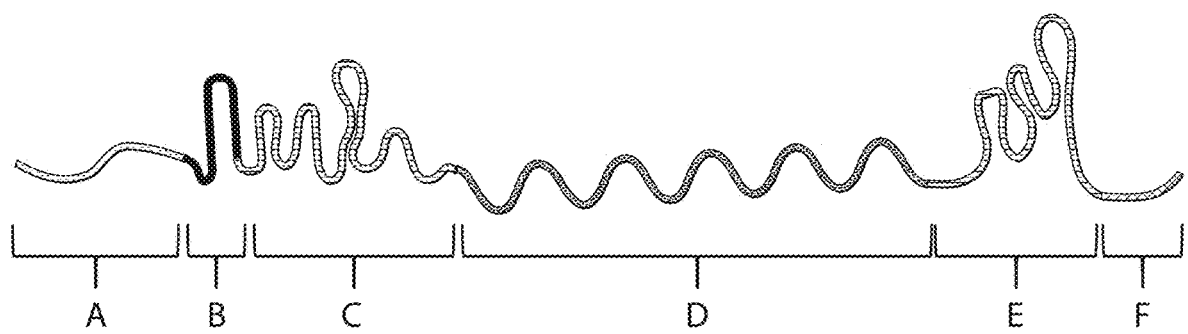
FIG. 5 is a diagram showing the modules of an exemplary GeneWriter RNA template. Individual modules of the exemplary template can be combined, re-arranged, and/or omitted, e.g., to produce a GENE WRITER™ template. A=5' homology arm; B=Ribozyme; C=5' UTR; D=heterologous object sequence; E=3' UTR; F=3' homology arm.

Further, this example describes the modularity of the GENE WRITER™ template molecule where it is composed of all or a subset of exemplary modules listed in FIG. 6 and illustrated in FIG. 5. Individual modules can be produced by chemical or in vitro syntheses as a contiguous nucleic acid molecule or in separate pieces that are later combined together. The individual modules of the GENE WRITER™ template molecule can be chemically modified nucleic acids, be comprised in part or in entirety of non-nucleic acids, re-arranged in order, and/or omitted to form the GENE WRITER™ template molecule.

In some embodiments, the GENE WRITER™ template molecule (all modules, A-F) is synthesized by in vitro transcription where 0-100% replacement of a corresponding rNTP (adenosine, cytidine, guanosine, and/or uridine) is with one or more modified rNTPs (base or ribose modification), e.g., 5' hydroxyl, 5' Phosphate, 2'-O-methyl, 2'-O-ethyl, 2'-fluoro, ribothymidine, C-5 propynyl-dC (pdC), C-5 propynyl-dU (pdU), C-5 propynyl-C(pC), C-5 propynyl-U (pU), 5-methyl C, 5-methyl U, 5-methyl dC, 5-methyl dU methoxy, (2,6-diaminopurine), 5'-Dimethoxytrityl-N4-ethyl-2'-deoxyCytidine, C-5 propynyl-fC (pfC), C-5 propynyl-fU (pfU), 5-methyl fC, 5-methyl fU, C-5 propynyl-mC (pmC), C-5 propynyl-fU (pmU), 5-methyl mC, 5-methyl mU, LNA (locked nucleic acid), MGB (minor groove binder) pseudouridine (Y), 1-N-methylpseudouridine (1-Me-Ψ), 5-methoxyuridine (5-MO-U). The modified nucleotides in this embodiment rely on incorporation through a transcription reaction which utilizes a natural or mutant polypeptide sequence of a RNA polymerase that readily incorporates modified nucleotides into a RNA transcript that is made in vitro (Padilla, R., Nucleic Acids Research, 30 (24), 138c-138, 2002; Ibach, J., et. al., Journal of Biotechnology, 167 (3), 287-295, 2013; Meyer, A. J., et. al., *Nucleic Acids Research*, 43 (15), 7480-7488, 2015). The modified GENE WRITER™ template molecule is typically in whole or in part compatible with the reverse transcriptase activity of the GENE WRITER™ polypeptide sequence; for modules or parts of modules of the GENE WRITER™ template molecule used as a template for reverse transcription, preference is given to modifications that are compatible with reverse transcription (Motorin et al., Methods in Enzymology 425 21-53, 2007; Mauger et al., *PNAS* 116, 24075-24083, 2019). GENE WRITER™ systems with template molecules containing modified rNTPs are tested as described above and in Example 14 (Improved GENE WRITER™ components for RNA-based delivery).

In some embodiments, individual modules are chemically synthesized containing modified nucleotides, e.g., 5' hydroxyl, 5' Phosphate, 2'-O-methyl, 2'-O-ethyl, 2'-fluoro, ribothymidine, C-5 propynyl-dC (pdC), C-5 propynyl-dU (pdU), C-5 propynyl-C(pC), C-5 propynyl-U (pU), 5-methyl C, 5-methyl U, 5-methyl dC, 5-methyl dU methoxy, (2,6-diaminopurine), 5'-Dimethoxytrityl-N4-ethyl-2'-deoxyCytidine, C-5 propynyl-fC (pfC), C-5 propynyl-fU (pfU), 5-methyl fC, 5-methyl fU, C-5 propynyl-mC (pmC), C-5 propynyl-fU (pmU), 5-methyl mC, 5-methyl mU, LNA (locked nucleic acid), MGB (minor groove binder) pseudouridine (Y'), 1-N-methylpseudouridine (1-Me-Ψ), 5-methoxyuridine (5-MO-U), where the individual modules are then ligated together through enzymatic (e.g., splint ligation using T4 DNA ligase, Moore, M. J., & Query, C. C. Methods in Enzymology, 317, 109-123, 2000) or chemical processes (e.g., Fedorova, O. A., et. al., Nucleosides and Nucleotides, 15 (6), 1137-1147, 1996) to form a complete GENE WRITER™ template molecule.

An example of a modified GENE WRITER™ template molecule is where modules A and F are each 100 nt of chemically synthesized RNA with cytidine and uridine nucleotides containing 2'-O-methyl ribose modifications and module A contains (3) phosphorothioate linkages between the first 3 nucleotides on the 5' end and module F contains (3) phosphorothioate linkages between the last 3 nucleotides on the 3' end of the module. Modules B-E are synthesized by in vitro transcription using an RNA polymerase (RNAP), e.g., T7 RNAP, T3 RNAP, or SP6 RNAP (NEB), or derivatives thereof that possess enhanced properties, e.g., increased fidelity, increased processivity, or increased efficiency of incorporating modified nucleotides. Module A is ligated to the 5' end of the in vitro transcribed module B-E molecule and module F is ligated on to the 3' end of the in vitro transcribed module B-E molecule by splint ligation (described by Moore, M. J., & Query, C. C. Methods in Enzymology, 317, 109-123, 2000). This fully assembled template RNA (all modules, A-F) is then used with a GENE WRITER™ polypeptide (or nucleic acid encoding the polypeptide) in a target cell to assess genomic integration as in previous examples. In some embodiments, RNA modifications do not decrease the efficiency of integration greater than 50%, e.g., as measured by ddPCR. In some embodiments, RNA modifications improve the efficiency of integration, e.g., as measured by ddPCR. In some embodiments, RNA modifications improve the reverse transcription reaction, e.g., improve the processivity or fidelity as measured by sequencing of integration events.

Example 19: GENE WRITER™ Templates that do not Incorporate UTRs

This example describes a configuration of the GENE WRITER™ template molecule that results in an exclusion of the UTRs, such that these regions used in retrotransposition are not integrated into the host cell.

In this example, we describe the positioning, omission, and/or substitution of the UTR modules of the GENE WRITER™ template molecule (FIGS. 5 and 6) to result in the GENE WRITER™ driver to not incorporate the UTR modules into the genome as a part of retrotransposition. In some embodiments, the GENE WRITER™ template molecule modules for the 5' and 3' UTRs (modules B+C and E of GENE WRITER™ template molecule) are moved to the ends of the molecule so that their function of interacting with the GENE WRITER™ driver does not change but the homology arm is now located adjacent to the heterologous object sequence (module D) where complementarity of the homology arms act as a primer for reverse transcription. In some cases, modules B and/or C are omitted from the GENE WRITER™ template molecule with module E following module F.

Additional examples of not incorporating the UTRs into the genome are removing modules B and C from the GENE WRITER™ template molecule, re-positioning module F (3' homology arm) to follow module D (heterologous object sequence) and have module E be substituted with a binding ligand such as biotin. This GENE WRITER™ template molecule would now consist of module A (5' homology arm)-module D (heterologous object sequence)-module F (3' homology arm)-module E comprised of biotin. The GENE WRITER™ driver polypeptide sequence would be modified to incorporate the amino acid sequence for monomeric streptavidin. This example illustrates how the utility of mediating a non-nucleic acid mediated association of the GENE WRITER™ template molecule with the GENE WRITER™ driver polypeptide sequence.

Example 20: GENE WRITER™ Genome Editor Polypeptides can Integrate Genetic Cargo Independently of the Homology Directed Repair Pathway This example describes the use of a GENE WRITER™ system in a human cell wherein the homologous recombination repair pathway is inhibited.

Figure 24:
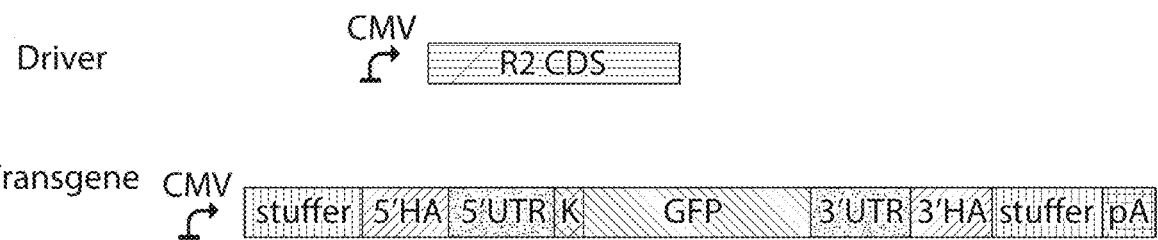
FIG. 24. Construct diagram of driver and transgene plasmids. Homology arms (HA) and stuffer sequences are variable in this set of experiments.
Figure 26A:
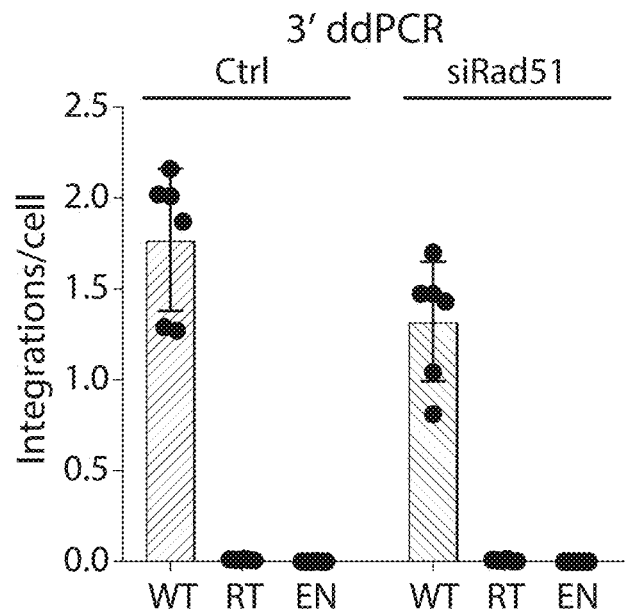
FIGS. 26A and 26B. U2OS cells were treated with a non targeting control siRNA (ctrl) or siRNA against Rad51, along with R2Tg Wt or control RT and EN mutants. ddPCR at the 3' (FIG. 26A) or 5' (FIG. 26B) junction was used to assess integration efficiency on day 3.
Figure 26B:
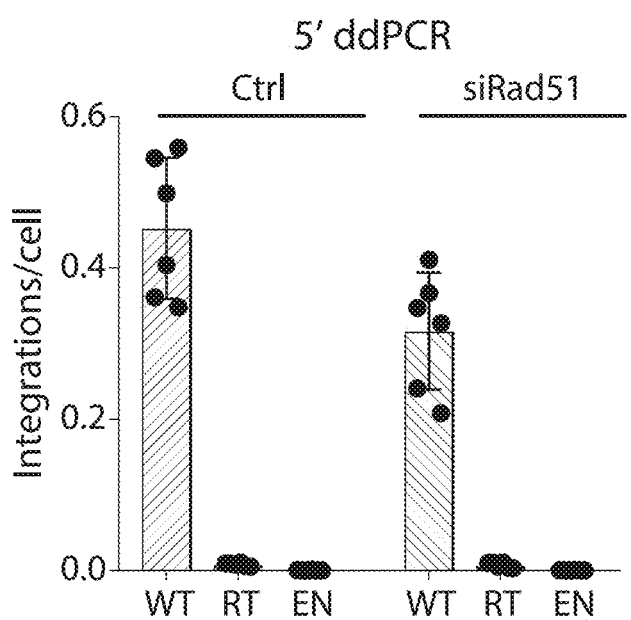

In this example, U2OS cells were treated with 30 pmols (1.5 μM) non-targeting control siRNA (Ctrl) or a siRNA against Rad51, a core component of the homologous recombination repair pathway. SiRNAs were co-delivered with R2Tg driver and transgene plasmid in trans (see FIG. 24 for driver and transgene configuration schematic). Specifically, Plasmid expressing R2Tg, control R2Tg with a mutation in the RT domain, or control R2Tg with an endonuclease inactivating mutation were used in conjunction with trans- gene (FIG. 25A, B). A total of 250 ng DNA plasmids with a 1:4 molar ration of driver to transgene, along with 30 pmol of siRNAs were nucleofected into 200k U2OS cells resuspended in 20 μL of nucleofection buffer SE using pulse code DN100. Protein lysates collected on day 3 showed the absence of Rad51 in the siRad51 treated condition (FIG. 25C). gDNA was extracted at day 3 and ddPCR assays to detect transgene integration at the rDNA locus was performed. The results of the ddPCR copy number analysis (in comparison to reference gene RPP30) are shown in FIG. 26. The absence of Rad51 leads to a ~20% reduction in R2Tg mediated transgene integration at the rDNA locus both at the 3' and 5' junctions (FIG. 26), indicating that R2TG mediated transgene insertion is not wholly dependent on the presence of the homologous recombination pathway, and can occur in the absence of the endogenous HR pathway. In some embodiments, HR independence enables GENE WRITING™ to work in cells and tissues with endogenously low levels of HR, e.g., liver, brain, retina, muscle, bone, nerve, cells in $G_0$ or $G_1$ phase, non-dividing cells, senescent cells, terminally differentiated cells. In some embodiments, HR independence enables GENE WRITING™ to work in cells or in patients or tissues containing cells with mutations in genes involved in the HR pathway, e.g., BRCA1, BRCA2, P53, RAD51.

Example 21: GENE WRITER™ Genome Editor Polypeptides can Integrate Genetic Cargo Independently of the Single-Stranded Template Repair Pathway This example describes the use of a GENE WRITER™ system in a human cell wherein the single-stranded template repair (SSTR) pathway is inhibited.

In this example, the SSTR pathway will be inhibited using siRNAs against the core components of the pathway: FANCA, FANCD2, FANCE, USP1. Control siRNAs of a non-target control will also be included. 200k U2OS cells will be nucleofected with 30 pmols (1.5 μM) siRNAs, as well as R2Tg driver and transgene plasmids (trans configuration). Specifically, 250 ng of Plasmids expressing R2Tg, control R2Tg with a mutation in the RT domain, or control R2Tg with an endonuclease inactivating mutation) are used in conjunction with transgene at a 1:4 molar ratio (driver to transgene). Transfections of U2OS cells is performed in SE buffer using program DN100. After nucleofection, cells are grown in complete medium for 3 days. gDNA is harvested on day 3 and ddPCR is performed to assess integration at the rDNA site. Transgene integration at rDNA is detected in the absence of core SSTR pathway components.

Example 22: GENE WRITER™ Systems with Enhanced Activity for Target Vs Non-Target Cells This example describes the incorporation of regulatory sequences into GENE WRITER™ systems in order to decrease integration activity in non-target cells.

In this example, genetic regulation is accomplished through (i) using tissue-specific promoters to upregulate component expression and integration in target cells and (ii) using miRNA binding sites to decrease integration in non-target cells that have increased endogenous levels of the corresponding miRNA. Target cells used are human hepatocytes and non-target cells are hematopoetic stem cells (HSCs). The driver of integration here is a plasmid encoding the GENE WRITER™ polypeptide (e.g., R2Tg retrotransposase) driven by different promoters and with scrambled or specific miRNA binding sites after the coding sequence. The template for integration is encoded on plasmid DNA, such that transcription results in a homology- and UTR-flanked heterologous object sequence. The heterologous object sequence may comprise a reporter gene that is driven by different promoters and with scrambled or specific miRNA binding sites after the coding sequence. The control promoter used here is CMV and the control for miRNA binding site is a randomly scrambled version of the binding site for miR-142. The target tissue-specific promoter used here is ApoE.HCR.hAAT, which is expressed in liver cells, and the off-target tissue-specific miRNA binding site is complementary to miR-142 (uguaguguuuccuacuuuaugga (SEQ ID NO: 1684)), which is expressed in HSCs.

Target cells and non-target cells are nucleofected with a combination of GENE WRITER™ polypeptide (1) and template (2) selected from:
GENE WRITER™ polypeptide constructs (1):
  a. Non-specific driver: CMV-R2Tg
  b. Non-specific inactivated driver: CMV-R2Tg (EN*)
  c. Tissue-specific driver: ApoE.HCR.hAAT-R2Tg-miR142
  d. Tissue-specific inactivated driver: ApoE.HCR.hAAT-R2Tg (EN*)-miR142
GENE WRITER™ template constructs (2):
  a. Non-specific transgene: CMV-gfp
  b. Tissue-specific transgene: ApoE.HCR.hAAT-gfp-miR142

Cells are incubated for at least three days and subsequently evaluated for integration efficiency and reporter expression. For integration efficiency, ddPCR is performed to quantify the average number of integrations per genome for each sample. In some embodiments, the ratio between the integration efficiency in target cells and non-target cells is higher when using a template paired with the tissue-specific driver (la) vs a non-specific driver (1c). To assess reporter expression, cells are analyzed by flow cytometry to detect GFP fluorescence and RT-qPCR to detect transcription. In some embodiments, the ratio between fluorescence in target cells and non-target cells is higher when using a driver paired with a tissue-specific transgene cassette (2b) vs a non-specific transgene cassette (2a). In some embodiments, the ratio between transcript levels in target cells and non-target cells is higher when using a driver paired with a tissue-specific transgene cassette (2b) vs a non-specific transgene cassette (2a). In some embodiments, the combination of a tissue-specific driver (1a) with a tissue-specific transgene cassette (2b) results in the highest ratio of transcription or expression between target and non-target cells. Alternatively, a screening assay can be performed in the same cell line artificially expressing or not expressing a given miRNA, e.g., the on-target screening cell is a HEK293T cell and the non-target cell is mimicked by introducing overexpression of miR-142 in HEK293T cells.

Example 23: Correction of Alpha-1 Antitrypsin Deficiency Using Lipid Nanoparticles Comprising GENE WRITER™ Genome Editor Polypeptides This example describes the use of a GENE WRITER™ gene editing system to alter a genomic sequence at a single nucleotide in vivo. More specifically, the GENE WRITER™ polypeptide and writing template are delivered to mouse liver cells via lipid nanoparticles to correct the SERPINA1 PiZ mutation causing alpha-1 antitrypsin deficiency.

Formulation and treatment of murine models with LNPs (LNP-INT01 system) carrying Cas9 and gRNA are taught by Finn et al. *Cell Reports* 22:2227-2235 (2018), the methods of which are incorporated herein by reference.

Capped and polyadenylated GENE WRITER™ polypeptide mRNA containing N1-methyl pseudo-U is generated by in vitro transcription using a linearized plasmid DNA template and T7 RNA polymerase. The polypeptide mRNA is purified from enzyme and nucleotides using a MegaClear Transcription Clean-up Kit, in accordance with the manufacturer's protocol (ThermoFisher). The transcript concentration is determined by measuring the light absorbance at 260 nm (Nanodrop), and the transcript is analyzed by capillary electrophoresis by TapeStation (Agilent). Template RNA comprising the mutation correcting sequence is also prepared by in vitro transcription and translation using similar methods. In this example, the template RNA comprises the sequence as exemplified in Example 1.

LNPs are formulated with an amine-to-RNA-phosphate (N: P) ratio of 4.5. The lipid nanoparticle components are dissolved in 100% ethanol with the following molar ratios: 45 mol % LP01 lipid, 44 mol % cholesterol, 9 mol % DSPC, and 2 mol % PEG2k-DMG. The RNA cargo (1:40 molar ratio of polypeptide mRNA: template RNA) is dissolved in 50 mM acetate buffer (pH 4.5), resulting in a concentration of RNA cargo of approximately 0.45 mg/mL. LNPs are formed by microfluidic mixing of the lipid and RNA solutions using a Precision Nanosystems NanoAssemblr Benchtop Instrument, in accordance with the manufacturer's protocol. After mixing, the LNPs are collected and diluted in PBS (approximately 1:1), and then the remaining buffer is exchanged into PBS (100-fold excess of sample volume) overnight at 4 C under gentle stirring using a 10 kDa Slide-a-Lyzer G2 Dialysis Cassette (ThermoFisher Scientific). The resultant mixture is then filtered using a 0.2-mm sterile filter. The filtrate is stored at 2 C-8 C. Multi-dose formulations may be formulated using 25 mM citrate, 100 mM NaCl cargo buffer (pH 5), and buffer exchanged by TFF into tris-saline sucrose buffer (TSS) buffer (5% sucrose, 45 mM NaCl, and 50 mM Tris). Formulated LNPs have an average size of 105 nm. Encapsulation efficiencies are determined by ribogreen assay (Leung et al., 2012). Particle size and polydispersity are measured by dynamic light scattering (DLS) using a Malvern Zetasizer DLS instrument.

NSG-PiZ mice carrying the human SERPINA1 PiZ allele (E342K) are acquired from The Jackson Laboratory. To assess the ability of GENE WRITING™ to edit the mutant allele in vivo, LNPs are dosed via the lateral tail vein at 3 mg/kg in a volume of 0.2 mL per animal. Excipient-treated animals are used as negative controls for all studies. Animals are euthanized at various time points by exsanguination via cardiac puncture under isoflurane anesthesia. In some embodiments, animals are euthanized at one week post-treatment to be analyzed for GENE WRITING™. Liver tissue is collected from the median or left lateral lobe from each animal for DNA extraction and analysis.

For NGS analysis of editing efficiency, PCR primers are designed around the target site, and the region of interest is amplified from extracted genomic DNA. Additional PCR is performed in accordance with the manufacturer's protocols (Illumina) to add the appropriate chemistry for sequencing, and amplicons are then sequenced on an Illumina MiSeq. Sequencing reads are aligned to the mouse reference genome after eliminating those having low quality scores. The resultant files containing the reads are mapped to the reference genome (BAM files), where reads that overlap the target region of interest are selected, and the number of wild-type reads versus the number of reads that contain the SERPINA1 reversion mutation encoded in the template RNA are calculated. The editing percentage (e.g., the "editing efficiency" or "percent editing") is defined as the total number of reversion sequence reads over the total number of sequence reads.

In some embodiments, this example is repeated with additional groups of mice and a redosing regimen is used to analyze dose-to-effect properties of the system. In these experiments, mice are assigned to groups for weekly dosing up to 4 weeks, with euthanasia and tissue analysis as described herein being performed each week. In some embodiments, mice that receive more doses of the LNP formulation demonstrate higher GENE WRITING™ efficiency by sequencing, e.g., mice receiving 2 doses one week apart that are analyzed at week three show a higher fraction of gene corrected reads by NGS of liver tissue samples as compared to mice receiving a single dose and analyzed at week three. In application, dosing in this manner may allow tuning of therapeutic intervention after evaluating patient response to one or more doses.

Example 24: Using GENE WRITING™ to Address Repeat Expansion Diseases

This example describes the use of a GENE WRITER™ gene editing system to treat a repeat expansion disease by rewriting a normal number of repeats into the locus. More specifically, the GENE WRITER™ polypeptide and writing template are delivered to mouse CNS via AAV to reset the CAG repeats in HTT as per the custom template RNA to cure Huntington Disease. Healthy humans tend to carry between 10 and 35 CAG repeats within the huntingtin gene (HTT), while those with Huntington Disease may possess between 36 to greater than 120 repeats.

In this example, the template RNA is designed to correct the CAG repeat region of the HTT gene by encoding a sequence with 10 such repeats and homology to the flanking target sequence to fully write across the target locus. Multiple examples of such template RNAs could be designed, with an exemplary template RNA, as encoded in DNA, comprising the sequence (1) GGCGGCTGAGGAAGCT-GAGG (2) GTTTTAGAGCTAGAAATAGCAAGT-TAAAATAA GGCTAGTCCGTTATCAACTTGAAAAA GTGGGACCGAGTCGGTCC (3) AGTCCCTCAAG TCCTTCcagcagcagcagcagcagcagcagcagccgc-caccgccgccgccgccgccgccgcctcct (4) CAGCTTCC TCAG (SEQ ID NO: 1685), where numbers are used to delineate the modules of the template in the order (5'-3') (1) gRNA spacer, (2) gRNA scaffold, (3) heterologous object sequence, (4) 3' homology priming domain, with the repeat correction being encoded in (3). The CAG repeat region is followed by a short repeat region encoding for 11 proline residues (8 residues being encoded by CCG triplets). Without wishing to be bound by theory, this region is included in (3) to place (4) in a more unique region to prevent mispriming. An exemplary gRNA for providing a second nick as described in embodiments of this system comprises the spacer sequence CGCTGCACCGACCGTGAGTT (SEQ ID NO: 1630) and directs a Cas9 nickase to nick the second strand of the target site within the homologous region. In some embodiments, this second nick improves the efficiency of the edit.

In order to deliver a complete GENE WRITING™ system to the CNS, in this example, the GENE WRITER™ is split across two AAV genomes, with the first encoding the nickase Cas9 domain fused to intein-N of a split intein pair (DnaE Intein-N: CLSYETEILTVEYGLLPIG-KIVEKRIECTVYSVDNNGNIYTQPVAQWHDR GEQEVFEYCL EDGSLIRATKDHKFMTVDGQMLPI-DEIFERELDLMRVDNLPN (SEQ ID NO: 1638)) and the second encoding the RT domain fused to an intein-C of a split intein pair (DnaE Intein-C, MIKIATRKYLGKQNVY-DIGVERDHNFALKNGFIASN (SEQ ID NO: 1640)) and the template RNA. The two polypeptide components are expressed from a polymerase II promoter, e.g. a neuronal cell-specific promoter described herein, and the template RNA and gRNA for providing a second nick are expressed from a polymerase III promoter, e.g. a U6 promoter. When co-infecting a cell, the two polypeptide components reconstitute a complete GENE WRITER™ polypeptide with N-terminal Cas9 and C-terminal RT and the template RNA is expressed and reverse transcribed into the target locus. To achieve delivery for cells of the CNS (specifically the claudate nucleus and the putamen of the basal ganglia), the pseudotyped system rAAV2/1 is used here, where the AAV2 ITRs are used to package the described nucleic acids into particles with AAV1 capsid. AAV preparation and mouse injection and harvesting protocols used here follow the teachings of Monteys et al. *Mol Ther* 25 (1): 12-23 (2017).

FVB-Tg (YAC128) 53Hay/J mice are acquired from The Jackson Laboratory. These transgenic mice express the full-length human huntingtin protein with ~118 glutamine repeats (CAG trinucleotide repeats) and develop hyperkinesis at three months of age. At 8 weeks of age, mice are treated with a combination 1:1 of rAAV2/1-Cas9 virus and rAAV-MMLV_RT/hU6templateRNA virus. For rAAV injections, mice are anesthetized with isoflurane and 5 µL of rAAV mixture injected unilaterally into the right striata at 0.2 µL/min. After three weeks, mice are sacrificed and brain tissue taken for genomic DNA extraction and NGS analysis.

For NGS analysis of editing efficiency, PCR primers are designed flanking the target site, and the region of interest is amplified from extracted genomic DNA. Additional PCR is performed in accordance with the manufacturer's protocols (Illumina) to add the necessary chemistry for sequencing, and amplicons are then sequenced on an Illumina MiSeq. Sequencing reads are aligned to the mouse reference genome after eliminating those having low quality scores. The resultant files containing the reads are mapped to the reference genome (BAM files), where reads that overlap the target region of interest are selected, and the number of diseased allele (>35 CAG repeats) reads versus the number of repaired allele (10-35 CAG repeats) reads are calculated. The editing percentage (e.g., the "editing efficiency" or "percent editing") is defined as the total number of repaired reads, as defined above, over the total number of sequence reads.

Example 25: Delivery of a GENE WRITING™ System by LNP and AAV Vehicles

This example describes the use of a GENE WRITER™ gene editing system to alter a genomic sequence at a single nucleotide in vivo. More specifically, the GENE WRITER™ polypeptide and writing template are delivered to mouse liver cells via a combination of lipid nanoparticles (mRNA encoding polypeptide) and AAV (DNA encoding the RNA template) to correct the SERPINA1 PiZ mutation causing alpha-1 antitrypsin deficiency.

Capped and tailed mRNA encoding the GENE WRITER™ polypeptide are prepared by in vitro transcription and formulated into LNP-INT01 as described in Example 23, but without template RNA co-formulation.

In this example, the template RNA is encoded as DNA and delivered via AAV. The teachings of Cunningham et al. *Mol Ther* 16 (6): 1081-1088 (2008) describe the use of rAAV2/8 with the human alpha-1 antitrypsin (hAAT) promoter and two copies of the hepatic control region of the apolipoprotein E enhancer (ApoE) to effectively transduce and drive expression of cargo in juvenile mouse liver. Accordingly, rAAV2/8.ApoE-hAAT.PiZ (rAAV2/8.PiZ) as described here comprises the above described AAV and promoter system driving expression of an RNA template for correcting the PiZ mutation, in addition to a second nick-directing gRNA being driven by a U6 promoter (RNA sequences previously described in Example 1).

NGS-PiZ mice carrying the human SERPINA1 PiZ allele (E342K) are acquired from The Jackson Laboratory. To assess the activity of GENE WRITING™ to edit the mutant allele in vivo, 8-week-old mice are dosed i.p, with $\sim 10^{11}$ vg of rAAV2/8.PiZ to express the template RNA and via the lateral tail vein with formulated LNPs at 3 mg/kg in a volume of 0.2 mL per animal to express the GENE WRITER™ polypeptide. Animals are euthanized at various time points by exsanguination via cardiac puncture under isoflurane anesthesia. In some embodiments, animals are euthanized at one week post-treatment to be analyzed for GENE WRITING™. Liver tissue is collected from the median or left lateral lobe from each animal for DNA extraction and analysis.

For NGS analysis of editing efficiency, PCR primers are designed around the target site, and the region of interest is amplified from extracted genomic DNA. Additional PCR is performed in accordance with the manufacturer's protocols (Illumina) to add the necessary chemistry for sequencing, and amplicons are then sequenced on an Illumina MiSeq. Sequencing reads are aligned to the mouse reference genome after eliminating those having low quality scores. The resultant files containing the reads are mapped to the reference genome (BAM files), where reads that overlap the target region of interest are selected, and the number of wild-type reads versus the number of reads that contain the SERPINA1 reversion mutation encoded in the template RNA are calculated. The editing percentage is defined as the total number of reversion sequence reads over the total number of sequence reads.

Example 26: Application of a GENE WRITER™ System for Delivering Therapeutic Gene to Liver in a Human Chimeric Liver Mouse Model This example describes a GENE WRITER™ genome editing system delivered to the liver in vivo for integration and stable expression of a genetic payload. Specifically, LNPs are used to deliver a GENE WRITING™ system capable of integrating a complete OTC expression cassette to treat a humanized mouse model of OTC-deficiency.

In this example, a GENE WRITING™ system is used to treat a humanized mouse model of OTC deficiency, in which human hepatocytes derived from patients with OTC deficiency are engrafted into a mouse model (Ginn et al JHEP Reports 2019). An exemplary GENE WRITING™ system for large payload integration comprises a Cas9-directed reverse transcriptase system utilizing a highly processive reverse transcriptase, e.g., MarathonRT. An exemplary template RNA component comprises, from 5' to 3', (1) a gRNA spacer with homology to the AAVS1 safe harbor site, (2) a gRNA scaffold, (3) a heterologous object sequence, and (4) a 3' target homology region for annealing to the genomic DNA immediately upstream of the first strand nick to prime TPRT of the heterologous object sequence. An exemplary sequence for (1) is GGGGCCACTAGGGACAGGAT (SEQ ID NO: 1689). Region (2) carries the gRNA scaffold as described in this application, generally comprising the sequence GTTTTAGAGCTAGAAATAGCAAGT-TAAAATAAGGCTAGTCCGTTATCAACTTGAAAA AGTGGGACCGAGTCGGTCC (SEQ ID NO: 1591). In this example, (3) comprises a complete OTC expression cassette, where a liver-codon-optimized sequence encoding human OTC (UniProt P00480) is in operable association with the ApoE.hAAT promoter system as described in Example 25. An exemplary sequence for (4) is CTGTCCCTAGTG (SEQ ID NO: 1690). An exemplary sequence of an additional gRNA spacer for generating a second strand nick to improve the efficiency of integration is AGAGAGATGGCTCCAGGAAA (SEQ ID NO: 1691).

Eight to 12-week-old female Fah$^{-/-}$Rag2$^{-/-}$Il2rg$^{-/-}$ (FRG) mice are engrafted with human hepatocytes, isolated from pediatric donors or purchased from Lonza (Basel, Switzerland), as described previously (Azuma et al Nat Biotechnol 2007). Engrafted mice are cycled on and off 2-(2-nitro-4-trifluoro-methylbenzoyl)-1,3-cyclohexane-dione (NTBC) in drinking water to promote liver repopulation. Blood is collected every two weeks and at the end of the experiment to measure the levels of human albumin, used as a marker to estimate the level of engraftment, in serum by enzyme-linked immunosorbent assay (ELISA; Bethyl Laboratories, Inc., Montgomery, TX). Eleven weeks after engraftment, mice are treated with the GENE WRITER™ genome editor polypeptides formulated as in Example 23. For treatment, LNPs are delivered via the lateral tail vein at 3 mg/kg in a volume of 0.2 mL per animal.

After vector injection, mice are cycled on NTBC for another 5 weeks before being euthanized. DNA and RNA are subsequently extracted from liver lysates by standard methods. OTC expression is subsequently assayed by performing RT-qPCR on isolated RNA samples using sequence-specific primers. Levels of human OTC are also measured throughout the experiment by using a human OTC ELISA kit (e.g., Aviva Systems Biology OTC ELISA Kit (Human) (OKCD07437)) on serum at Days −7, 0, 2, 4, 7, 14, 21, 28, and 35 post-injection, following the manufacturer's recommended protocol.

For analysis of editing efficiency, a ddPCR assay is performed using a pair of primers that anneal across either the 5' junction or the 3' junction of integration, with one primer in each set annealing to the heterologous object sequence, and the other to an appropriate region of the AAVS1 site on the genome. The assay is normalized to a reference gene to quantify the number of target site integrations per genome.

To analyze integrations at the target site, long-read sequencing across the integration site is performed. PCR primers are designed flanking the target site, and the region of interest is amplified from extracted genomic DNA. Additional PCR is performed in accordance with the manufacturer's protocols (PacBio) to add the necessary chemistry for sequencing, and amplicons are then sequenced via PacBio. Sequencing reads are aligned to the mouse reference genome after eliminating those having low quality scores. The resultant files containing the reads are mapped to the reference genome (BAM files), where reads that contain an insertion sequence relative to the reference genome are selected for further analysis to determine completeness of integration, defined in this example as containing the complete promoter and coding sequence of OTC.

Example 27: GENE WRITER™ Genome Editor Polypeptides for Integration of a CAR in T-Cells Ex Vivo This example describes delivery of a GENE WRITER™ genome editing system to T-cells ex vivo for integration and stable expression of a genetic payload. Specifically, LNPs are used to deliver a GENE WRITING™ system capable of integrating a chimeric antigen receptor (CAR) into the TRAC locus to generate CAR-T cells for treating B-cell lymphoma.

In this example, a GENE WRITING™ system comprises a GENE WRITING™ polypeptide, e.g., a nickase Cas9 and R2Tg reverse transcriptase domain, as described herein, a gRNA for directing nickase activity to the target locus, and a template RNA comprising, from 5' to 3':
(1) 100 nt homology to target site 3' of first strand nick
(2) 5' UTR from R2Tg
(3) Heterologous object sequence
(4) 3' UTR from R2Tg
(5) 100 nt homology to target site 5' of first strand nick Wherein (3) comprises the coding sequence for the CD19-specific Hu19-CD828Z (Genbank MN698642; Brudno et al. Nat Med 26:270-280 (2020)) CAR molecule. The GENE WRITER™ in this example is guided to the 5' end of the first exon of TRAC by using a targeted gRNA, e.g., TCAGGGTTCTGGATATCTGT (SEQ ID NO: 1692), in order to place the cargo under endogenous expression control from that locus while disrupting the endogenous TCR, as taught by Eyquem et al. Nature 543:113-117 (2017). These three components (polypeptide, gRNA, and template) all comprise RNA, which is synthesized by in vitro transcription (e.g., polypeptide mRNA, template RNA) or chemical synthesis (gRNA).

The LNP formulation used in this example has been screened and validated for delivery to T-cells ex vivo, being taught in Billingsley et al. Nano Lett 20 (3): 1578-1589

(2020), which is incorporated herein by reference in its entirety. Specifically, the LNP formulation C14-4, comprising cholesterol, phospholipid, lipid-anchored PEG, and the ionizable lipid C14-4 (FIG. 2C of Billingsley et al. Nano Lett 20 (3): 1578-1589 (2020)) was used to encapsulate all three RNA components in a molar ratio of polypeptide mRNA: gRNA: template RNA of about 1:40:40.

Additional edits can be performed on T-cells in order to improve activity of the CAR-T cells against their cognate target. In some embodiments, a second LNP formulation of C14-4 as described comprises a Cas9/gRNA preformed RNP complex, wherein the gRNA targets the Pdcd1 exon 1 for PD-1 inactivation, which can enhance anti-tumor activity of CAR-T cells by disruption of this inhibitory checkpoint that can otherwise trigger suppression of the cells (see Rupp et al. Sci Rep 7:737 (2017)). The application of both nanoparticle formulation thus enables lymphoma targeting by providing the anti-CD19 cargo, while simultaneously boosting efficacy by knocking out the PD-1 checkpoint inhibitor. In some embodiments, cells may be treated with the nanoparticles simultaneously. In some embodiments, the cells may be treated with the nanoparticles in separate steps, e.g., first deliver the RNP for generating the PD-1 knockout, and subsequently treat cells with the nanoparticles carrying the anti-CD19 CAR. In some embodiments, the second component of the system that improves T cell efficacy may result in the knockout of PD-1, TCR, CTLA-4, HLA-I, HLA-II, CS1, CD52, B2M, MHC-I, MHC-II, CD3, FAS, PDC1, CISH, TRAC, or a combination thereof. In some embodiments, knockdown of PD-1, TCR, CTLA-4, HLA-I, HLA-II, CS1, CD52, B2M, MHC-I, MHC-II, CD3, FAS, PDC1, CISH, or TRAC may be preferred, e.g., using siRNA targeting PD-1. In some embodiments, siRNA targeting PD-1 may be achieved using self-delivering RNAi as described by Ligtenberg et al. Mol Ther 26 (6): 1482-1493 (2018) and in WO2010033247, incorporated herein by reference in its entirety, in which extensive chemical modifications of siRNAs, conferring the resulting hydrophobically modified siRNA molecules the ability to penetrate all cell types ex vivo and in vivo and achieve long-lasting specific target gene knockdown without any additional delivery formulations or techniques. In some embodiments, one or more components of the system may be delivered by other methods, e.g., electroporation. In some embodiments, additional regulators are knocked in to the cells for overexpression to control T cell- and NK cell-mediated immune responses and macrophage engulfment, e.g., PD-L1, HLA-G, CD47 (Han et al. PNAS 116 (21): 10441-10446 (2019)). Knock-in may be accomplished through application of an additional GENE WRITING™ system with a template carrying an expression cassette for one or more such factors (3) with targeting to a safe harbor locus, e.g., AAVS1, e.g., using gRNA GGGGCCACTAGGGACAGGAT (SEQ ID NO: 1689) to target the GENE WRITER™ polypeptide to AAVS1.

LNPs are used to treat primary T cells activated by Dynabeads at a 1:1 CD4+:CD8+ ratio at 450 ng/µL total mRNA concentrations. The resulting T cell populations are analyzed for integration, expression, and effect. For assessing integration, ddPCR is used with primers producing an amplicon extending from within the integrated CAR to the flanking genomic TRAC sequence. Comparing signal to a reference gene (e.g., RPP30), allows quantification of the average copy number per genome and integration efficiency. To analyze expression, flow cytometry with immunological probes is used to assess the level and percent of cells displaying surface CAR expression. To analyze activity of the CAR-T cells, treated cells are assessed via a co-plated cancer cell killing assay. By engineering Nalm6 ALL cells to express luciferase, cancer cell killing can be assessed by change in luminescence after co-culture with CAR-T cells as compared to signal from Nalm6 cells alone Billingsley et al. Nano Lett 20 (3): 1578-1589 (2020). Thus, a GENE WRITING™ system can be used to generate CAR-T cells ex vivo with the desired cytotoxic activity.

Example 28: GENE WRITER™ Genome Editor Polypeptides for Integration of a CAR in T-Cells In Vivo This example describes a GENE WRITER™ genome editing system delivered to T-cells in vivo for integration and stable expression of a genetic payload. Specifically, targeted nanoparticles are used to deliver a GENE WRITING™ system capable of integrating a chimeric antigen receptor (CAR) expression cassette into the murine Rosa26 locus to generate CAR-T cells in a murine model.

In this example, a GENE WRITING™ system comprises a GENE WRITING™ polypeptide, e.g., a nickase Cas9 and R2Tg reverse transcriptase domain, as described herein, a gRNA for directing nickase activity to the target locus, and a template RNA comprising, from 5' to 3':
(1) 100 nt homology to target site 3' of first strand nick
(2) 5' UTR from R2Tg
(3) Heterologous object sequence
(4) 3' UTR from R2Tg
(5) 100 nt homology to target site 5' of first strand nick Wherein (3) comprises the coding sequence for the CD19-specific m194-1BBz CAR driven by the EF1a promoter (Smith et al. Nat Nanotechnol 12 (8): 813-820 (2017)). The GENE WRITER™ in this example is guided to the murine Rosa26 locus using a gRNA, e.g., ACTCCAGTCTTTCTAGAAGA (SEQ ID NO: 1693) (Chu et al. Nat Biotechnol 33 (5): 543-548 (2015)). Production of RNA molecules is as according to examples provided herein, e.g., by in vitro transcription (e.g., GENE WRITER™ polypeptide mRNA, template RNA) and by chemical synthesis (e.g., gRNA). Modifications to the RNA components of the system are as described elsewhere. For GENE WRITER™ mRNA, the sequence additionally comprises a 5' UTR (e.g., GGGAAAUAAGAGAGAAAA GAAGAGUAAGAAGAAAUAUAAGAGCCACC (SEQ ID NO: 1603)) and a 3' UTR (e.g., UGAUAAUAGGCUG-GAGCCUCGGUGGCCAUGCUUCUUGCCCC-UUGGGCCUCCCCCC AGCCCUCCUCCCCUUC-CUGCACCCGUACCCCGUGGUCUUUGAAUAAAGU-CUGA (SEQ ID NO: 1604)) flanking the coding sequence. This combination of 5' UTR and 3' UTR has been shown to result in good expression of an operably linked ORF (Richner et al. Cell 168 (6): P1114-1125 (2017)).

In order to achieve delivery specifically to T-cells, targeted LNPs (tLNPs) are generated that carry a conjugated mAb against CD4. See, e.g., Ramishetti et al. ACS Nano 9 (7): 6706-6716 (2015). Alternatively, conjugating a mAb against CD3 can be used to target both CD4+ and CD8+ T-cells (Smith et al. Nat Nanotechnol 12 (8): 813-820 (2017)). In other embodiments, the nanoparticle used to deliver to T-cells in vivo is a constrained nanoparticle that lacks a targeting ligand, as taught by Lokugamage et al. Adv Mater 31 (41): e1902251 (2019).

The tLNP can be made by first preparing the nucleic acid mix (e.g., polypeptide mRNA: gRNA: template RNA molar ratio of 1:40:40) with a mixture of lipids (cholesterol, DSPC, PEG-DMG, Dlin-MC3-DMA, and DSPE-PEG-maleimide)

and then chemically conjugating the desired DTT-reduced mAb (e.g., anti-CD4, e.g., clone YTS.177) to the maleimide functional group on the LNPs. See Ramishetti et al. ACS Nano 9 (7): 6706-6716 (2015).

Six to 8 week old C57BL6/J mice are injected intravenously with formulated LNP at a dose of 1 mg RNA/kg body weight. Blood is collected at one day and three days post-administration in heparin-coated collection tubes, and the leukocytes are isolated by density centrifugation using Ficoll-Paque PLUS (GE Healthcare). Five days post-administration, animals are euthanized and blood and organs (spleen, lymph nodes, bone marrow cells) are harvested for T-cell analysis. Expression of the anti-CD19 CAR is detected by FACS using specific immunological sorting. Positive cells are confirmed for integration by ddPCR on the sorted population, where primers are used that flank an integration junction, e.g., one primer of the pair annealing to the integrated cargo and the other to genomic DNA from the Rosa26 target site.

Example 29: Assessment of Distance and PAM Orientation Between the First and Second Nicks to Reduce Non-Templated Indel Formation During GENE WRITING™

This examples describes how the placement of a second nick used in a GENE WRITING™ system can be optimized to (1) increase the frequency of installation of a desired edit using a GENE WRITER™ polypeptide with a template RNA, while (2) decreasing undesired insertions and/or deletions that may arise as a byproduct of the second nick.

An exemplary GENE WRITING™ system can install a desired genomic modification (e.g., an insertion, deletion, or point mutation) using 1) a template RNA that comprises a gRNA and a heterologous object sequence comprising the desired genomic modification, and 2) a GENE WRITING™ polypeptide comprising a nickase Cas9 (e.g., Cas9 N863A) fused to a reverse transcriptase (RT) (e.g., an RT domain from MMLV). In said exemplary GENE WRITING™ system, the Cas9-RT fusion introduces a first nick, which exposes an available 3'OH to initiate the reverse transcriptase reaction using the template RNA as a template for target primed reverse transcription. The placement of a second nick adjacent to, but on the opposite strand as the first nick, enhances the installation of the desired genome modification.

In this experiment, a 3 nt insertion (CTT) is directed to the HEK3 locus. The template RNA for the insertion comprises (1) a gRNA spacer with homology to the HEK3 site, (2) a gRNA scaffold, (3) a heterologous object sequence including the CTT insertion, and (4) a 3' target homology region for annealing to the genomic DNA immediately upstream of the first strand nick to set up target-primed reverse transcription of the heterologous object sequence. The sequence of the template RNA used is (5'-3') GGCCCAGACT-GAGCACGTGAGTTTTAGAGCTAGAAATAGCAAGT-TAAAATAAGGCT AGTCCGTTATCAACTTGAAA AAGTGGCACCGAGTCGGTGCTCTGCCATCA<AAG> CG TGCTCAGTCTG (SEQ ID NO: 1694), where "< >" is used to denote the insertion sequence.

In addition, a set of second nick gRNAs, targeting a nick to the opposite DNA strand as the first nick, were designed that place a second nick either upstream or downstream of the location of the desired CTT insertion at various distances ranging from 26 to 257 bp. The upstream second nick creates a set of nicks with an inward orientation, with the PAM sites out (PAM-out), while the downstream second nick creates a set of nicks with an outward orientation, with the PAM sites inside the nicks (PAM-in), as described herein. Second nick gRNAs were designed using a web-based tool and are listed in Tables 54 and 55. The distance between dual nicks indicates the distance between the first nick directed by the template RNA and the second nick directed by the second nick gRNA, and the PAM orientation (e.g., "PAM-in" and thus outward orientation, or "PAM-out" and thus inward orientation) is provided with respect to the first nick as depicted in FIG. 31.

TABLE 54 gRNA targeting the second nick upstream of the first nick in "PAM-out" orientation

| PAM orientation to first nick | Orientation | Distance between dual nicks (nts) | sgRNA Sequence | PAM Sequence |
|---|---|---|---|---|
| out | antisense | 28 | TGGGCCCCAAGGATTGACCC (SEQ ID NO: 1695) | AGG |
| out | antisense | 33 | CCCAAGGATTGACCCAGGCC (SEQ ID NO: 1696) | AGG |
| out | antisense | 34 | CCAAGGATTGACCCAGGCCA (SEQ ID NO: 1697) | GGG |
| out | antisense | 38 | GGATTGACCCAGGCCAGGGC (SEQ ID NO: 1698) | TGG |
| out | antisense | 108 | GCAGAAATAGACTAATTGCA (SEQ ID NO: 1699) | TGG |
| out | antisense | 109 | CAGAAATAGACTAATTGCAT (SEQ ID NO: 1700) | GGG |
| out | antisense | 120 | TAATTGCATGGGCGTTTCCC (SEQ ID NO: 1701) | TGG |

TABLE 54-continued gRNA targeting the second nick upstream of the
first nick in "PAM-out" orientation

| PAM orientation to first nick | Orientation | Distance between dual nicks (nts) | sgRNA Sequence | PAM Sequence |
|---|---|---|---|---|
| out | antisense | 121 | AATTGCATGGGCGTTTCCCT (SEQ ID NO: 1702) | GGG |
| out | antisense | 136 | TCCCTGGGATCCCTGTCTCC (SEQ ID NO: 1703) | AGG |
| out | antisense | 161 | TCTCTCATCCATGCCTTTCT (SEQ ID NO: 1704) | AGG |
| out | antisense | 197 | CCCTTGCTTAAAACTCTCCA (SEQ ID NO: 1705) | AGG |
| out | antisense | 222 | TCTCATGCCAAGCTCCCTGC (SEQ ID NO: 1706) | AGG |
| out | antisense | 232 | AGCTCCCTGCAGGACATCCC (SEQ ID NO: 1707) | AGG |
| out | antisense | 240 | GCAGGACATCCCAGGCCCTC (SEQ ID NO: 1708) | TGG |
| out | antisense | 241 | CAGGACATCCCAGGCCCTCT (SEQ ID NO: 1709) | GGG |
| out | antisense | 255 | CCCTCTGGGACAGCAGCTCA (SEQ ID NO: 1710) | CGG |
| out | antisense | 256 | CCTCTGGGACAGCAGCTCAC (SEQ ID NO: 1711) | GGG |

TABLE 55 gRNA targeting the second nick downstream of the
first nick in "PAM-in" orientation

| PAM orientation to first nick | Orientation | Distance between dual nicks (nts) | sgRNA Sequence | PAM Sequence |
|---|---|---|---|---|
| In | antisense | 26 | GACGCCCTCTGGAGGAAGCA (SEQ ID NO: 1712) | GGG |
| In | antisense | 27 | CGACGCCCTCTGGAGGAAGC (SEQ ID NO: 1713) | AGG |
| In | antisense | 34 | TGTCCTGCGACGCCCTCTGG (SEQ ID NO: 1714) | AGG |
| Ir | antisense | 37 | AGCTGTCCTGCGACGCCCTC (SEQ ID NO: 1715) | TGG |
| In | antisense | 63 | GCACATACTAGCCCCTGTCT (SEQ ID NO: 1716) | AGG |
| In | antisense | 90 | GTCAACCAGTATCCCGGTGC (SEQ ID NO: 1717) | AGG |
| In | antisense | 96 | AAACTTGTCAACCAGTATCC (SEQ ID NO: 1718) | CGG |
| In | antisense | 133 | CCAGGGACCTCCCTAGGTGC (SEQ ID NO: 1719) | TGG |
| In | antisense | 139 | CCCCTTCCAGGGACCTCCCT (SEQ ID NO: 1720) | AGG |

TABLE 55-continued gRNA targeting the second nick downstream of the
first nick in "PAM-in" orientation

| PAM orientation to first nick | Orientation | Distance between dual nicks (nts) | sgRNA Sequence | PAM Sequence |
|---|---|---|---|---|
| In | antisense | 150 | GGTGAGGCTGGCCCCTTCCA (SEQ ID NO: 1721) | GGG |
| In | antisense | 151 | TGGTGAGGCTGGCCCCTTCC (SEQ ID NO: 1722) | AGG |
| In | antisense | 162 | CCCTCCTCTCCTGGTGAGGC (SEQ ID NO: 1723) | TGG |
| In | antisense | 166 | AGGTCCCTCCTCTCCTGGTG (SEQ ID NO: 1724) | AGG |
| In | antisense | 171 | GGGCCAGGTCCCTCCTCTCC (SEQ ID NO: 1725) | TGG |
| In | antisense | 186 | GAGCTCGACCCTGAAGGGCC (SEQ ID NO: 1726) | AGG |
| I1 | antisense | 191 | CTGTTGAGCTCGACCCTGAA (SEQ ID NO: 1727) | GGG |
| In | antisense | 192 | TCTGTTGAGCTCGACCCTGA (SEQ ID NO: 1728) | AGG |
| In | antisense | 233 | GCTGAAAGCCACTGGGCTCT (SEQ ID NO: 1729) | GGG |
| In | antisense | 234 | TGCTGAAAGCCACTGGGCTC (SEQ ID NO: 1730) | TGG |
| In | antisense | 240 | TGCAGGTGCTGAAAGCCACT (SEQ ID NO: 1731) | GGG |
| In | antisense | 241 | ATGCAGGTGCTGAAAGCCAC (SEQ ID NO: 1732) | TGG |
| In | antisense | 257 | TTGATCTCTGATTTTCATGC (SEQ ID NO: 1733) | AGG |

To conduct the experiment, 200,000 U2OS cells in 20 μL SE buffer are nucleofected with 800 ng of plasmid encoding the GENE WRITER™ polypeptide (N863ACas9-RT), 200 ng of template RNA, and 83 ng of a second nick gRNA listed in Tables 54 and 55. The Lonza Amaxa nucleofection system is used with the nucleofection code DN100. After nucleofection, 80 μL of DMEM+10% FBS medium are added to the cell suspension and the cells are plate in a 24 well plate with 500 μL of DMEM+10% FBS. Genomic DNA is extracted at day 3 post-nucleofection.

To analyze extracted DNA for the desired CTT insertion, amplicon sequencing is performed as described herein by amplifying the HEK locus using primers surrounding the first nick. The anticipated 300-350 bp amplicon is then sequenced on an Illumina MiSeq. The frequency of the desired CCT insertions is determined using the CRISPResso computational analysis pipeline (Clement et al. Nat Biotechnol 37 (3): 224-226 (2019)).

To measure undesired insertions and/or deletions arising as byproducts of the reaction, long-range amplification is performed with primers located >1.5 kb upstream and downstream of the first nick site, producing an amplicon >3 kb. This amplicon is sequenced using long-read sequencing (e.g., PacBio) and analyzed for the presence of insertions and deletions resulting from the dual nicking.

In some embodiments, a reaction using a second nick gRNA that cuts downstream of the first nick and provides a "PAM in" or outward orientation results in fewer unintended mutations (e.g., mutations in the target site other than the targeted CTT insertion) as compared to gRNAs placed upstream of the first nick at a similar distance but providing a "PAM-out" or inward orientation, as measured by the methods described herein. In other embodiments, a second nick gRNA that cuts upstream of the first nick and provides a "PAM-out" or inward orientation results in fewer undesired mutations (e.g., mutations in the target site other than the targeted CTT insertion) when the distance between the first and second nick is at least 100 nt as compared to a second nick gRNA providing a distance between the first and second nick of less than 100 nt, as measured by the methods described herein.

Figure 32A:
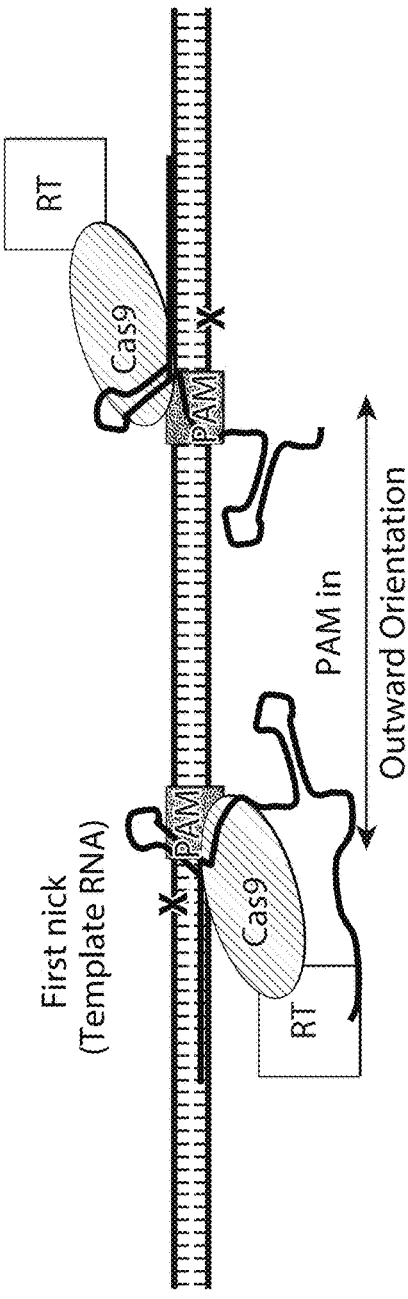
FIGS. 32A and 32B. An illustration of the orientation and position of second strand nicking in an exemplary GENE WRITING™ system and their effect on editing.
Figure 32B:
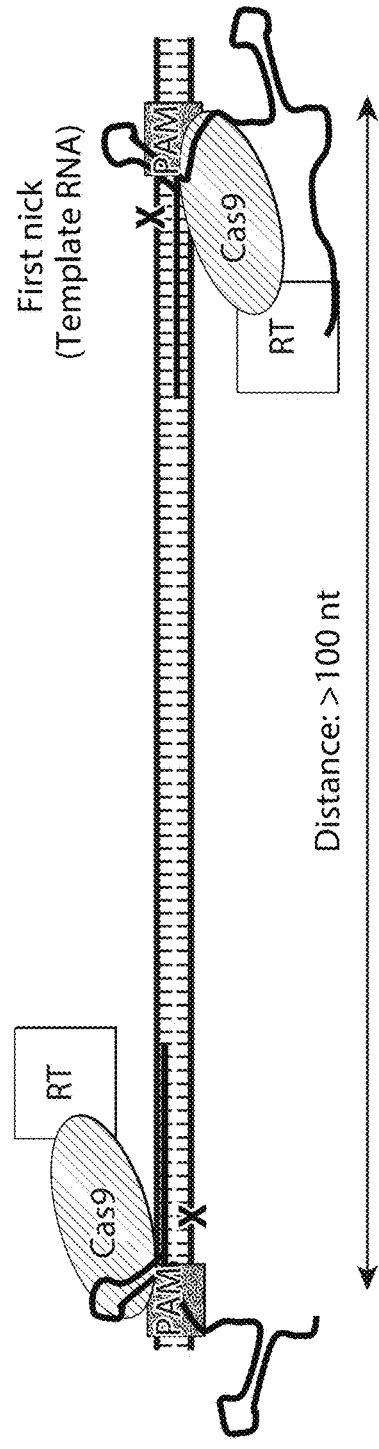

Thus, in some embodiments, a preferred design for a second nick gRNA is one resulting in 1) a "PAM-in" or outward orientation, or 2) a "PAM-out" or inward orientation with at least 100 nt separation between the first and second nicks (FIG. 32).

Example 30: Design and Human Cell Expression of GENE WRITING™ Systems Utilizing Various Cas-RT Fusions This example describes the construction and expression of GENE WRITING™ polypeptides comprising fusions of Cas and reverse transcriptase domains in mammalian cells. GENE WRITING™ polypeptides with these domains have been shown herein to enable the precise, site-specific modification of a DNA target from an RNA template molecule. Here, we describe the expression of a library of domains to create novel systems that may have diverse functional characteristics. More specifically, described here are fusion proteins comprising 1) a Cas-nuclease containing a mutation inactivating one endonuclease active site, e.g., the Cas9 nickase Cas9 (N863A); 2) a peptide-linker to connect the functional protein domains, e.g., a sequence from Table 13 or 56, e.g., SGGSSGGSSGSETPGTSESAT-PESSGGSSGGSS (SEQ ID NO: 1589); and 3) a reverse transcriptase (RT), e.g., an RT domain described in this application, e.g., an RT domain comprising a sequence from Table 2, Table 4, Table 5, Table 6, or Table 8, or a derivative thereof may be used in such an assay, collectively referred to in this Example as Cas-RT. Accordingly, Cas-RT fusion proteins are assembled on a plasmid and co-delivered with a single guide RNA (sgRNA) expression plasmid to validate system expression in human cells.

Figure 33:
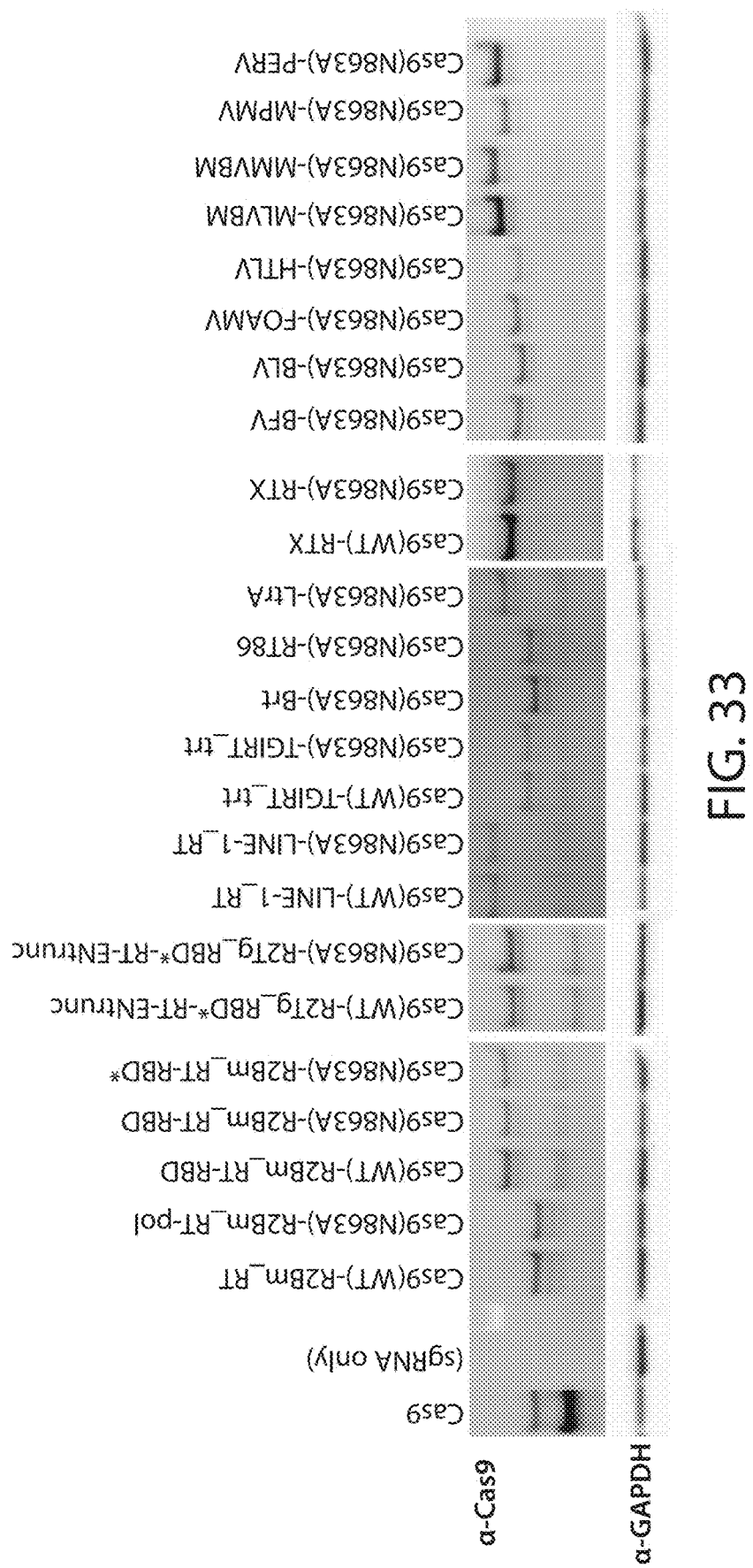
FIG. 33. Shows generation and expression of Cas9-RT fusion proteins. To assess expression of novel GENE WRITER™ polypeptides in human cells, U2OS cells were transfected with Cas-RT expression plasmids harboring various RT domains from Tables 2 and 5 fused to a wild-type (WT) or Cas9 (N863A) nickase. Cell lysates were collected on day 2 post-transfection and analyzed by Western blot using a primary antibody against Cas9. A primary antibody against GADPH was included as a loading control.

GENE WRITER™ polypeptides generated by Cas-RT domain fusions assayed here comprised: (1) a Cas9 wild-type or Cas9 (N863A) nickase domain; (2) a peptide linker (SGGSSGGSSGSETPGTSESATPESSGGSSGGSS (SEQ ID NO: 1589)); (3) a selection of RT domains from Table 2 and Table 5 taken from diverse sources; and (4) at least one nuclear localization signal. U2OS or HEK293T cells were transfected by Lonza Amaxa nucleofection of 250,000 cells/well with ~800 ng of Cas9 (N863A)-RT fusion plasmid with 200 ng of a sgRNA plasmid. To assess the expression level of Cas9-RT fusions, cell lysates were collected on day 2 post-transfection and analyzed by Western blot using a primary antibody against Cas9. Several Cas9-RT fusions showed appreciable protein expression (FIG. 33), suggestive of expression levels sufficient for GENE WRITING™ activity. Notably, a wide range of expression levels is observed for the different Cas9-RT constructs, demonstrating the impact of the fusion design and RT selection on expression level of Cas-RT in cells.

Example 31: Improvement of Expression of Cas-RT Fusions Through Linker Selection This example demonstrates the optimization of Cas-RT fusions to improve protein expression in mammalian cells. As described in Example 30, construction of novel Cas-RT fusions by the simple substitution of new functional domains may result in low or moderate expression of the GENE WRITER™ polypeptide. Thus, it is contemplated here that modified configurations of the fusion may be advantageous in the context of different domains. Without wishing to be limited by the example, one such approach for improving the expression and stability of new fusions is through the use of a linker library. Here, the peptide linker sequence between the Cas and RT domains of the Cas-RT fusion is varied using a library of linker sequences. More specifically, linkers from Table 56 were used to generate new variants of a Cas9-RT fusion construct previously demonstrating low protein expression (see Example 30 and FIG. 33) and delivered to human cells to screen for improved Cas-RT protein expression.

Figure 34:
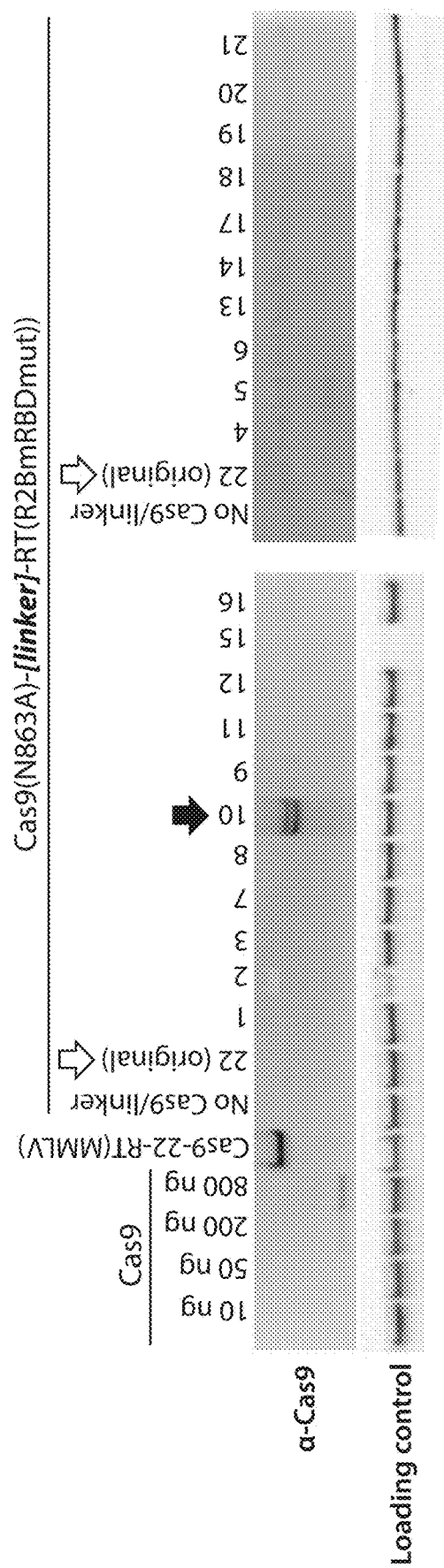
FIG. 34. Shows improving expression of Cas-RT fusions through choice of linker sequence. To assess how linkers can alter the expression of novel GENE WRITER™ polypeptides in human cells, U2OS cells were transfected with Cas-RT expression plasmids harboring various linkers from Table 56 fusing the Cas9 (N863A) nickase to the RT domain of an RNA-binding domain mutated R2Bm retrotransposase. Cell lysates were collected and analyzed by Western blot using a primary antibody against Cas9. A primary antibody against vinculin (left) or GADPH (right) was included as a loading control. Cas9 controls on the left represent titration of a Cas9 expression plasmid. Empty arrows indicate the original linker tested, while the filled arrow represents a linker (Linker 10) found to substantially improve expression of the fusion polypeptide. Sample numbers correspond to linker sequence identifiers in Table 56.

A set of 22 peptide linkers (Table 56) with varying degrees of length, flexibility, hydrophobicity, and secondary structure was first used to generate variants of a Cas-RT fusion protein by substitution of the original linker (see Example 30). HEK293T cells were transfected by electroporation of 250,000 cells/well with ~800 ng of each Cas9-RT fusion plasmid along with 200 ng of a single-guide RNA plasmid. To assess the expression level of Cas9-RT fusions, cell lysates were collected on day 2 post-transfection and analyzed by Western blot using a primary antibody against Cas9. Linker 10 listed in Table 56 significantly improved Cas-RT fusion expression (FIG. 34), demonstrating the potentially profound impact of the peptide linker sequence on Cas-RT expression.

TABLE 56

Peptide sequences used as linkers between the Cas and RT domains in Gene Writer ™ polypeptides comprising Cas-RT fusions

| # | Linker sequence | SEQ ID NO: | Notes |
|---|---|---|---|
| 1 | GGS | | Short |
| 2 | GGGGS | 1535 | Flexible, short |
| 3 | (GGGGS)$_2$ | 3303 | Flexible |
| 4 | (GGGGS)$_3$ | 3304 | Flexible, long |
| 5 | (GGGGS)$_4$ | 3305 | Flexible, very long |
| 6 | (G)$_6$ | 3310 | Flexible |
| 7 | (G)$_8$ | 3312 | Flexible |
| 8 | GSAGSAAGSGEF | 3410 | Flexible |
| 9 | (GSSGSS) | 1736 | Mid |
| 10 | (GSSGSS)$_2$ | 3314 | Mid, Flexible |
| 11 | (GSSGSS)$_3$ | 3316 | Mid |
| 12 | SGSETPGTSESATPES | 1023 | XTEN |
| 13 | (EAAAK) | 1534 | Rigid helix, short |
| 14 | (EAAAK)$_2$ | 3317 | Rigid helix, mid |
| 15 | (EAAAK)$_3$ | 3318 | Rigid helix, long |
| 16 | PAP | | Rigid, short |
| 17 | PAPAP | 3322 | Rigid, short |
| 18 | PAPAPAPAP | 3324 | Rigid, mid |
| 19 | A(EAAAK)$_4$ALEA(EAAAK)$_4$A | 3407 | Rigid, very long with helices |
| 20 | GGGGS(EAAAK)GGGGS | 3408 | Flexible-helix-flex |

TABLE 56-continued

Peptide sequences used as linkers between the Cas and RT domains in Gene Writer ™ polypeptides comprising Cas-RT fusions

| # | Linker sequence | SEQ ID NO: | Notes |
|---|---|---|---|
| 21 | (EAAAK)GGGGS (EAAAK) | 3409 | Helix-flex-helix |
| 22 | SGGSSGGSSGS ETPGTSESATP ESSGGSSGGSS | 1589 | Flexible-XTEN-flexible |

Example 32: Cas-Mediated Cleavage Activity of GENE WRITER™ Genome Editor Polypeptides Comprising Cas-RT Fusions This example demonstrates the ability of Cas-RT fusions to retain functionality of the protein domains. Specifically, by assaying cells treated with GENE WRITER™ polypeptides comprising a cleavage-competent Cas domain (cleavase), DNA binding can be read by target site analysis to demonstrate activity of Cas in the context of the fusions. Here, such Cas-RT cleavase fusions in which both nuclease active sites are functional, e.g., Cas9 (wild-type)-RT, were co-delivered on plasmid vectors along with a sgRNA-expression plasmid to target the Cas to the AAVS1 site in human cells. Analysis of indel formation at the predicted cleavage site in AAVS1 by Cas-RT cleavase fusions functioned as a readout of both DNA binding activity and endonuclease activity, thereby confirming effective DNA targeting by the Cas-RT fusions.

Cas-RT fusions with fully functional endonuclease domains, e.g., comprising wild-type Cas9 with both nuclease active sites intact, e.g., Cas9 (N863), were generated from Cas-RT fusion proteins described herein, e.g., comprising a Cas9 nickase, e.g., Cas9 (N863A), in order to increase the sensitivity of detection of DNA binding and cleavage. Since the intact Cas9 nuclease can cut both strands to generate a double-stranded cleavage event in the genome, repair of these sites generates a higher mutation (indel) signal than repair of a single-stranded DNA nick. Thus, the frequency of indel formation of the fusions was compared to that of unfused, wild-type Cas9 in order to assess the maintenance of Cas functionality when placed in the context of the novel Cas-RT fusions.

Figure 35:
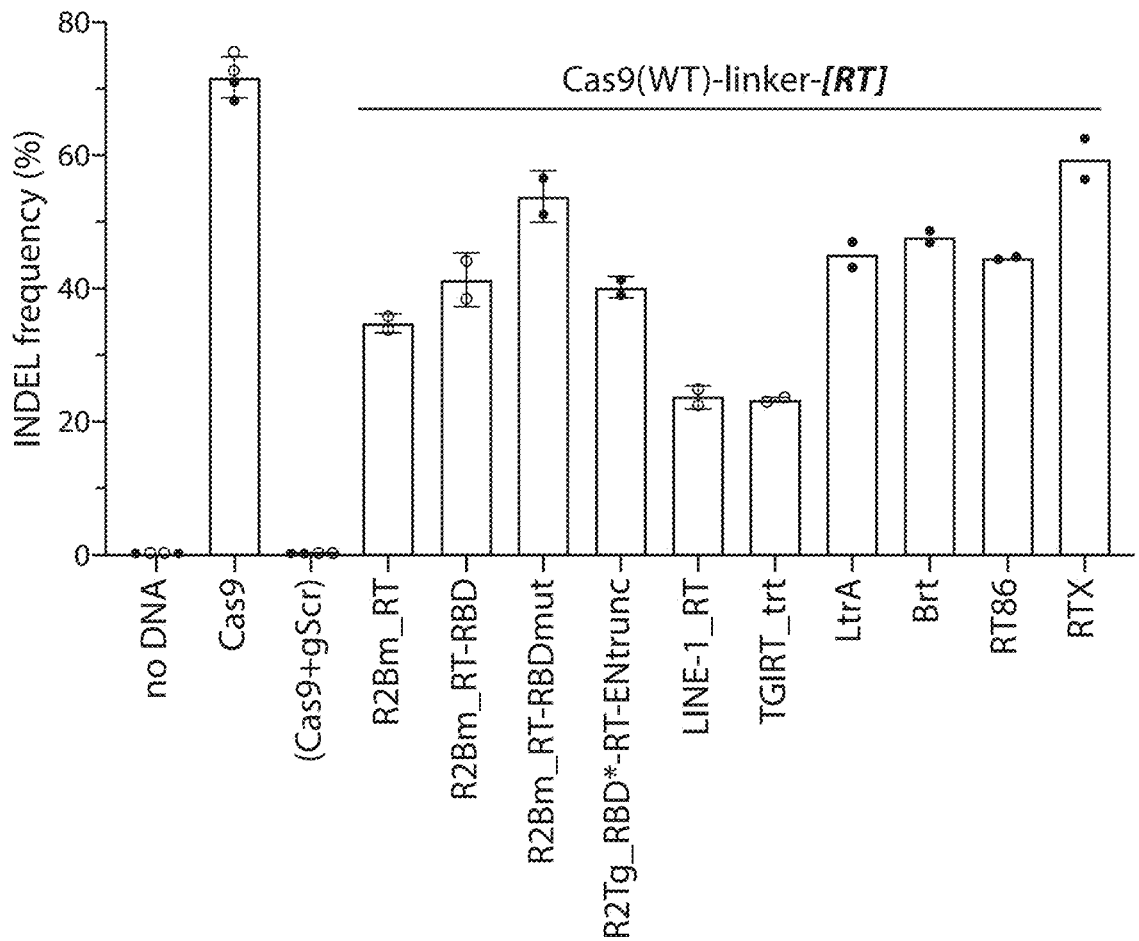
FIG. 35. Shows Cas/gRNA DNA targeting activity is preserved in Cas-RT fusions. Various RT domains were fused to Cas9 (WT) and electroporated into U2OS cells. Genomic DNA was harvested and analyzed for mutational signatures by next generation sequencing. Mutations in the RNA or DNA-binding domains (RBD or DBD) of R2 retrotransposase domains is indicated, where relevant. Indel frequency is used here as a proxy for Cas activity preservation in the context of the RT fusion.

U2OS or HEK293T cells were transfected by Lonza Amaxa nucleofection of 250,000 cells/well with ~800 ng of Cas9 (WT)-RT fusion plasmid along with 200 ng of a sgRNA plasmid to produce the gRNA targeting Cas9 to AAVS1 (Table 57 gRNA P7). To assess the DNA binding and cleavage activity of Cas9-RT cleavase fusions, genomic DNA (gDNA) was collected on day 3 post-transfection. Indel patterns in the gDNA were analyzed by amplicon sequencing at loci targeted by the sgRNA. Sequencing results were analyzed by the CRISPResso2 pipeline (Clement et al Nat Biotechnol 37 (3): 224-226 (2019)). All tested Cas-RT cleavase fusions showed indel formation commensurate to their respective protein expression levels (FIG. 33), indicating that Cas-mediated DNA binding activity is retained in Cas-RT fusions (FIG. 35).

Example 33: GENE WRITER™ Genome Editor Polypeptides Comprising Cas-RT Fusions with Various RT Domains Enable Precise Editing in Human Cells This example demonstrates the ability of multiple tested Cas-RT fusions to programmably install mutations in genomic DNA in human cells. More specifically, the reverse transcriptase domain of Cas-RT fusions, e.g., an RT domain described in this application, was varied to determine the genome editing capacity of Cas-RT fusions employing novel RT combinations. Template RNAs were co-delivered on plasmid vectors along with Cas-RT expression plasmids in human cells to determine the Rewriting activity of Cas-RT fusions.

In order to generate domain libraries for GENE WRITER™ polypeptides, Cas effector proteins were selected; see in Table 12 and Table 11. Additional Cas9 domains were further selected for use in the GENE WRITER™ polypeptides described herein, as features including PAM requirements of a target sequence, predicted mutations for conferring nickase activity (e.g., D10A, H840A, or N863A for SpCas9), and gRNA features including single-guide composition, e.g., specific spacer parameters and gRNA scaffold sequence for conferring polypeptide binding for the cognate Cas enzyme, were able to be determined (Table 11). Linker sequences to connect Cas and RT domains were collected based on a search for diversity of length, flexibility, and composition in order to optimize fusion proteins (Tables 13 and 56). Optimization of fusion expression by linker screening is further described in Example 31. Reverse transcriptase domains were mined from a variety of sources using literature and RT protein domain signatures as described in this application, including from non-LTR retrotransposons, LTR retrotransposons, group II introns, diversity-generating elements, retrons, telomerases, retroplasmids, retroviruses, and polymerases with evolved RNA-dependent DNA polymerase activity (e.g., an RT domain comprising a sequence from Table 2, Table 4, Table 5, Table 6, Table 9, or Table 8, or a derivative thereof may be used in such an assay).

Figures 36A, 36B:
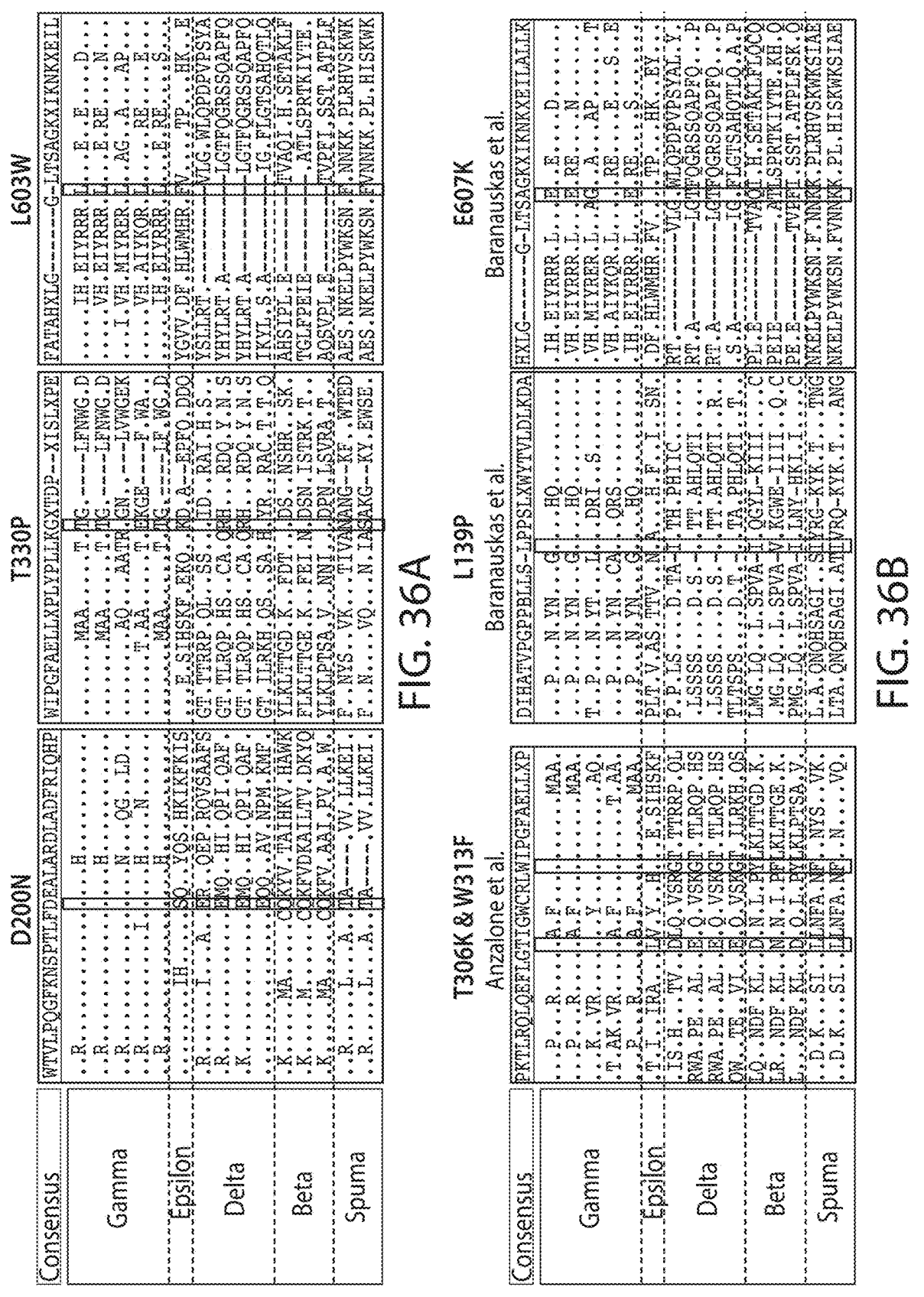

Specifically, to assess the use of novel RT domains in the context of a GENE WRITER™ polypeptide to successfully edit the genome, a subset of exemplary RT domains from retroviruses was selected for fusion to a Cas9 (N863A) nickase. Briefly, a database of POL proteins from Retroviridae was first generated and then prioritized (see The UniProt Consortium Nucleic Acids Res 47 (D1): D506-D515 (2019); Mitchell et al. Nucleic Acids Res 47 (D1): D351-D360 (2019)). Though not wishing to be limited by such example, retroviral RTs from the genera Betaretrovirus, Deltaretrovirus, Gammaretrovirus, and Spumavirus may function as monomeric proteins (see, for example, Table 1 from Herschhorn et al Cell Mol Life Sci 67 (16): 2717-2747 (2010)) and thus may be advantageous for use in a fusion protein, as described herein. A selection of retroviral monomeric RT sequences emerging from the analysis with these criteria is shown in Table 9. Further, mutations that have been shown to stabilize RT domains, as described in this application and in the literature (Table 18) (Anzalone et al Nat Biotechnol 38 (7): 824-844 (2020); Baranauskas et al Protein Eng Des Sel 25 (10): 657-668 (2012); Arezi and Hogrefe Nucleic Acids Res 37 (2): 473-481 (2009); Yasukawa et al J Biotechnol 150 (3): 299-306 (2010); the findings of which as they relate to improving RT stability and function are incorporated herein in their entirety), were analyzed for application to candidate RT domains (positions provided here based on the MMLV RT amino acid sequence as reference). As examples, MMLV RT with the mutational profile L139P/D200N/T330P/L603W/E607K showed an approximately 65-fold increase in processivity and 48-fold increase in template affinity (Baranauskas et al Protein Eng Des Sel 25 (10): 657-668 (2012)) and increased efficiency of prime editing of genomic DNA by a range of 1.6-5.1-fold with mutational profile D200N/T306K/W313F/T330P/L603W (Anzalone et al Nat Biotechnol 38 (7): 824-844 (2020)). From these studies, the core set of D200N/T330P/L603W was identified and an alignment of RT domains from the retroviral genera described here was used to predict the relevant amino acid positions where conserved (FIG. 36A). The additional mutations T306K and/or W313F were also applied where relevant and L139P and/or E607K was used when neither mutation of the T306K/W313F set was able to be applied (FIG. 36B). Cas9 nickase fusions with these wild-type RT domains or mutational variants with potentially improved activity were generated and exemplary fusions are described in Table 19.

To generate precise edits using GENE WRITER™ Cas-RT fusions, Template RNAs were constructed to template reverse transcription of an edit into the genomic target site by the RT domain. Template RNAs were designed to comprise (i) a gRNA spacer sequence for guiding the Cas-RT to the target region, e.g., a sequence complementary to a 20-nucleotide sequence in the HEK3 locus; (ii) a primer-binding sequence capable of complementary base pairing with a single strand of the nicked DNA for target-primed reverse transcription; (iii) a heterologous object sequence providing a template for reverse transcription that further comprises the intended final target sequence; and (iv) a gRNA scaffold sequence to associate with the Cas9 domain of the Cas9-RT polypeptide fusion. The constructs employed here specifically followed the 5' to 3' orientation (i), (iv), (iii), (ii). Template RNAs encoded on plasmids were cloned such that expression was driven by the U6 promoter and transcription termination controlled by a 7 nt polyT stretch following the primer-binding sequence at the 3' end of the Template RNA cassette. Template compositions are described in Table 57 (Templates P1, P2, P3).

Figure 37:
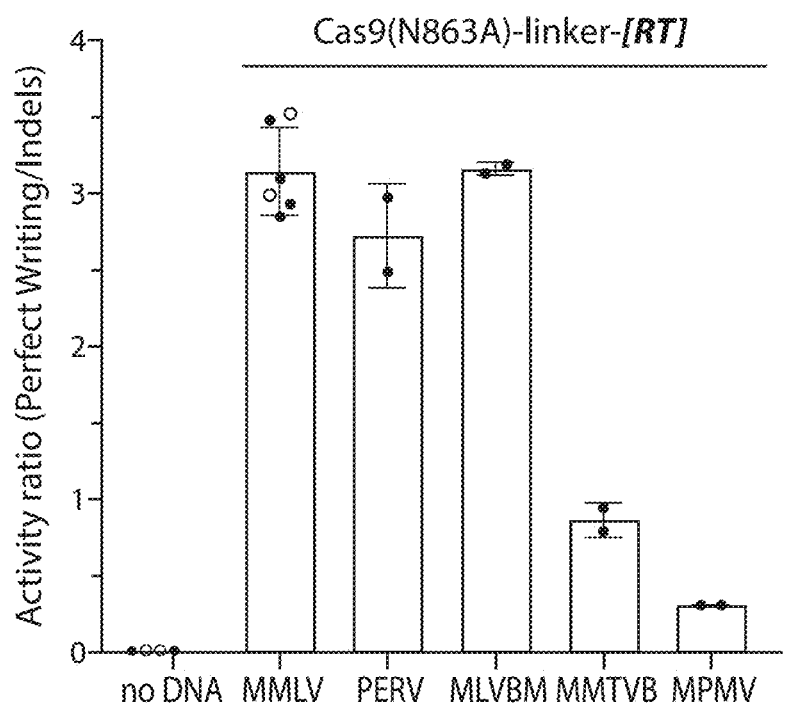
FIG. 37. U2OS cells were nucleofected with various Cas-RT fusion vectors in which the RT domain was selected from a database of monomeric retroviral reverse transcriptase domains. Editing of a HEK3 locus using a Template described in Table 57 was assessed by amplicon sequencing and analysis of precise editing vs indel signatures. Data are represented here as Activity Ratios, which are calculated as the ratio of the frequency of reads with the precisely intended edit (CTT insertion at the target nick site) to the frequency of reads with any other mutations (indels). Three Template RNA configurations assayed resulted in similar outcomes, so the results for a single template (Template P2 from Table 57) are shown.

U2OS or HEK293T cells were transfected by electroporation of 250,000 cells/well with ~800 ng of Cas9-RT (MMLV) fusion expression plasmid, 200 ng of a Template RNA expression plasmid, and 83 ng of an additional second-nick gRNA (2gRNA P5) expression plasmid (Table 57). To assess the genome editing capacity of Cas-RT fusions, genomic DNA (gDNA) was collected on day 3 post-transfection. The frequency of intended (exact and scarless edit as designed) versus unintended (any non-intended changes to the target sequence) edits ("Activity ratio") at target loci were analyzed by amplicon sequencing. As used herein, amplicon sequencing of a target site comprises the use of site-specific primers in PCR amplification of the target site, sequencing of amplicons on an Illumina MiSeq, and detection and characterization of editing events using the CRISPResso2 pipeline (Clement et al Nat Biotechnol 37 (3): 224-226 (2019)). Several Cas-RT fusions showed appreciable genome editing activity, with multiple Cas-RT fusions having Activity Ratios of ~3 (FIG. 37), demonstrating that various Cas-RT fusions drawing from reverse transcriptase domains described herein can efficiently and precisely encode edits into the human genome.

TABLE 57

List of Template RNA and gRNA used in select examples.

| Name | Description | spacer | scaffold | RT + ins | PBS | Template RNA |
|---|---|---|---|---|---|---|
| Template P1 | HEK3_8PBS_10RT (CTTat1) | GGCCCAGACTGA GCACGTGA (SEQ ID NO: 3574) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | TCTGCCATCAA AG (SEQ ID NO: 3576) | CGTG CTCA | GGCCCAGACTGAG CACGTGAGTTTTAG AGCTAGAAATAGC AAGTTAAAATAAG GCTAGTCCGTTATC AACTTGAAAAAGT GGCACCGAGTCGGT GCTCTGCCATCAAA GCGTGCTCA (SEQ ID NO: 3577) |
| Template P2 | HEK3_13PBS_10RT (CTTat1) | GGCCCAGACTGA GCACGTGA (SEQ ID NO: 3574) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | TCTGCCATCAA AG (SEQ ID NO: 3576) | CGTG CTCA GTCT G (SEQ ID NO: 3578) | GGCCCAGACTGAG CACGTGAGTTTTAG AGCTAGAAATAGC AAGTTAAAATAAG GCTAGTCCGTTATC AACTTGAAAAAGT GGCACCGAGTCGGT GCTCTGCCATCAAA GCGTGCTCAGTCTG (SEQ ID NO: 3579) |
| Template P3 | HEK3_17PBS_10RT (CTTat1) | GGCCCAGACTGA GCACGTGA (SEQ ID NO: 3574) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | TCTGCCATCAA AG (SEQ ID NO: 3576) | CGTG CTCA GTCT GGGC C (SEQ ID NO: 3580) | GGCCCAGACTGAG CACGTGAGTTTTAG AGCTAGAAATAGC AAGTTAAAATAAG GCTAGTCCGTTATC AACTTGAAAAAGT GGCACCGAGTCGGT GCTCTGCCATCAAA GCGTGCTCAGTCTG GCC (SEQ ID NO: 3581) |

TABLE 57-continued

List of Template RNA and gRNA used in select examples.

| Name | Description | spacer | scaffold | RT + ins | PBS | Template RNA |
|---|---|---|---|---|---|---|
| Template P4 | HBB_13PBS_10RT (TtoAat4) | GCATGGTGCACC TGACTCCTG (SEQ ID NO: 3582) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | AGACTTCTCCA CAG (SEQ ID NO: 3583) | GAGT CAGG TGCA C (SEQ ID NO: 3584) | GCATGGTGCACCTG ACTCCTGGTTTTAG AGCTAGAAATAGC AAGTTAAAATAAG GCTAGTCCGTTATC AACTTGAAAAAGT GGCACCGAGTCGGT GCAGACTTCTCCAC AGGAGTCAGGTGC AC (SEQ ID NO: 3585) |
| 2gRNA P5 | HEK3_+90 | GTCAACCAGTAT CCCGGTGC (SEQ ID NO: 1717) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | NA | NA | NA |
| 2gRNA P6 | HBB_+72 | GCCTTGATACCA ACCTGCCCA (SEQ ID NO: 3586) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | NA | NA | NA |
| gRNA P7 | g19_AAVS1 | GTCCCCTCCACC CCACAGTG (SEQ ID NO: 3587) | GTTTTAGA GCTAGAAA TAGCAAGT TAAAATAA GGCTAGTC CGTTATCA ACTTGAAA AAGTGGCA CCGAGTCG GTGC (SEQ ID NO: 3575) | NA | NA | NA |

Example 34: Multiplexing of a GENE WRITER™ System to Simultaneously Edit Multiple Loci in a Human Cell This example demonstrates the use of a GENE WRITER™ system to edit multiple sites in the genome. In some applications, it may be of high value to be able to engineer multiple locations in the genome, e.g., to correct multiple genetic mutations or to optimize an engineered cell for cell therapy by performing multiple simultaneous modifications ex vivo or in vivo. In this example, a 3-plasmid system is utilized comprising: 1) a GENE WRITER™ polypeptide expression plasmid, e.g., a plasmid encoding a Cas9 nickase fused to a reverse transcriptase (Cas-RT); 2) a Template plasmid, e.g., a plasmid encoding an expression cassette for a Template RNA that determines the genome site and the edit to instill at that site; and 3) a second-nick gRNA expression plasmid, e.g., a plasmid encoding an additional gRNA sequence to direct a second-strand nick for Cas9 at a location proximal to the target site.

In this example, two genome loci, the HBB gene and the human HEK3 locus, were targeted using gRNA comprising spacer sequences with identity to these sites to determine the ability to target multiple loci in parallel. To assess targeting of either locus separately or both simultaneously, cells were treated with different compositions of the Template plasmids to enable targeting of: 1) HEK3 alone, 2) HBB alone, or 3) both HBB and the HEK3 locus. Specifically, 800 ng of plasmid encoding the Cas9-RT (MMLV) fusion (Table 19), 200 ng of plasmid encoding the HEK3-modifying Template (Template P2, Table 57) and/or plasmid encoding the HBB-modifying Template (Template P4, Table 57), and 83 ng of plasmid encoding the HEK3 second-nick gRNA (2gRNA P5, Table 57) and/or plasmid encoding the HBB second-nick gRNA (2gRNA P6, Table 57) were nucleofected using nucleofection program DS_150 into HEK293T cells. After nucleofection, cells were grown at 37° C., 5% $CO_2$ for 3 days prior to cell lysis and genomic DNA extraction. Primers specific to each locus were used to amplify the region and amplicons were sequenced using an Illumina MiSeq. Perfect correction and indel rates were analyzed using the CRISPResso2 pipeline (Clement et al Nat Biotechnol 37 (3): 224-226 (2019)) to determine GENE WRITING™ efficacy. Table 58 lists the components of the GENE WRITER™ System used in this example.

TABLE 58

| Name | Description | spacer | scaffold | RT + ins | PBS | Template RNA |
|---|---|---|---|---|---|---|
| Template P1 | HEK 3_8P BS_1 0RT (CTTat1) | GGCCCAGACTGAGCACGTGA (SEQ ID NO: 3574) | GTTTTAGAGCTAGAAATAGCAAGTTAAAATAAGGCTAGTCCGTTATCAACTTGAAAAAGTGGCACCGAGTCGGTGC (SEQ ID NO: 3575) | TCTGCCATCAAAG (SEQ ID NO: 3576) | CGTGCTCA | GGCCCAGACTGAGCACGTGAGTTTTAGAGCTAGAAATAGCAAGTTAAAATAAGGCTAGTCCGTTATCAACTTGAAAAAGTGGCACCGAGTCGGTGCTCTGCCATCAAAGCGTGCTCA (SEQ ID NO: 3577) |
| Template P2 | HEK 3_13 PBS_10RT (CTTat1) | GGCCCAGACTGAGCACGTGA (SEQ ID NO: 3574) | GTTTTAGAGCTAGAAATAGCAAGTTAAAATAAGGCTAGTCCGTTATCAACTTGAAAAAGTGGCACCGAGTCGGTGC (SEQ ID NO: 3575) | TCTGCCATCAAAG (SEQ ID NO: 3576) | CGTGCTCAGTCTG (SEQ ID NO: 3578) | GGCCCAGACTGAGCACGTGAGTTTTAGAGCTAGAAATAGCAAGTTAAAATAAGGCTAGTCCGTTATCAACTTGAAAAAGTGGCACCGAGTCGGTGCTCTGCCATCAAAGCGTGCTCAGTCTG (SEQ ID NO: 3579) |
| Template P3 | HEK 3_17 PBS_10RT (CTTat1) | GGCCCAGACTGAGCACGTGA (SEQ ID NO: 3574) | GTTTTAGAGCTAGAAATAGCAAGTTAAAATAAGGCTAGTCCGTTATCAACTTGAAAAAGTGGCACCGAGTCGGTGC (SEQ ID NO: 3575) | TCTGCCATCAAAG (SEQ ID NO: 3576) | CGTGCTCAGTCTGGCC (SEQ ID NO: 3580) | GGCCCAGACTGAGCACGTGAGTTTTAGAGCTAGAAATAGCAAGTTAAAATAAGGCTAGTCCGTTATCAACTTGAAAAAGTGGCACCGAGTCGGTGCTCTGCCATCAAAGCGTGCTCAGTCTGGGCC (SEQ ID NO: 3581) |
| Template P4 | HBB_13P BS_1 0RT (TtoAat4) | GCATGGTGCACCTGACTCCTG (SEQ ID NO: 3582) | GTTTTAGAGCTAGAAATAGCAAGTTAAAATAAGGCTAGTCCGTTATCAACTTGAAAAAGTGGCACCGAGTCGGTGC (SEQ ID NO: 3575) | AGACTTCTCCACAG (SEQ ID NO: 3583) | GAGTCAGGTGCAC (SEQ ID NO: 3584) | GCATGGTGCACCTGACTCCTGGTTTTAGAGCTAGAAATAGCAAGTTAAAATAAGGCTAGTCCGTTATCAACTTGAAAAAGTGGCACCGAGTCGGTGCAGACTTCTCCACAGGAGTCAGGTGCAC (SEQ ID NO: 3585) |
| 2gRNA P5 | HEK3_+90 | GTCAACCAGTATCCCGGTGC (SEQ ID NO: 1717) | GTTTTAGAGCTAGAAATAGCAAGTTAAAATAAGGCTAGTCCGTTATCAACTTGAAAAAGTGGCACCGAGTCGGTGC (SEQ ID NO: 3575) | NA | NA | NA |
| 2gRNA P6 | HBB_+72 | GCCTTGATACCAACCTGCCCA (SEQ ID NO: 3586) | GTTTTAGAGCTAGAAATAGCAAGTTAAAATAAGGCTAGTCCGTTATCAACTTGAAAAAGTGGCACCGAGTCGGTGC (SEQ ID NO: 3575) | NA | NA | NA |
| gRNA P7 | g19_AAV S1 | GTCCCCTCCACCCCACAGTG (SEQ ID NO: 3587) | GTTTTAGAGCTAGAAATAGCAAGTTAAAATAAGGCTAGTCCGTTATCAACTTGAAAAAGTGGCACCGAGTCGGTGC (SEQ ID NO: 3575) | NA | NA | NA |

Figure 38:
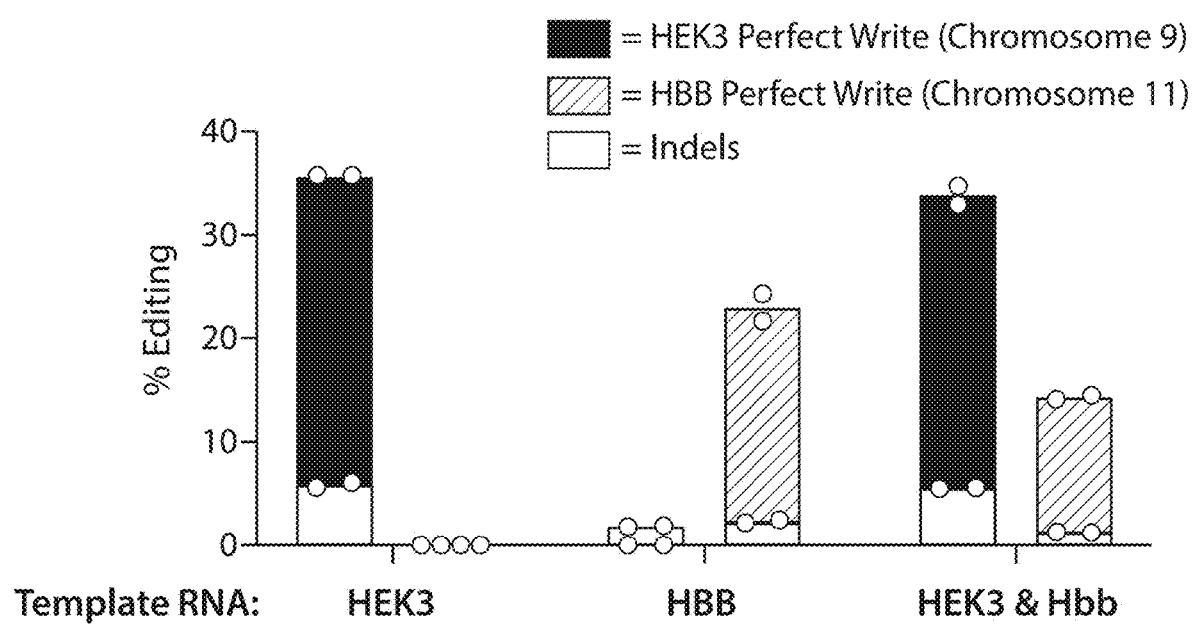
FIG. 38. shows targeting multiple loci simultaneously results in efficient GENE WRITING™ activity. HEK293 cells were nucleofected with GENE WRITING™ systems comprising different compositions of Template plasmids to enable targeting of: 1) HEK3 alone, 2) HBB alone, or 3) both HBB and the HEK3 locus. Percent of editing is indicated for each locus upon delivery of one or both locus-specific Template RNA expression plasmids. Filled bars represent Perfect Writing events, while unfilled bars represent the frequency of indels. Target-locus-specific editing was seen when delivering either Template independently, and highly efficient and specific edits were seen at both loci when co-delivering the Templates.

When tested independently, both targets saw a high degree of precise correction, with approximately 36% editing in HEK3 and 23% editing in HBB (FIG. 38). Further, when targeted at the same time, approximately 34% editing of HEK3 and 14% editing of HBB target sites was achieved with precise correction conferred by the respective Template RNAs. Additionally, insertions and deletions were observed with low frequency in all conditions, with indels for each locus reaching similar levels when tested alone or in combination. Though not the express intent of this example, the lack of increase in indels during simultaneous editing is a positive indicator for the potential to increase the number of loci targetable in parallel without compromising the precision of each individual edit.

Example 35: Delivery of DNA-Free GENE WRITER™ Systems Through Nucleofection of Human Cells This example describes the application of a GENE WRITER™ system to edit the genome in human cells via delivery of RNA components, e.g., mRNA encoding the GENE WRITER™ polypeptide and an RNA template. Without wishing to be bound by theory, the ability to deliver only RNA components in the absence of DNA is expected to confer major advantages to this system, including a reduction in immunogenicity and cellular toxicity linked to the detection of DNA in the cytoplasm and the availability of lipid nanoparticles systems described herein, the majority of which are optimized for RNA delivery, that can circumvent issues associated with viral delivery of nucleic acid therapeutics (e.g., manufacturing challenges, pre-existing immunity, immunogenic response to viral proteins). The reduction in cellular toxicity through use of an RNA system may be especially important for the modification of more sensitive cell types, such as primary cells. Further, nucleofection may be an effective method of delivering these systems to a patient's cells, e.g., for ex vivo cell engineering. Thus, it is of significant value to demonstrate the capacity of a GENE WRITING™ system to function appropriately when delivered as all RNA and in the absence of DNA. Specifically, this example demonstrates delivery of an all-RNA GENE WRITING™ system to modify the genome of HEK293T cells. To demonstrate RNA-based GENE WRITING™ is not limited to a single composition, two versions of a Cas-RT fusion polypeptide are employed that comprise an RT domain derived from either Moloney murine leukemia virus (Cas9-RT (MMLV)) or porcine endogenous retrovirus (Cas9-RT (PERV)) (Table 19).

GENE WRITER™ polypeptide-encoding mRNAs (1) were generated using T7 polymerase-driven in vitro transcription. In general, plasmids encoding the mRNA constructs comprised a transcriptional cassette comprising the following components: T7 promoter, 5'UTR, GENE WRITER™ coding sequence (Cas9 nickase fused with a reverse transcriptase by a peptide linker and further comprising a nuclear localization signal), 3'UTR, and an 80 nt polyA tail (SEQ ID NO: 3666). In this example, RNA molecules were prepared using unmodified nucleotides from linearized plasmid template. The mRNAs encoding Cas9-RT (MMLV) or Cas9-RT (PERV) (Table 20) were co-transcriptionally capped with CLEANCAP™ AG (TriLink BioTechnologies).

GENE WRITER™ Template RNAs (2) encoding genomic edits were generated by chemical synthesis and purified by standard desalting. The first and last three bases of each Template RNA comprised 2'-O-methyl phosphorothioate modifications. Template RNAs of varying length were designed to introduce different mutations into the human HEK3 locus (Table 59).

Where indicated, second nick gRNAs (3) were generated by chemical synthesis and comprised the following sequence modifications:

```
                                    (SEQ ID NO: 3588)
    mG*mC*mA*rGrArArArUrArGrArCrUrArArUrUr

GrCrArGrUrUrUrUrArGrArGrCrUrArGrArArAr

UrArGrCrArArGrUrUrArArArUrArArGrGrCr

UrArGrUrCrCrGrUrUrArUrCrArArCrUrUrGrAr

ArArArArGrUrGrGrCrArCrCrGrArGrUrCrGrGr

UrGrCmU*mU*mU*rU.
```

To assay the RNA GENE WRITING™ systems described herein, HEK293T cells were plated 2 days before nucleofection to obtain 70-80% confluency on the day of nucleofection. RNAs were mixed according to the following combinations: i) Cas9-RT mRNA (1) only; ii) Cas9-RT mRNA (1), template RNA (2), and second nick gRNA (3); or iii) Cas9-RT mRNA (1) and template RNA (2). RNA mixes comprised 4.5 µg of the Cas9-RT mRNA (1), 5 µM final concentration of template RNA (2), and 1.3 µM final concentration of second nick gRNA (3). Mixes were nucleofected into approximately 200,000 cells using the Lonza Amaxa Nucleofector 96 Well Shuttle System, as according to manufacturer's protocols. Cells were then lysed and genomic DNA was collected 72 hours after nucleofection. Amplicon sequencing libraries were prepared using primers to amplify across the target site and Illumina sequencing was performed. Precise correction and indel rates were analyzed using the CRISPResso2 pipeline (Clement et al Nat Biotechnol 37 (3): 224-226 (2019)).

Figure 39:
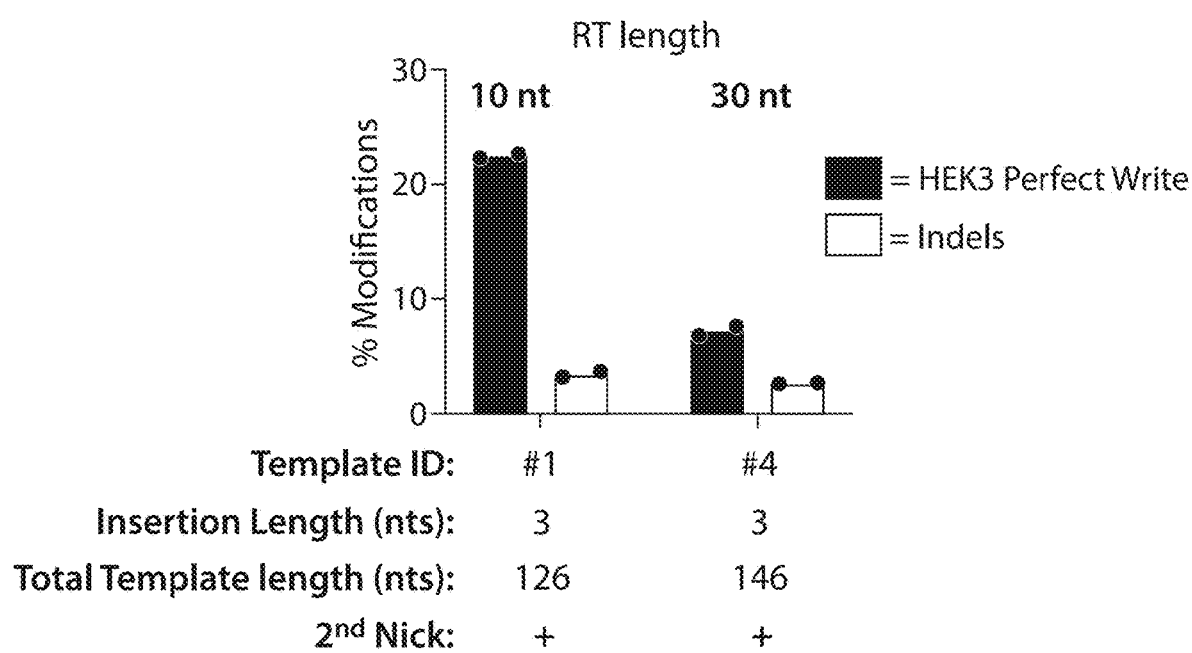
FIG. 39. Shows effect of length on GENE WRITING™ activity. HEK293T cells were nucleofected with all-RNA GENE WRITING™ systems comprising various Template RNAs (Table 59) to test editing efficiency of the DNA-free approach at the HEK3 locus. Template 4, which encoded the same edit as Template 1, but with an addition of 20 nt at the 3' end of the RT template, showed an approximately 3.1-fold drop in precise Writing activity and an approximately 2.4-fold drop in the ratio of precise corrections to indels.
Figure 40:
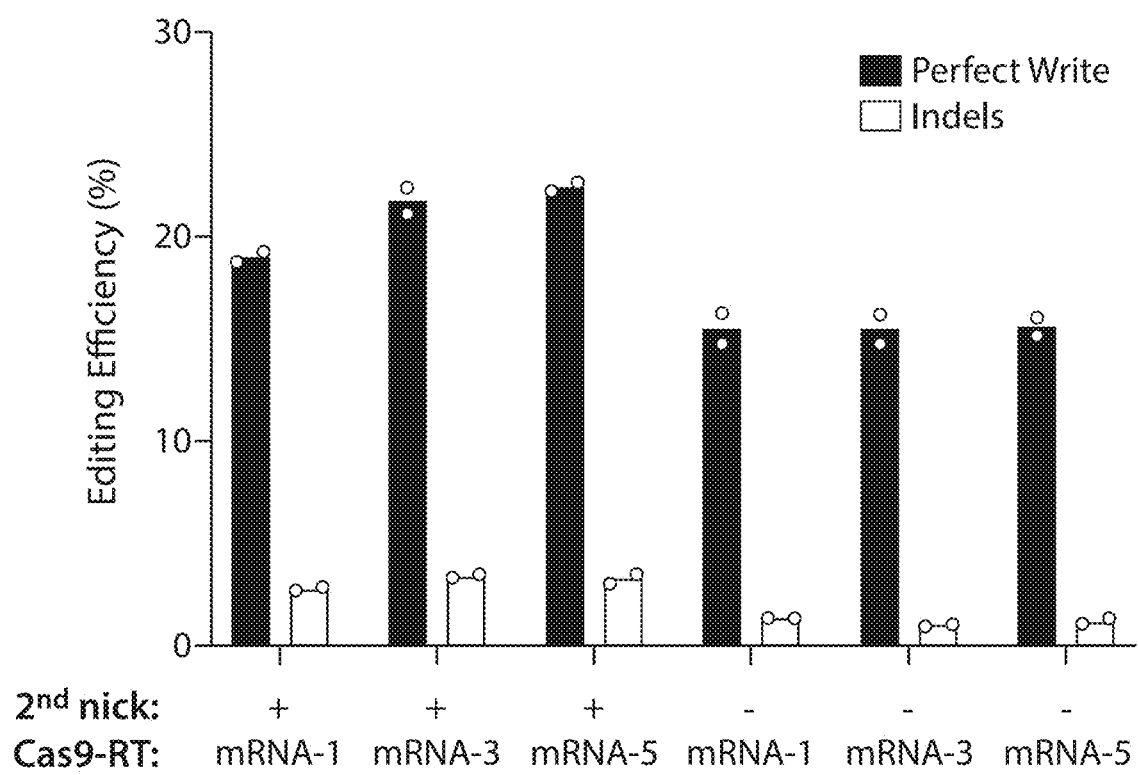
FIG. 40. Shows effect of all-RNA delivery of GENE WRITER™ using different mRNA compositions. Nucleofection of various Cas9-RT (MMLV) mRNAs (Table 60) into HEK293T using Template 1 (Table 59). No strong effects were observed here in varying capping and UTR compositions.
Figure 41:
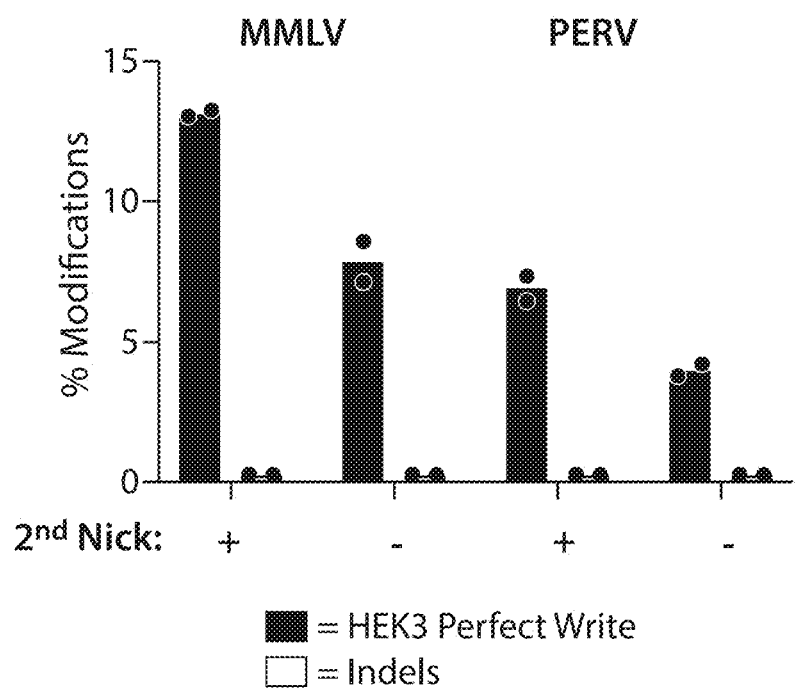
FIG. 41. HEK293T cells were nucleofected with a GENE WRITING™ system using a set Template (Template 1, Table 59) for editing the HEK3 locus and two different Cas-RT constructs. Sequence analysis indicated that both Cas-RT fusions made edits in a very precise and efficient manner. In both systems, there was an increase in efficiency under conditions including the optional secondary nick. These data show successful cloning and Precise Writing by the PERV RT domain in the context of these Cas-RT fusions.

In these experiments, approximately 20% precise Writing activity was achieved with Cas9-RT (MMLV) using Template 1 (Table 59). A drop in activity was observed for templates that were longer than 120 nt in length; Template 4, which encoded the same edit as Template 1, but with an addition of 20 nt at the 3' end of the RT template, showed an approximately 3.1-fold drop in precise Writing activity and an approximately 2.4-fold drop in the ratio of precise corrections to indels (FIG. 39). The use of Cas9-RT-encoding mRNAs with different UTRs and capping approaches produced similar levels of activity, though there was a slight increase with mRNA-5 (Table 60; FIG. 40). The all-RNA nucleofection of the GENE WRITER™ Cas9-RT (PERV) with Template 1 and the second-nick gRNA further resulted in a precise Writing efficiency of approximately 7% (FIG. 41). Across the experiments of this example, the addition of the second-nick gRNA resulted in an increase in Writing activity.

Table 59 provides sequences of Template RNA molecules used in all-RNA GENE WRITING™ Examples. The spacer sequence of each Template RNA described here was kept constant and comprised 20 nt (5'-GGCCCAGACT-GAGCACGTGA-3' (SEQ ID NO: 3574)) of 100% identity to a target site in the human HEK3 locus (also known as LINC01509) (sequence maps to NC_000009.12: 107422339 . . . 107422358, assembly GRCh38.p13). A Template RNA will typically comprise the components shown in the table, such that spacer+scaffold+RT+edit+PBS+Tail can yield the complete molecule.

TABLE 59

Template RNAs used in various Examples disclosed herein

| Name | Description | spacer | scaffold | RT+edit | PBS | Tail | TemplateRNA Combined | RNA Sequence | Length |
|---|---|---|---|---|---|---|---|---|---|
| Template 1 | HEK3_13P BS_10RT(C TTat1) | GGCC CAGA CTGA GCAC GTGA (SEQ ID NO: 3574) | GTTT TAGA GCTA GAAA TAGC AAGT TAAA ATAA GGCT AGTC CGTT ATCA ACTT GAAA AAGT GGCA CCGA GTCG GTGC (SEQ ID NO: 3575) | TCTG CCAT CAAA G (SEQ ID NO: 3576) | CGT GCT CA GTC TG (SEQ ID NO: 3578) | TTTT | GGCC CAGA CTGA GCAC GTGA GTTT TAGA GCTA GAAA TAGC AAGT TAAA ATAA GGCT AGTC CGTT ATCA ACTT GAAA AAGT GGCA CCGA GTCG GTGC TCTG CCAT CAAA GCGT GCTC AGTC TGTT TT (SEQ ID NO: 3589) | mG*mG*mC*r CrCrArGrAr CrUrGrArGr CrArCrGrUr GrArGrUrUr UrUrArGrAr GrCrUrArGr ArArArUrAr GrCrArArGr UrUrArArAr ArUrArArGr GrCrUrArGr UrCrCrGrUr ArArArArAr GrUrGrGrCr ArCrCrGrAr GrUrCrGrGr UrGrCrUrCr UrGrCrCrAr UrCrArArAr GrCrGrUrGr CrUrCrArGr UrCrUrGrU* mU*mU*mU (SEQ ID NO: 3590) | 126 |
| Template 2 | HEK3_13P BS_10RT (10 nts at1) | GGCC CAGA CTGA GCAC GTGA (SEQ ID NO: 3574) | GTTT TAGA GCTA GAAA TAGC AAGT TAAA ATAA GGCT AGTC CGTT ATCA ACTT GAAA AAGT GGCA CCGA GTCG GTGC (SEQ ID NO: 3575) | TCTG CCAT CACA TGTA GTTG (SEQ ID NO: 3591) | CGT GCT CA GTC TG (SEQ ID NO: 3578) | TTTT | GGCC CAGA CTGA GCAC GTGA GTTT TAGA GCTA GAAA TAGC AAGT TAAA ATAA GGCT AGTC CGTT ATCA ACTT GAAA AAGT GGCA CCGA GTCG GTGC TCTG CCAT CACA TGTA GTTG CGTG CTCA GTCT GTTT T (SEQ ID NO: 3592) | mG*mG*mC*r CrCrArGrAr CrUrGrArGr CrArCrGrUr GrArGrUrUr UrUrArGrAr GrCrUrArGr ArArArUrAr GrCrArArGr UrUrArArAr ArUrArArGr GrCrUrArGr UrCrCrGrUr ArArArArAr GrUrGrGrCr ArCrCrGrAr GrUrCrGrGr UrGrCrUrCr UrGrCrCrAr UrCrArCrAr UrGrUrArGr UrUrGrCrGr UrGrCrUrCr ArGrUrCrUr GrU*mU*mU* mU (SEQ ID NO: 3593) | 133 |

TABLE 59-continued

Template RNAs used in various Examples disclosed herein

| Name | Description | spacer | scaffold | RT+edit | PBS | Tail | TemplateRNA Combined | RNA Sequence | Length |
|---|---|---|---|---|---|---|---|---|---|
| Template 3 | HEK3_13P BS_10RT (20 nts at1) | GGCC CAGA CTGA GCAC GTGA (SEQ ID NO: 3574) | GTTT TAGA GCTA GAAA TAGC AAGT TAAA ATAA GGCT AGTC CGTT ATCA ACTT GAAA AAGT GGCA CCGA GTCG GTGC (SEQ ID NO: 3575) | TCTG CCAT CACA TGTA GTTG AGGT CAAT GA (SEQ ID NO:3594) | CGT GCT CA GTC TG (SEQ ID NO: 3578) | TTTT | GGCC CAGA CTGA GCAC GTGA GTTT TAGA GCTA GAAA TAGC AAGT TAAA ATAA GGCT AGTC CGTT ATCA ACTT GAAA AAGT GGCA CCGA GTCG GTGC TCTG CCAT CACA TGTA GTTG AGGT CAAT GACG TGCT CAGT CTGT TTT (SEQ ID NO: 3595) | mG*mG*mC* rCrC rArGrArCrU rGrArGrCrA rCrGrUrGrA rGrUrUrUrU rArGrArGrC rUrArGrArA rArUrArGrC rArArGrUrU rArArArArU rArArGrGrC rUrArGrUrC rCrGrUrUrA rUrCrArArC rUrUrGrArA rArArArGrU rGrGrCrArC rCrGrArGrU rCrGrGrUrG rCrUrCrUrG rCrCrArUrC rArCrArUrG rCrUrCrArG rUrCrUrGrU *mU*mU*mU (SEQ ID NO: 3596) | 143 |
| Template 4 | HEK3_13P BS_30RT (CTTat1) | GGCC CAGA CTGA GCAC GTGA (SEQ ID NO: 3574) | GTTT TAGA GCTA GAAA TAGC AAGT TAAA ATAA GGCT AGTC CGTT ATCA ACTT GAAA AAGT GGCA CCGA GTCG GTGC (SEQ ID NO: 3575) | GGAA GCAG GGCT TCCT TTCC TCTG CCAT CAAA G (SEQ ID NO: 3597) | CGT GCT CA GTC TG (SEQ ID NO: 3578) | TTTT | GGCC CAGA CTGA GCAC GTGA GTTT TAGA GCTA GAAA TAGC AAGT TAAA ATAA GGCT AGTC CGTT ATCA ACTT GAAA AAGT GGCA CCGA GTCG GTGC GGAA GCAG GGCT TCCT TTCC TCTG CCAT CAAA | mG*mG*mC*r CrUrGrArGr CrUrGrArGr CrArCrGrUr GrArGrUrUr UrArGrArGr CrUrArGrAr ArArArUrAr GrCrArArGr UrUrArArAr ArUrArArGr GrCrUrArGr UrCrCrGrUr UrArUrCrAr ArCrUrUrGr ArArArArGr UrGrGrCrAr CrCrGrArGr UrCrGrGrUr GrCrGrGrAr ArGrCrArGr GrGrCrUrUr CrCrUrUrUr CrCrUrCrUr GrCrCrArUr CrArArArGr* mU*mU*mU (SEQ ID NO: 3599) | 146 |

TABLE 59-continued

Template RNAs used in various Examples disclosed herein

| Name | Description | spacer | scaffold | RT+edit | PBS | Tail | TemplateRNA Combined | RNA Sequence | Length |
|---|---|---|---|---|---|---|---|---|---|
| | | | | | | | GCGT GCTC AGTC TGTT TT (SEQ ID NO: 3598) | | |
| Template 5 | HEK3 13P BS_30RT (10 nts at1) | GGCC CAGA CTGA GCAC GTGA (SEQ ID NO: 3574) | GTTT TAGA GCTA GAAA TAGC AAGT TAAA ATAA GGCT AGTC CGTT ATCA ACTT GAAA AAGT GGCA CCGA GTCG GTGC (SEQ ID NO: 3575) | GGAA GCAG GGCT TCCT TTCC TCTG CCAT CACA TGTA GTTG (SEQ ID NO: 3600) | CGT GCT CA GTC TG (SEQ ID NO: 3578) | TTTT | GGCC CAGA CTGA GCAC GTGA GTTT TAGA GCTA GAAA TAGC AAGT TAAA ATAA GGCT AGTC CGTT ATCA ACTT GAAA AAGT GGCA CCGA GTCG GTGC GGAA GCAG GGCT TCCT TTCC TCTG CCAT CACA TGTA GTTG CGTG CTCA GTCT GTTT T (SEQ ID NO: 3601) | mG*mG*mC*r CrCrArGrAr CrUrGrArGr CrArCrGrUr GrArGrUrUr UrUrArGrAr GrCrUrArGr ArArArUrAr GrCrArArGr UrUrArArAr ArUrArArGr GrCrUrArGr UrCrCrGrUr UrArUrCrAr ArCrUrUrGr ArArArArAr GrUrGrGrCr ArArGrGrCr ArCrCrGrAr GrUrCrGrGr UrGrCrGrGr ArArGrCrAr GrGrGrCrUr UrCrCrUrUr UrCrCrUrCr UrGrCrCrAr UrCrArCrAr UrGrUrArGr UrUrGrCrGr UrGrCrUrCr ArGrUrCrUr GrU*mU*mU* mU (SEQ ID NO: 3602) | 153 |
| Template 6 | HEK3 13P BS_30RT (20 nts at1) | GGCC CAGA CTGA GCAC GTGA (SEQ ID NO: 3574) | GTTT TAGA GCTA GAAA TAGC AAGT TAAA ATAA GGCT AGTC CGTT ATCA ACTT GAAA AAGT GGCA CCGA GTCG GTGC (SEQ ID NO: 3575) | GGAA GCAG GGCT TCCT TTCC TCTG CCAT CACA TGTA GTTG AGGT CAAT GA (SEQ ID NO: 3603) | CGT GCT CA GTC TG (SEQ ID NO: 3578) | TTTT | GGCC CAGA CTGA GCAC GTGA GTTT TAGA GCTA GAAA TAGC AAGT TAAA ATAA GGCT AGTC CGTT ATCA ACTT GAAA AAGT GGCA | mG*mG*mC*r CrCrArGrAr CrUrGrArGr CrArCrGrUr GrArGrUrUr UrUrArGrAr GrCrUrArGr ArArArUrAr GrCrArArGr UrUrArArAr ArUrArArGr GrCrUrArGr UrCrCrGrUr UrArUrCrAr ArCrUrUrGr ArArArArAr GrUrGrGrCr ArArGrGrCr Ar | 163 |

TABLE 59-continued

Template RNAs used in various Examples disclosed herein

| Name | Description | spacer | scaffold | RT+edit | PBS | Tail | TemplateRNA Combined | RNA Sequence | Length |
|---|---|---|---|---|---|---|---|---|---|
| | | | | | | | CCGA | GrGrGrCrUr | |
| | | | | | | | GTCG | UrCrCrUrUr | |
| | | | | | | | GTGC | UrCrCrUrCr | |
| | | | | | | | GGAA | UrGrCrCrAr | |
| | | | | | | | GCAG | UrCrArCrAr | |
| | | | | | | | GGCT | UrGrUrArGr | |
| | | | | | | | TCCT | UrUrGrArGr | |
| | | | | | | | TTCC | GrUrCrArAr | |
| | | | | | | | TCTG | UrGrArCrGr | |
| | | | | | | | CCAT | UrGrCrUrCr | |
| | | | | | | | CACA | ArGrUrCrUr | |
| | | | | | | | TGTA | GrU*mU*mU* | |
| | | | | | | | GTTG | mU(SEQ ID | |
| | | | | | | | AGGT | NO: 3605) | |
| | | | | | | | CAAT | | |
| | | | | | | | GACG | | |
| | | | | | | | TGCT | | |
| | | | | | | | CAGT | | |
| | | | | | | | CTGT | | |
| | | | | | | | TTT | | |
| | | | | | | | (SEQ | | |
| | | | | | | | ID | | |
| | | | | | | | NO: | | |
| | | | | | | | 3604) | | |

TABLE 60

Different production and compositions of Gene Writer ™ polypeptide mRNAs used in various Examples

| Name | Transcription template | Capping | Poly A | Modified NTPs | 5' UTR | 3' UTR |
|---|---|---|---|---|---|---|
| mRNA-1 | PCR amplicon | CleanCap (AG); co-transcriptional | Added during amplification | None | AGGAAA TAAGAG AGAAAA GAAGAG TAAGAA GAAATA TAAGAG CCACC (SEQ ID NO: 3606) | GCTGGAGCCTCG GTGGCCATGCTTC TTGCCCCTTGGGC CTCCCCCCAGCCC CTCCTCCCCTTCC TGCACCCGTACCC CCGTGGTCTTTGA ATAAAGTCTGA (SEQ ID NO: 3607) |
| mRNA-2 | PCR amplicon | CleanCap (AG); co-transcriptional | Added during amplification | 5moU | AGGAAA TAAGAG AGAAAA GAAGAG TAAGAA GAAATA TAAGAG CCACC (SEQ ID NO: 3606) | GCTGGAGCCTCG GTGGCCATGCTTC TTGCCCCTTGGGC CTCCCCCCAGCCC CTCCTCCCCTTCC TGCACCCGTACCC CCGTGGTCTTTGA ATAAAGTCTGA (SEQ ID NO: 3607) |
| mRNA-3 | PCR amplicon | Enzymatic, 2'O Methylated (Cap1); post-transcriptional | Added during amplification | None | GGGAAA TAAGAG AGAAAA GAAGAG TAAGAA GAAATA TAAGAG CCACC (SEQ ID NO: 3608) | GCTGGAGCCTCG GTGGCCATGCTTC TTGCCCCTTGGGC CTCCCCCCAGCCC CTCCTCCCCTTCC TGCACCCGTACCC CCGTGGTCTTTGA ATAAAGTCTGA (SEQ ID NO: 3607) |

TABLE 60-continued

Different production and compositions of Gene Writer ™ polypeptide mRNAs used in various Examples

| Name | Transcription template | Capping | Poly A | Modified NTPs | 5' UTR | 3' UTR |
|---|---|---|---|---|---|---|
| mRNA-4 | PCR amplicon | Enzymatic, 2'O Methylated (Cap1); post-transcriptional | Added during amplification | 5moU | GGGAAA TAAGAG AGAAAA GAAGAG TAAGAA GAAATA TAAGAG CCACC (SEQ ID NO: 3608) | GCTGGAGCCTCG GTGGCCATGCTTC TTGCCCCTTGGGC CTCCCCCCAGCCC CTCCTCCCCTTCC TGCACCCGTACCC CCGTGGTCTTTGA ATAAAGTCTGA (SEQ ID NO: 3607) |
| mRNA-5 | Linearized plasmid | CleanCap (AG); co-transcriptional | Plasmid-encoded | None | AGGAAA TAAGAG AGAAAA GAAGAG TAAGAA GAAATA TAAGAG CCACC (SEQ ID NO: 3606) | GCTGCCTTCTGCG GGGCTTGCCTTCT GGCCATGCCCTTC TTCTCTCCCTTGC ACCTGTACCTCTT GGTCTTTGAATAA AGCCTGAGTAGG AAGTCTA (SEQ ID NO: 3609) |

Example 36: Use of Modified Nucleotides in an all-RNA GENE WRITER™ System

This example describes the application of a GENE WRITER™ system to edit the genome in human cells via delivery of RNA components, e.g., mRNA encoding the GENE WRITER™ polypeptide and an RNA template. Further to the demonstration of the DNA-free system in Example 35, this example describes the incorporation of modified nucleotides, e.g., 5-methoxyuridine, into the mRNA encoding the GENE WRITER™ polypeptide, and the incorporation of modified nucleotides, e.g. 2'-O-methyl phosphorothioate, into the GENE WRITER™ template RNA.

GENE WRITER™ polypeptide-encoding mRNAs (1) were generated using T7 polymerase-driven in vitro transcription of an amplicon generated from a plasmid by PCR. The plasmid encoding the mRNA construct comprised a transcriptional cassette comprising the following components: T7 promoter, 5'UTR, GENE WRITER™ coding sequence (Cas9 nickase fused with a reverse transcriptase by a peptide linker and further comprising a bipartite SV40 NLS), and a 3'UTR. A poly A tail component was added such that it was encoded in the amplicon serving as the template for RNA transcription. In this example, mRNA molecules were prepared by incorporating one modified nucleotide, 5-methoxyuridine (5moU), into the transcription reaction. The mRNA encoding Cas9-RT (MMLV) (Table 20) was capped either co-transcriptionally with CLEANCAP™ AG (TriLink BioTechnologies) or post-transcriptionally via enzymatic capping (2'O methylated, Cap1) (Table 60).

GENE WRITER™ Template RNAs (2) encoding genomic edits were generated by chemical synthesis and purified by standard desalting. The first and last three bases of each Template RNA comprised 2'-O-methyl phosphorothioate modifications. Here, Template 1 was used to introduce a CTT insertion into the human HEK3 locus (Table 59). Where indicated, second nick gRNAs (3) were generated by chemical synthesis and comprised the following sequence modifications:

(SEQ ID NO: 3588)
mG*mC*mA*rGrArArArUrArGrArCrUrArArUrUrGr

CrArGrUrUrUrUrArGrArGrCrUrArGrArArArUrAr

GrCrArArGrUrUrArArArArUrArArGrGrCrUrArGr

UrCrCrGrUrUrArUrCrArArCrUrUrGrArArArArAr

GrUrGrGrCrArCrCrGrArGrUrCrGrGrUrGrCmU*mU

*mU*rU.

To assay the RNA GENE WRITING™ systems described herein, HEK293T cells were plated 2 days before nucleofection to obtain 70-80% confluency on the day of nucleofection. RNAs were mixed according to the following combinations: i) Cas9-RT mRNA (1) only; ii) Cas9-RT mRNA (1), template RNA (2), and second nick gRNA (3); or iii) Cas9-RT mRNA (1) and template RNA (2). RNA mixes comprised 4.5 µg of the Cas9-RT mRNA (1), 5 µM final concentration of template RNA (2), and 1.3 µM final concentration of second nick gRNA (3). Mixes were nucleofected into approximately 200,000 cells using the Lonza Amaxa Nucleofector 96 Well Shuttle System, as according to manufacturer's protocols. Cells were then lysed and genomic DNA was collected 72 hours after nucleofection. Amplicon sequencing libraries were prepared using primers to amplify across the target site and Illumina sequencing was performed. Precise correction and indel rates were analyzed using the CRISPResso2 pipeline (Clement et al Nat Biotechnol 37 (3): 224-226 (2019)).

Figure 42:
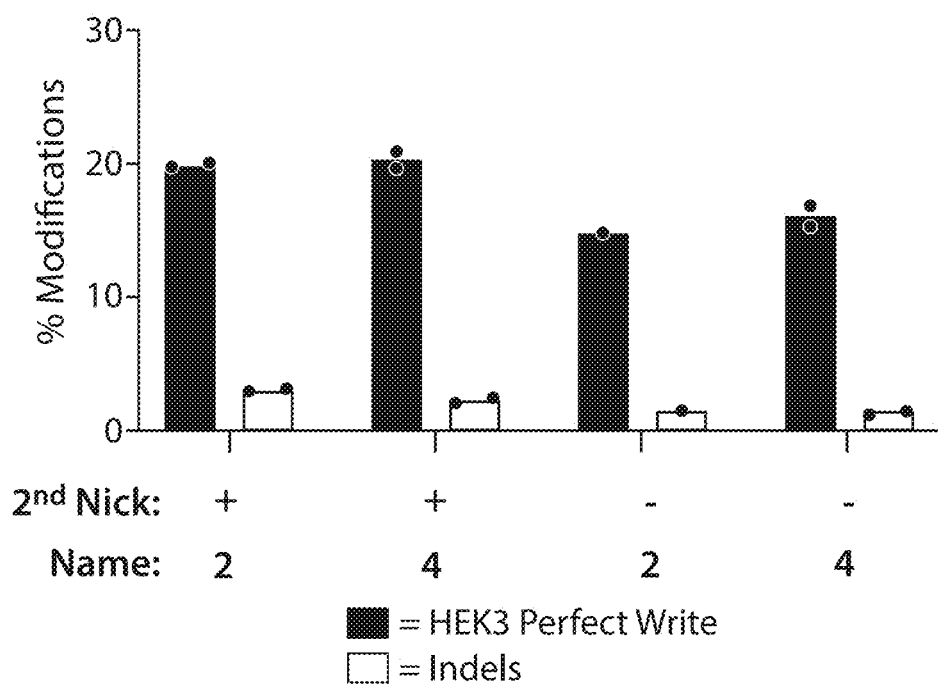
FIG. 42. Shows the effect of all-RNA delivery of GENE WRITER™ employing modified nucleotides. mRNA molecules encoding the Cas-RT (MMLV) polypeptide were varied in composition to determine effects (Table 60). Here, Template 1 is used to edit the HEK3 locus after incorporating modified nucleotides in the mRNA component. GENE WRITING™ activity with a 5moU-modified mRNA component was found to both high and precise.

In these experiments, approximately 20% precise Writing activity was achieved using an all RNA GENE WRITING™ system that incorporated modified nucleotides (5moU) in the mRNA encoding the GENE WRITER™ polypeptide (FIG. 42). Notably, the incorporation of the modified nucleotide 5moU did not result in an observable inhibitory effect on Writing efficiency. Similar efficiencies resulted from the mRNA capping methods assayed here (see Table 60). A slight decrease in efficiency was observed in the absence of a second nick gRNA (FIG. 42).

Example 37: Delivery of DNA-Free GENE WRITER™ Systems Through Lipid-Based Transfection of Human Cells This example describes the application of a GENE WRITER™ system to edit the genome in human cells via delivery of RNA components, e.g., mRNA encoding the GENE WRITER™ polypeptide and an RNA template. Without wishing to be bound by theory, the ability to deliver only RNA components in the absence of DNA is expected to confer major advantages to this system, including a reduction in immunogenicity and cellular toxicity linked to the detection of DNA in the cytoplasm and the availability of lipid nanoparticles systems described herein, the majority of which are optimized for RNA delivery, that can circumvent issues associated with viral delivery of nucleic acid therapeutics (e.g., manufacturing challenges, pre-existing immunity, immunogenic response to viral proteins). The reduction in cellular toxicity through use of an RNA system may be especially important for the modification of more sensitive cell types, such as primary cells. Lipid transfection reagents may be utilized directly for ex vivo cell engineering and lipid-based nanoparticles are suitable for in vivo RNA delivery to a patient's cells. Thus, it is of significant value to demonstrate the capacity of a GENE WRITING™ system to function appropriately when delivered as all RNA and in the absence of DNA. Specifically, this example demonstrates delivery of an all RNA GENE WRITING™ system to modify the genome of HEK293T cells using the lipid-based transfection reagents LIPOFECTAMINE™ 3000 and MESSENGERMAX™ (Invitrogen). To demonstrate RNA-based GENE WRITING™ is not limited to a single composition, two versions of a Cas-RT fusion polypeptide are employed that comprise an RT domain derived from either Moloney murine leukemia virus (Cas9-RT (MMLV)) or porcine endogenous retrovirus (Cas9-RT (PERV)) (Table 19).

GENE WRITER™ polypeptide-encoding mRNAs (1) were generated using T7 polymerase-driven in vitro transcription. In general, plasmids encoding the mRNA constructs comprised a transcriptional cassette comprising the following components: T7 promoter, 5'UTR, GENE WRITER™ coding sequence (Cas9 nickase fused with a reverse transcriptase by a peptide linker and further comprising a nuclear localization signal), 3'UTR, and an 80 nt polyA tail (SEQ ID NO: 3666). In this example, RNA molecules were prepared using unmodified nucleotides from either linearized plasmid template or using a PCR amplicon of the transcriptional cassette described above. The mRNA encoding Cas9-RT (MMLV) was capped either co-transcriptionally with CLEANCAP™ AG (TriLink BioTechnologies) or post-transcriptionally via enzymatic capping (2'O methylated, Cap1) (Table 60). The mRNA encoding Cas9-RT (PERV) was generated from plasmid template and co-transcriptionally capped with CLEANCAP™ AG (TriLink BioTechnologies) (Table 20).

GENE WRITER™ Template RNAs (2) encoding genomic edits were generated by chemical synthesis and purified by standard desalting. The first and last three bases of each Template RNA comprised 2'-O-methyl phosphorothioate modifications. Here, Template 1 was used to introduce a CTT insertion into the human HEK3 locus (Table 59).

Where indicated, second nick gRNAs (3) were generated by chemical synthesis and comprised the following sequence modifications:

```
                                          (SEQ ID NO: 3588)
mG*mC*mA*rGrArArArUrArGrArCrUrArArUrUrGr

CrArGrUrUrUrArGrArGrCrUrArGrArArArUrAr

GrCrArArGrUrUrArArArUrArArGrGrCrUrArGr

UrCrCrGrUrArUrCrArArCrUrUrGrArArArArAr

GrUrGrGrCrArCrCrGrArGrUrCrGrGrUrGrCmU*mU

*mU*rU.
```

To assay the RNA GENE WRITING™ systems described herein, approximately 50,000 HEK293T cells were plated in 24-well plates 1 day before lipofection. RNAs were mixed according to the following combinations: i) Cas9-RT mRNA (1) only; ii) Cas9-RT mRNA (1), template RNA (2), and second nick gRNA (3); or iii) Cas9-RT mRNA (1) and template RNA (2). RNA mixes comprised 0.45 µg of the Cas9-RT mRNA (1), 2.5 pM final concentration of template RNA (2), and 1.0 pM final concentration of second nick gRNA (3). RNAs were mixed with Opti-MEM media (Gibco) and LIPOFECTAMINE™ 3000 or MESSENGERMAX™ reagent (Invitrogen) and added to cells. Cells were then lysed and genomic DNA was collected 72 hours after nucleofection. Amplicon sequencing libraries were prepared using primers to amplify across the target site and Illumina sequencing was performed. Precise correction and indel rates were analyzed using the CRISPResso2 pipeline (Clement et al *Nat Biotechnol* 37 (3): 224-226 (2019)).

Figure 43A:
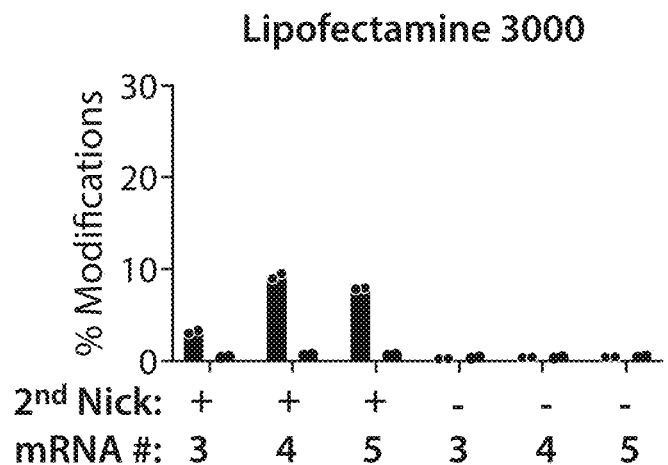
FIGS. 43A-43C show the effect of all-RNA delivery of GENE WRITER™ using different mRNA compositions delivered into the cell via lipid particles.
Figure 43B:
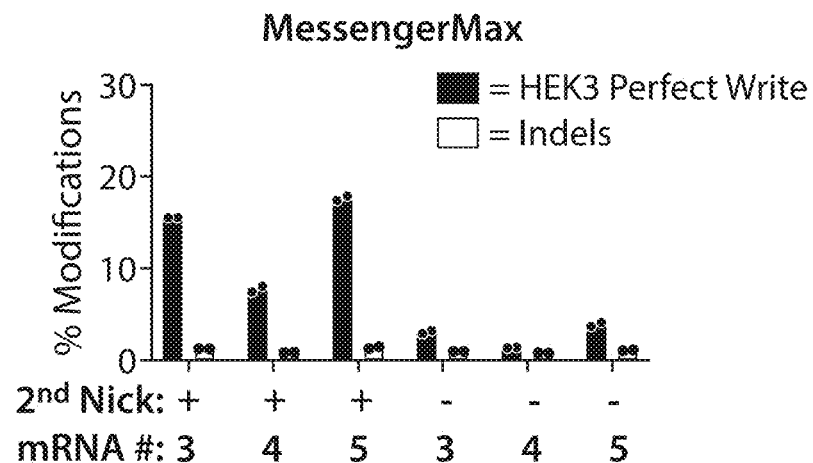
Figure 43C:
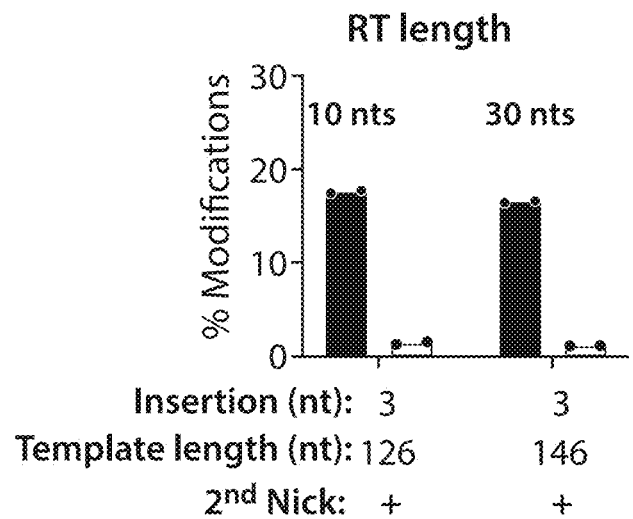
Figure 44:
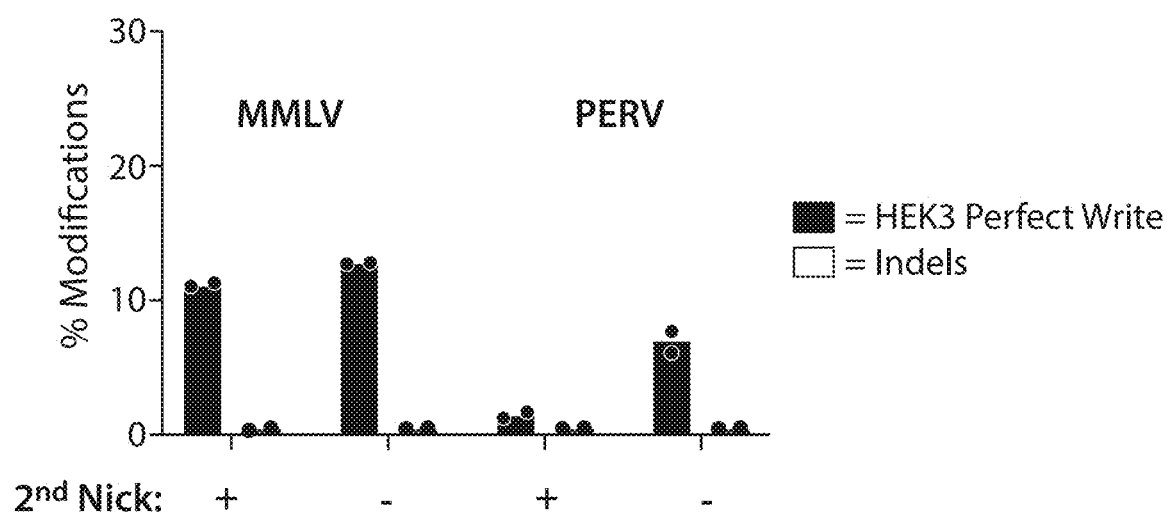
FIG. 44. shows all-RNA delivery of Cas-RT using lipid-based systems. The Cas9-RT (MMLV) and Cas9-RT (PERV) were delivered into HEK293T cells with Template 1 (Table 59) using MESSENGERMAX™ lipid reagent. Here, activity for both enzymes was around 5% Precise Writing.

In these experiments, up to approximately 17% precise Writing activity was achieved using an all RNA GENE WRITING™ system delivered by lipid-based transfection, approaching efficiencies similar to nucleofection (FIG. 43 B; see Example 35 for nucleofection). LIPOFECTAMINE™ 3000 was also used (FIG. 43A). In contrast to nucleofection (Example 35), there was not an observable reduction when utilizing the 20 nt longer Template 4 as compared to Template 1 (Table 59; FIG. 43 C). Further, the all-RNA lipofection of the GENE WRITER™ Cas9-RT (PERV) with Template I resulted in precise Writing of the desired edit with an efficiency of approximately 3.5% (FIG. 44).

Example 38: RNA GENE WRITING™ Enables DNA-Free Precise Editing of Primary T Cells This example describes the use of a Cas9-RT fusion polypeptide-based GENE WRITER™ system for the genomic editing of target DNA sequences. More specifically, this example describes nucleofection of an all-RNA system into primary CD4+ T cells for Gene Rewriting in primary human cells, e.g., as a means of demonstrating the Gene Rewriter system for ex vivo application.

The all RNA system described here comprised: 1) GENE WRITER™ polypeptide-encoding mRNA, e.g., an RNA encoding the Cas9-RT fusion polypeptide as a driver for programmed gene editing through a targeted nicking and reverse transcription process as described in this invention; 2) a template RNA molecule, e.g., an RNA comprising (i) a gRNA spacer sequence for guiding the driver to the targeted region, e.g., a sequence complementary to a 20-nucleotide sequence in the HEK3 locus; (ii) a primer-binding sequence capable of complementary base pairing with a single strand of the nicked DNA for target-primed reverse transcription; (iii) a heterologous object sequence providing a template for reverse transcription that further comprises the intended final target sequence; and (iv) a gRNA scaffold sequence to associate with the Cas9 domain of the Cas9-RT polypeptide fusion; and 3) an optional additional gRNA to promote second-strand nicking near the target site, e.g., an RNA comprising (i) a spacer sequence for targeting the driver to induce a second nick, on the opposite strand of the first nick guided by the template RNA, at a site proximal to the target site (e.g., within 50-150 nt from the first nick); and (ii) a gRNA scaffold sequence mediating an association with the Cas9 domain of the driver. In this example, the Cas-RT fusion polypeptide (1) (Table 19) comprises a Cas9 (N863A) nickase fused to an MMLV reverse transcriptase domain. The template RNAs (2) employed here specifically follow the 5' to 3' orientation (i), (iv), (iii), (ii), as listed in the description thereof and are detailed in Table 59 and Example 35.

Figure 45A:
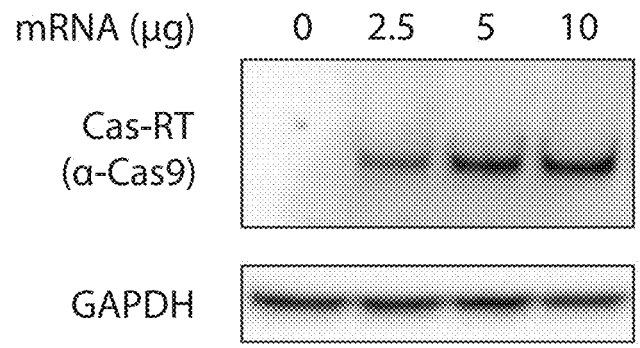
FIGS. 45A and 45B show expression of all-RNA GENE WRITER™ system in primary human CD4+ T cells.

To deliver the RNA GENE WRITER™ system into primary human CD4+ T cells and validate protein expression, 1,000,000 cells (Human Peripheral Blood CD4+ T Cells, Lonza catalog #2W-200) were stimulated by CD3/CD28 for two days and then nucleofected with 0, 2.5, 5, or 10 μg of mRNA encoding the Cas-RT polypeptide using a Nucleofector 96-well Shuttle System (Lonza) with the EO-115 nucleofection program, as according to manufacturer's protocols. One day post-nucleofection, the efficiency of delivery was assessed by immunoblotting with a Cas9 antibody (Cell Signaling) to measure protein expression of the GENE WRITER™ polypeptide from the nucleofected mRNA (FIG. 45A).

Figure 45B:
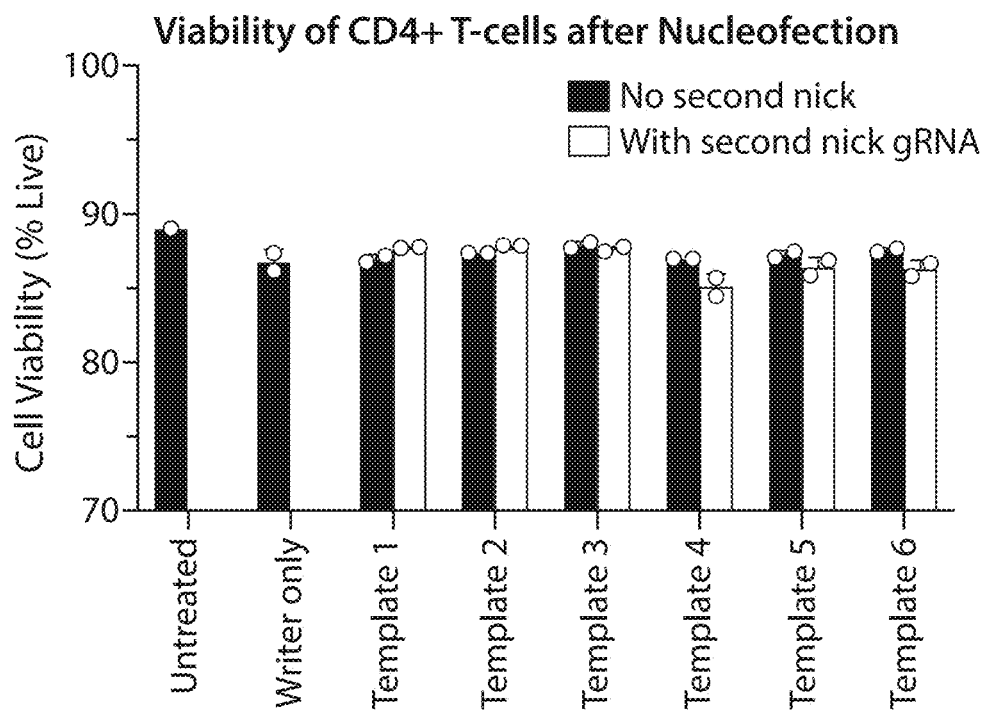
Figure 46A:
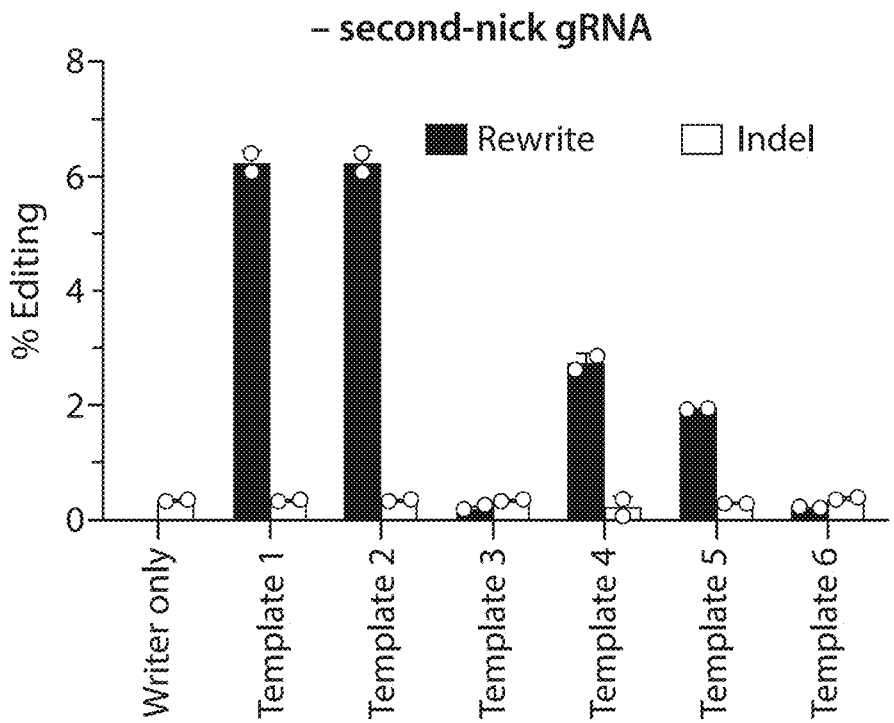
FIGS. 46A and 46B show GENE WRITING™ in primary human CD4+ T cells.
Figure 46B:
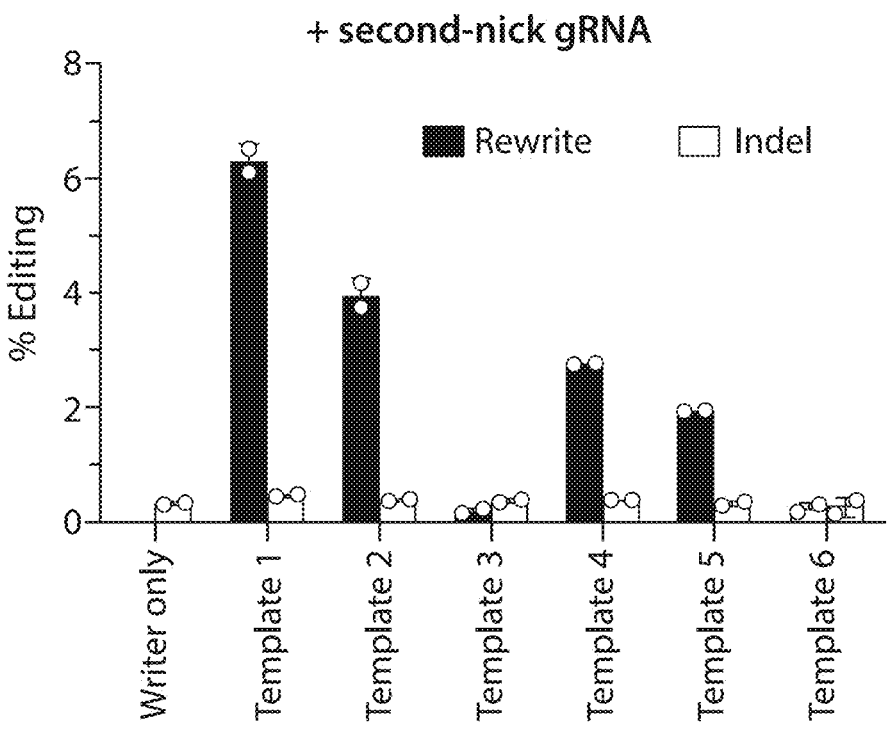

Subsequently, primary human CD4+ T cells were nucleofected with either: (1) 5 μg GENE WRITER™ polypeptide mRNA (Writer only control); (2) 5 μg GENE WRITER™ polypeptide mRNA and 5 μM template RNA, e.g., one of six template RNAs from Table 59 that target the same site of the HEK3 locus, but differ in editing result or design; or (3) 5 μg GENE WRITER™ polypeptide mRNA, 5 μM template RNA, e.g., one of six template RNAs from Table 59, and 2.075 μM of an additional gRNA for generating a second-strand nick, e.g., the second-nick gRNA targeting a sequence 108 nt upstream of the HEK3 target site described in Example 35. Three days post-nucleofection, cells were harvested to examine 1) cell viability after RNA delivery of the GENE WRITER™ system, and 2) editing efficiency on the target site of the genome. To assess the cell viability, the percentage of live cells was measured by flow cytometry after staining cells with a fluorescent live/dead dye (BioLegend). Cell viability was comparable in experimental conditions and in the absence of nucleofection (Untreated control) (FIG. 45 B). To evaluate efficiency of editing by the GENE WRITING™ systems, genomic DNA was analyzed by PCR-based amplicon sequencing assay, as described in Example 35. The efficiency of the desired editing (Perfect Write) reached approximately 6.3% using Template 1 (Table 59) with the GENE WRITER™ polypeptide mRNA (FIGS. 46A and B). Here, the addition of a second-nick gRNA (FIG. 46 B) resulted in similar levels of editing. Thus, this example demonstrates the use of GENE WRITING™ systems for highly specific editing in primary T cells and further shows the successful application of DNA-free, all-RNA GENE WRITING™ in these cells.

Example 39: Detection of Retrotransposase-Mediated Integration in Human Cells

This example describes the identification of retrotransposons demonstrating functionality in human cells. By assaying native or modified retrotransposons for integration activity, this example demonstrates a method for the selection of retrotransposases comprising protein domains that can be used to recreate retrotransposases in their native domain composition or as components of chimeric or synthetic GENE WRITER™ genome editor polypeptides for engineering the genome of human cells. For example, a retrotransposon successfully producing an integration signal is expected to comprise functional DNA binding, endonuclease, reverse transcriptase, and, optionally, second-strand synthesis activities. In some embodiments, a reverse transcriptase domain from a retrotransposon that has been shown to demonstrate activity as described in this example is used to provide the reverse transcriptase activity in a GENE WRITER™ polypeptide, e.g., as the RT of a Cas-RT fusion polypeptide. The screen described here employs the nucleofection of a two-plasmid system comprising a retrotransposon polypeptide and an inactivated reporter template into human cells to characterize the RT-dependent retrotransposition efficiency of computationally selected retrotransposons.

In this example, a two-plasmid system was employed comprising: 1) a retrotransposon-encoded protein expression driver plasmid, e.g., a plasmid encoding a retrotransposase polypeptide from Table 1, comprising a human codon-optimized retrotransposase coding sequence fused with a HiBit tag for detection of protein expression and driven by the mammalian CMV promoter, and 2) a template plasmid, e.g., a plasmid comprising (i) a promoter for expression in mammalian cells to drive transcription of the RNA template molecule, e.g., a CMV promoter, with the template molecule further comprising (ii) a reporter cassette that is inactive in the context of plasmid-derived expression, e.g., an EGFP expression cassette with coding sequence disrupted by an intron encoded in the opposite orientation (GFPai) flanked by (iii) the untranslated regions (UTRs) of the native retrotransposon that naturally comprises the retrotransposase of (1) (see FIG. 48). Here, the GFP reporter is encoded in the absence of a promoter to drive its expression to avoid any loss of signal due to GFP toxicity (see FIG. 48).

To deliver the two-plasmid system into U2OS cells, ~400,000 cells were nucleofected with 88.3 ng driver plasmid (1) and 161.7 ng template plasmid (2) using the Lonza SE Cell Line 96-well Nucleofector™ Kit as per manufacturer's instructions. Three days post-nucleofection, integration efficiency was measured using ddPCR to determine the copy number of integrations per genome. Reverse transcription-dependent retrotransposition activity was measured by using a ddPCR approach that utilized the antisense intron as described below. Expression of the driver protein was measured by HiBit-based bioluminescence assay.

When employing an antisense intron reporter containing intronic sequence within the reporter cassette of the template plasmid, e.g., the GFPai system described here, the intron is present in the plasmid but is spliced out during transcription, thus only reporter DNA derived from the transcript by reverse transcription would lack the intron sequence (FIG. 48). To limit detection to only events derived from reverse transcription, a ddPCR Taqman probe was designed to span the splicing junction to hybridize to DNA lacking the intron but not to plasmid DNA still containing the intact intron. The forward and reverse primers were designed upstream and downstream of the probe and within the GFP sequence. This design avoids the possible background from template plasmid directly recombined into the genome without a first transcription step, or from intact template plasmid contaminating the gDNA extraction samples.

GENE WRITING™ systems derived from retrotransposases in Table 1 were assayed as following this example to determine activity in human cells. Analysis of the integration efficiency of 163 candidate retrotransposon systems by ddPCR is shown in FIG. 49. From the assay described in this example, 25 retrotransposase candidates demonstrated successful trans-integration of the retrotransposon UTR-flanked Template sequence at greater than 0.01 copies/genome on average.

Example 40: Selection of Lipid Reagents with Reduced Aldehyde Content

In this example, lipids are selected for downstream use in lipid nanoparticle formulations containing GENE WRITING™ component nucleic acid(s), and lipids are selected based at least in part on having an absence or low level of contaminating aldehydes. Reactive aldehyde groups in lipid reagents may cause chemical modifications to component nucleic acid(s), e.g., RNA, e.g., template RNA, during LNP formulation. Thus, in some embodiments, the aldehyde content of lipid reagents is minimized.

Liquid chromatography (LC) coupled with tandem mass spectrometry (MS/MS) can be used to separate, characterize, and quantify the aldehyde content of reagents, e.g., as described in Zurek et al. The Analyst 124 (9): 1291-1295 (1999), incorporated herein by reference. Here, each lipid reagent is subjected to LC-MS/MS analysis. The LC/MS-MS method first separates the lipid and one or more impurities with a C8 HPLC column and follows with the detection and structural determination of these molecules with the mass spectrometer. If an aldehyde is present in a lipid reagent, it is quantified using a staple-isotope labeled (SIL) standard that is structurally identical to the aldehyde, but is heavier due to C13 and N15 labeling. An appropriate amount of the SIL standard is spiked into the lipid reagent. The mixture is then subjected to LC-MS/MS analysis. The amount of contaminating aldehyde is determined by multiplying the amount of SIL standard and the peak ratio (unknown/SIL). Any identified aldehyde(s) in the lipid reagents is quantified as described. In some embodiments, lipid raw materials selected for LNP formulation are not found to contain any contaminating aldehyde content above a chosen level. In some embodiments, one or more, and optionally all, lipid reagents used for formulation comprise less than 3% total aldehyde content. In some embodiments, one or more, and optionally all, lipid reagents used for formulation comprise less than 0.3% of any single aldehyde species. In some embodiments, one or more, and optionally all, lipid reagents used in formulation comprise less than 0.3% of any single aldehyde species and less than 3% total aldehyde content.

Example 41: Quantification of RNA Modification Caused by Aldehydes During Formulation In this example, the RNA molecules are analyzed post-formulation to determine the extent of any modifications that may have happened during the formulation process, e.g., to detect chemical modifications caused by aldehyde contamination of the lipid reagents (see, e.g., Example 40).

RNA modifications can be detected by analysis of ribonucleosides, e.g., as according to the methods of Su et al. Nature Protocols 9:828-841 (2014), incorporated herein by reference in its entirety. In this process, RNA is digested by a mix of nucleosides, and then subjected to LC-MS/MS analysis. RNA post-formulation is contained in LNPs and must first be separated from lipids by coprecipitating with GlycoBlue in 80% isopropanol. After centrifugation, the pellets containing RNA are carefully transferred to a new Eppendorf tube, to which a cocktail of enzymes (benzonase, Phosphodiesterase type 1, phosphatase) is added to digest the RNA into nucleosides. The Eppendorf tube is placed on a preheated Thermomixer at 37° C., for 1 hour. The resulting nucleosides mix is directly analyzed by a LC-MS/MS method that first separates nucleosides and modified nucleosides with a C18 column and then detects them with mass spectrometry.

If aldehyde(s) in lipid reagents have caused chemical modification, data analysis will associate the modified nucleoside(s) with the aldehyde(s). A modified nucleoside can be quantified using a SIL standard which is structurally identical to the native nucleoside except heavier due to C13 and N15 labeling. An appropriate amount of the SIL standard is spiked into the nucleoside digest, which is then subjected to LC-MS/MS analysis. The amount of the modified nucleoside is obtained by multiplying the amount of SIL standard and the peak ratio (unknown/SIL). LC-MS/MS is capable of quantifying all the targeted molecules simultaneously. In some embodiments, the use of lipid reagents with higher contaminating aldehyde content results in higher levels of RNA modification as compared to the use of higher purity lipid reagents as materials during the lipid nanoparticle formulation process. Thus, in preferred embodiments, higher purity lipid reagents are used that result in RNA modification below an acceptable level.

Example 42: GENE WRITER™ Enabling Large Insertion into Genomic DNA

This example describes the use of a GENE WRITER™ gene editing system to alter a genomic sequence by insertion of a large string of nucleotides.

In this example, the GENE WRITER™ polypeptide, gRNA, and writing template are provided as DNA transfected into HEK293T cells. The GENE WRITER™ polypeptide uses a Cas9 nickase for both DNA-binding and endonuclease functions. The reverse transcriptase function is derived from the highly processive RT domain of an R2 retrotransposase. The writing template is designed to have homology to the target sequence, while incorporating the genetic payload at the desired position, such that reverse transcription of the template RNA results in the generation of a new DNA strand containing the desired insertion.

To create a large insertion in the human HEK293T cell DNA, the GENE WRITER™ polypeptide is used in conjunction with a specific gRNA, which targets the Cas9-containing GENE WRITER™ to the target locus, and a template RNA for reverse transcription, which contains an RT-binding motif (3' UTR from an R2 element) for associating with the reverse transcriptase, a region of homology to the target site for priming reverse transcription, and a genetic payload (GFP expression unit). This complex nicks the target site and then performs TPRT on the template, initiating the reaction by using priming regions on the template that are complementary to the sequence immediately adjacent to the site of the nick and copying the GFP payload into the genomic DNA.

After transfection, cells are incubated for three days to allow for expression of the GENE WRITING™ system and conversion of the genomic DNA target. After the incubation period, genomic DNA is extracted from cells. Genomic DNA is then subjected to PCR-based amplification using site-specific primers and amplicons are sequenced on an Illumina MiSeq according to manufacturer's protocols. Sequence analysis is then performed to determine the frequency of reads containing the desired edit.

Example 43: GENE WRITER™ Genome Editor Polypeptides can Integrate Genetic Cargo Independently of the Single-Stranded Template Repair Pathway This example describes the use of a GENE WRITER™ system in a human cell wherein the single-stranded template repair (SSTR) pathway is inhibited.

In this example, the SSTR pathway will be inhibited using siRNAs against the core components of the pathway: FANCA, FANCD2, FANCE, USP1. Control siRNAs of a non-target control will also be included. 200k U2OS cells will be nucleofected with 30 pmols (1.5 μM) siRNAs, as well as R2Tg driver and transgene plasmids (trans configuration). Specifically, 250 ng of Plasmids expressing R2Tg, control R2Tg with a mutation in the RT domain, or control R2Tg with an endonuclease inactivating mutation) are used in conjunction with transgene at a 1:4 molar ratio (driver to transgene). Transfections of U2OS cells is performed in SE buffer using program DN100. After nucleofection, cells are grown in complete medium for 3 days. gDNA is harvested on day 3 and ddPCR is performed to assess integration at the rDNA site. Transgene integration at rDNA is detected in the absence of core SSTR pathway components.

Example 44: Formulation of Lipid Nanoparticles Encapsulating Firefly Luciferase mRNA In this example, a reporter mRNA encoding firefly luciferase was formulated into lipid nanoparticles comprising different ionizable lipids. Lipid nanoparticle (LNP) components (ionizable lipid, helper lipid, sterol, PEG) were dissolved in 100% ethanol with the lipid component. These were then prepared at molar ratios of 50:10:38.5:1.5 using ionizable lipid LIPIDV004 or LIPIDV005 (Table 61), DSPC, cholesterol, and DMG-PEG 2000, respectively. Firefly Luciferase mRNA-LNPs containing the ionizable lipid LIPIDV003 (Table 61) were prepared at a molar ratio of 45:9:44:2 using LIPIDV003, DSPC, cholesterol, and DMG-PEG 2000, respectively. Firefly luciferase mRNA used in these formulations was produced by in vitro transcription and encoded the Firefly Luciferase protein, further comprising a 5' cap, 5' and 3' UTRs, and a polyA tail. The mRNA was synthesized under standard conditions for T7 RNA polymerase in vitro transcription with co-transcriptional capping, but with the nucleotide triphosphate UTP 100% substituted with N1-methyl-pseudouridine triphosphate in the reaction. Purified mRNA was dissolved in 25 mM sodium citrate, pH 4 to a concentration of 0.1 mg/mL.

Firefly Luciferase mRNA was formulated into LNPs with a lipid amine to RNA phosphate (N: P) molar ratio of 6. The LNPs were formed by microfluidic mixing of the lipid and RNA solutions using a Precision Nanosystems NanoAssemblr™ Benchtop Instrument, using the manufacturer's recommended settings. A 3:1 ratio of aqueous to organic solvent was maintained during mixing using differential flow rates. After mixing, the LNPs were collected and dialyzed in 15 mM Tris, 5% sucrose buffer at 4° C. overnight. The Firefly Luciferase mRNA-LNP formulation was concentrated by centrifugation with Amicon 10 kDa centrifugal filters (Millipore). The resulting mixture was then filtered using a 0.2 μm sterile filter. The final LNP was stored at −80° C. until further use.

TABLE 61

Ionizable Lipids used in Example 44 (Formula (ix), (vii), and (iii))

| LIPID ID | Chemical Name | Molecular Weight | Structure |
| --- | --- | --- | --- |
| LIPIDV003 | (9Z,12Z)-3-((4,4-bis(octyloxy)butanoyl)oxy)-2-((((3-(diethylamino)propoxy)carbonyl)oxy)methyl)propyl octadeca-9,12-dienoate | 852.29 | 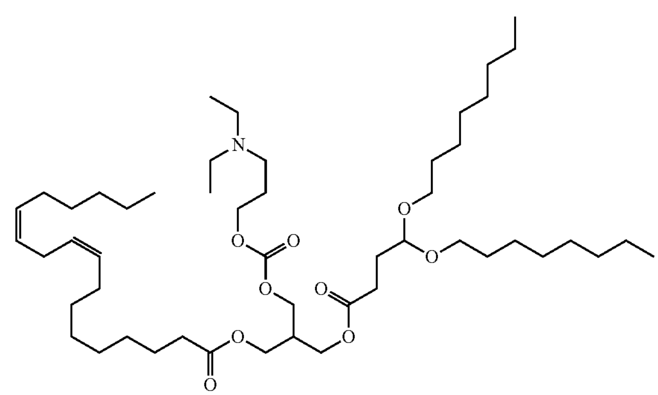 [SMILES: CCCCC/C=C\C/C=C\CCCCCCCC(=O)OCC(COC(=O)CCC(OCCCCCCCC)OCCCCCCCC)COC(=O)OCCCN(CC)CC] |
| LIPIDV004 | Heptadecan-9-yl 8-((2-hydroxyethyl)(8-(nonyloxy)-8-oxooctyl)amino)octanoate | 710.18 | 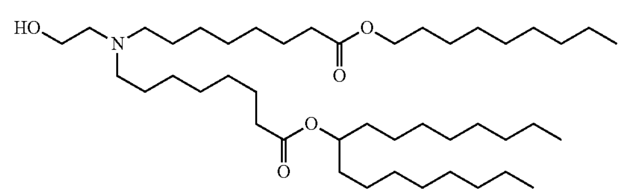 [SMILES: CCCCCCCCCOC(=O)CCCCCCCN(CCO)CCCCCCCC(=O)OC(CCCCCCCC)CCCCCCCC] |

TABLE 61-continued

Ionizable Lipids used in Example 44 (Formula (ix), (vii), and (iii))

| LIPID ID | Chemical Name | Molecular Weight | Structure |
|---|---|---|---|
| LIPIDV005 | | 919.56 | 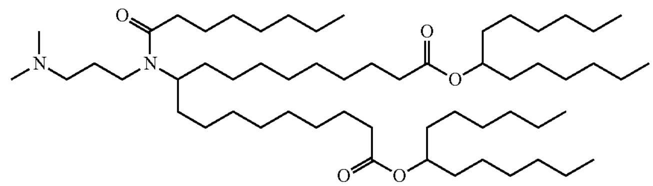 [SMILES: CCCCCCCC(=O)N(CCCN(C)C)C(CCCCCCCCC(=O)OC(CCCCCC)CCCCCC)CCCCCCCCC(=O)OC(CCCCCC)CCCCCC] |

Prepared LNPs were analyzed for size, uniformity, and % RNA encapsulation. The size and uniformity measurements were performed by dynamic light scattering using a Malvern Zetasizer DLS instrument (Malvern Panalytical). LNPs were diluted in PBS prior to being measured by DLS to determine the average particle size (nanometers, nm) and polydispersity index (pdi). The particle sizes of the Firefly Luciferase mRNA-LNPs are shown in Table 62.

TABLE 62

LNP particle size and uniformity

| LNP ID | Ionizable Lipid | Particle Size (nm) | pdi |
|---|---|---|---|
| LNPV019-002 | LIPIDV005 | 77 | 0.04 |
| LNPV006-006 | LIPIDV004 | 71 | 0.08 |
| LNPV011-003 | LIPIDV003 | 87 | 0.08 |

The percent encapsulation of luciferase mRNA was measured by the fluorescence-based RNA quantification assay Ribogreen (ThermoFisher Scientific). LNP samples were diluted in 1× TE buffer and mixed with the Ribogreen reagent per manufacturer's recommendations and measured on a i3 SpectraMax spectrophotomer (Molecular Devices) using 644 nm excitation and 673 nm emission wavelengths. To determine the percent encapsulation, LNPs were measured using the Ribogreen assay with intact LNPs and disrupted LNPs, where the particles were incubated with 1× TE buffer containing 0.2% (w/w) Triton-X100 to disrupt particles to allow encapsulated RNA to interact with the Ribogreen reagent. The samples were again measured on the i3 SpectraMax spectrophotometer to determine the total amount of RNA present. Total RNA was subtracted from the amount of RNA detected when the LNPs were intact to determine the fraction encapsulated. Values were multiplied by 100 to determine the percent encapsulation. The Firefly Luciferase mRNA-LNPs that were measured by Ribogreen and the percent RNA encapsulation is reported in Table 63.

TABLE 63

RNA encapsulation after LNP formulation

| LNP ID | Ionizable Lipid | % mRNA encapsulation |
|---|---|---|
| LNPV019-002 | LIPIDV005 | 98 |
| LNPV006-006 | LIPIDV004 | 92 |
| LNPV011-003 | LIPIDV003 | 97 |

Example 45: In Vitro Activity Testing of mRNA-LNPs in Primary Hepatocytes

In this example, LNPs comprising the luciferase reporter mRNA were used to deliver the RNA cargo into cells in culture. Primary mouse or primary human hepatocytes were thawed and plated in collagen-coated 96-well tissue culture plates at a density of 30,000 or 50,000 cells per well, respectively. The cells were plated in 1× William's Media E with no phenol red and incubated at 37° C., with 5% $CO_2$. After 4 hours, the medium was replaced with maintenance medium (1× William's Media E with no phenol containing Hepatocyte Maintenance Supplement Pack (ThermoFisher Scientific)) and cells were grown overnight at 37° C., with 5% $CO_2$. Firefly Luciferase mRNA-LNPs were thawed at 4° C., and gently mixed. The LNPs were diluted to the appropriate concentration in maintenance media containing 7.5% fetal bovine serum. The LNPs were incubated at 37° C., for 5 minutes prior to being added to the plated primary hepatocytes. To assess delivery of RNA cargo to cells, LNPs were incubated with primary hepatocytes for 24 hours and cells were then harvested and lysed for a Luciferase activity assay. Briefly, medium was aspirated from each well followed by a wash with 1×PBS. The PBS was aspirated from each well and 200 μL passive lysis buffer (PLB) (Promega) was added back to each well and then placed on a plate shaker for 10 minutes. The lysed cells in PLB were frozen and stored at −80° C. until luciferase activity assay was performed.

To perform the luciferase activity assay, cellular lysates in passive lysis buffer were thawed, transferred to a round bottom 96-well microtiter plate and spun down at 15,000 g at 4° C. for 3 min to remove cellular debris. The concentration of protein was measured for each sample using the PIERCE™ BCA Protein Assay Kit (ThermoFisher Scientific) according to the manufacturer's instructions. Protein concentrations were used to normalize for cell numbers and determine appropriate dilutions of lysates for the luciferase assay. The luciferase activity assay was performed in white-walled 96-well microtiter plates using the luciferase assay reagent (Promega) according to manufacturer's instructions and luminescence was measured using an i3X SpectraMax plate reader (Molecular Devices). The results of the dose-response of Firefly luciferase activity mediated by the Firefly mRNA-LNPs are shown in FIGS. 50A and B and indicate successful LNP-mediated delivery of RNA into primary cells in culture. As shown in FIG. 50A, LNPs formulated as according to Example 44 were analyzed for delivery of cargo to primary human (A) and mouse (B) hepatocytes, as according to Example 45. The luciferase assay revealed dose-responsive luciferase activity from cell lysates, indicating successful delivery of RNA to the cells and expression of Firefly luciferase from the mRNA cargo.

Example 46: LNP-Mediated Delivery of RNA to the Mouse Liver

To measure the effectiveness of LNP-mediated delivery of firefly luciferase containing particles to the liver, LNPs were formulated and characterized as described in Example 44 and tested in vitro prior (Example 45) to administration to mice. C57BL/6 male mice (Charles River Labs) at approximately 8 weeks of age were dosed with LNPs via intravenous (i.v.) route at 1 mg/kg. Vehicle control animals were dosed i.v, with 300 µL phosphate buffered saline. Mice were injected via intraperitoneal route with dexamethasone at 5 mg/kg 30 minutes prior to injection of LNPs. Tissues were collected at necropsy at or 6, 24, 48 hours after LNP administration with a group size of 5 mice per time point. Liver and other tissue samples were collected, snap-frozen in liquid nitrogen, and stored at −80° C. until analysis. Frozen liver samples were pulverized on dry ice and transferred to homogenization tubes containing lysing matrix D beads (MP Biomedical). Ice-cold 1× luciferase cell culture lysis reagent (CCLR) (Promega) was added to each tube and the samples were homogenized in a FASTPREP™-24 5G Homogenizer (MP Biomedical) at 6 m/s for 40 seconds. The samples were transferred to a clean microcentrifuge tube and clarified by centrifugation. Prior to luciferase activity assay, the protein concentration of liver homogenates was determined for each sample using the PIERCE™ BCA Protein Assay Kit (ThermoFisher Scientific) according to the manufacturer's instructions. Luciferase activity was measured with 200 µg (total protein) of liver homogenate using the luciferase assay reagent (Promega) according to manufacturer's instructions using an i3X SpectraMax plate reader (Molecular Devices). Liver samples revealed successful delivery of mRNA by all lipid formulations, with reporter activity following the ranking LIPIDV005>LIPIDV004>LIPIDV003 (FIG. 51). As shown in FIG. 51, Firefly luciferase mRNA-containing LNPs were formulated and delivered to mice by iv, and liver samples were harvested and assayed for luciferase activity at 6, 24, and 48 hours post administration. Reporter activity by the various formulations followed the ranking LIPIDV005>LIPIDV004>LIPIDV003. RNA expression was transient and enzyme levels returned near vehicle background by 48 hours. Post-administration. This assay validated the use of these ionizable lipids and their respective formulations for RNA systems for delivery to the liver.

Without wishing to be limited by example, the lipids and formulations described in this example are support the efficacy for the in vivo delivery of other RNA molecules beyond a reporter mRNA. All-RNA GENE WRITING™ systems can be delivered by the formulations described herein. For example, all-RNA systems employing a GENE WRITER™ polypeptide mRNA, Template RNA, and an optional second-nick gRNA are described for editing the genome in vitro by nucleofection, by using modified nucleotides, by lipofection), and editing cells, e.g., primary T cells. As described in this application, these all-RNA systems have many unique advantages in cellular immunogenicity and toxicity, which is of importance when dealing with more sensitive primary cells, especially immune cells, e.g., T cells, as opposed to immortalized cell culture cell lines. Further, it is contemplated that these all RNA systems could be targeted to alternate tissues and cell types using novel lipid delivery systems as referenced herein, e.g., for delivery to the liver, the lungs, muscle, immune cells, and others, given the function of GENE WRITING™ systems has been validated in multiple cell types in vitro here, and the function of other RNA systems delivered with targeted LNPs is known in the art. The in vivo delivery of GENE WRITING™ systems has potential for great impact in many therapeutic areas, e.g., correcting pathogenic mutations), instilling protective variants, and enhancing cells endogenous to the body, e.g., T cells. Given an appropriate formulation, all-RNA GENE WRITING™ is conceived to enable the manufacture of cell-based therapies in situ in the patient.

LENGTHY TABLES

The patent contains a lengthy table section. A copy of the table is available in electronic form from the USPTO web site (https://seqdata.uspto.gov/?pageRequest=docDetail&DocID=US12157898B2). An electronic copy of the table will also be available from the USPTO upon request and payment of the fee set forth in 37 CFR 1.19(b)(3).

SEQUENCE LISTING (3666 sequences)

SEQ ID NO: 1-1015 - skipped (1015 entries)

SEQ ID NO: 1016 - protein, 1390 aa, synthetic construct
  source 1..1390: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1017-1022 - skipped (6 entries)

SEQ ID NO: 1023 - protein, 16 aa, synthetic construct
  source 1..16: note = Description of Artificial Sequence: Synthetic peptide
SGSETPGTSESATPES

SEQ ID NO: 1024 - protein, 4 aa, synthetic construct
  source 1..4: note = Description of Artificial Sequence: Synthetic peptide
GGGS

SEQ ID NO: 1025-1139 - skipped (115 entries)

SEQ ID NO: 1140 - DNA, 175 bp, Taeniopygia guttata
  source 1..175: mol_type = unassigned DNA
gtctagttacaactgggcatcgctgcagagatcgcacctcctcgtggtcccgctggtagcccttcgaagggtgactaagtcgatctctgccccaggtacggagccgttgggactcaccagtccaacgtaactcctgcctaaattcggtgaaacaaattcctcggtaaaaagcccc

SEQ ID NO: 1141 - DNA, 91 bp, Geospiza fortis
  source 1..91: mol_type = unassigned DNA
agacttaagtgagtttggttacaactgggcatagctgcagagaccgcgcctcctcgcggccccgctggtaagcccttaacagggtgactaa

SEQ ID NO: 1142 - DNA, 160 bp, Zonotrichia albicollis
  source 1..160: mol_type = unassigned DNA
cgacttgagaaggtctggttacaactgggcatagctgcagagatcgcgcctcctcgtggccccgctggtaagcccttaacagggtgactaagtcgatctctgccccagtccaggagccgctgggtttcaccagcccagcgattccttccaaattcggtga

SEQ ID NO: 1143 - DNA, 152 bp, Danio rerio
  source 1..152: mol_type = unassigned DNA
aatcccccctacccaatccccccgtcgtgacctccaggccaggaatcacgagcgtacgacagtggccatccggcaatgacaatagcgtgactaacgacaatgagtcagatccatgacccttggagtgggttaacctccgcctctttaaaaac

SEQ ID NO: 1144 - DNA, 500 bp, Gasterosteus aculeatus
  source 1..500: mol_type = unassigned DNA
catattggggtctcaggaggagacacagggtctgttgcggctccggtaaacggtaccggagtcggttaagcatcgtttgggcccgcctccacgtggtggtccgcggtaacaccaatagggtggctaagaggcccagtaatttccccgaattgtcttcccccccgcgcgggggggacccccctttagtgtcggagcggtcgcgcctccgcgtttggggtgtcgcaggcgtgagccttcgtccccttaagttcagacggtcccggcttcttgccgggccaacccccggtgcagcgttctcccatgttggatcggcacccagccccgggtgccatgcgagttcagacattttgtttatgtatcgtctgcgtggttgacttgctaagctcatttcctcctctcactgcgtccccccaggtgctgatcggttgaagaggattcgtcgttgacctcggcggtgaatttgggattgtattatacaggtaggtatagagggcgtgcgg

SEQ ID NO: 1145 - DNA, 595 bp, Bombyx mori
  source 1..595: mol_type = unassigned DNA
gggcgatacgcataattttaatttcccgattgaaatccagtcgtcttaatctggtgaccagtggcgcggtcaccagtatagtgcacaggacgtgaatggctccgaggctggcggagtcactcactataagtgtgagagacgatgtcctgtgccaagtatacgtccaaccctaacgggttaagtgaaattagttgctcataacagggacggtgtacctgtttgctcgtggctggctatcgaatggacgggaccaatacacccccctgttagtaatggggtaagagagagcggtctgaaactatggccgaaatcacgacgccccactcctacccataacctgcacgtggtaccgccgcacattgaccgatacgggaggaggggcagcacttgaatcacgtagtcttggtgtagccattgcgggactacagccctcgtaagtgccgccttagaacgcaacggggcaataggtgggccggggcgctagcgggggggagtaatctcccctgttggcgtgcaccgcactgctcccactgggggcagtgtcatccggaaacaggtgggccggggcgccaccaggggggagcaatccctcctg

SEQ ID NO: 1146 - DNA, 337 bp, Hydra vulgaris
  source 1..337: mol_type = unassigned DNA
ttcaagtggatgaagctgggaaggtaatctgtagttggttgagttggttgcagattactgctgtcgattttgctttctattgaaagcctgtctctacgggtcctgaagcttgaattttggtagctatagttttgtgggaggaaagtggaattttgtaccatcttttgtctctcgtatctactatagtaaatccggtcatgcagcctctacgcggcgcaactagaaacttggatcagtgatcaaggctaatgcatgccgggtctcctcagattaggagtataatacaaatctgacttcatcactaagaggctatggggctaacgatcctatagtctcg

SEQ ID NO: 1147 - DNA, 265 bp, Hydra vulgaris
  source 1..265: mol_type = unassigned DNA
cttggggtcactgacacatttttcggtagccatagttttttgagaggaagagtggaagtttttccatgagtcgtctctcgtataaactgtggtaaatccggccatccagcctctacgcggcgcaactagaaacttggatcagtgatcaaggctaatggatgacgggactccatggataaggagatataaagatcttatttgaacgcatcttaaggggttatggggctaacacccccttaattctggtgcacatttattgaccgtt

SEQ ID NO: 1148 - DNA, 569 bp, Adineta vaga
  source 1..569: mol_type = unassigned DNA
gaaatagtttgcaatggtaggtgtatggcgcctctgtgtctctctttcgctggatatagtttgacgattttgtaccaggtatctgtttcttgtgagttcagcaccagtttgaacaggcttagcgatagaccttcgaacttgaaacactgttgtgaagctggctgggcccctgcagattttctcgattagaacgtgagtgttacgtccagaatgacccaccagtggttagttctacgttgccctggaaaggagaaaagttgagctaaaatcgcacggcctagttgtttatcaaataggcacggtgaggaactcttctatgtaccctgactaaagtactcacttgtgcgctgggtttgctccccctcgcattgacttatctgatcgcactacccaccaaacgaaacataaacttagctcgtggtatcagtccacagcgtgtgcagtcggattcaggggagcgtgttagtgacaagcaggataatattaacatagttaatgttaaggcgttcaacattccttatccaattggaagagttgactgtgaagtttgtcatgaagacattggacaa

SEQ ID NO: 1149 - DNA, 265 bp, Oryzias latipes
  source 1..265: mol_type = unassigned DNA
cgcacaggggacacagagcctgcccaagtaccgctcccgagggagcgggaaacgggggggtgactatcccctggggtccggcgagagcgctggtctacggaccaggggtggctgtgggcaggctgctcctcaggccagttgattagttacgcatgggctgtacctccacgtggtcccgctggtaacgacttgtcggctaaatcagcccgcccaccatctgggatatggttgaccgtctaaccccagtactcaggtcacaaacaaa

SEQ ID NO: 1150 - DNA, 840 bp, Limulus polyphemus
  source 1..840: mol_type = unassigned DNA
tgggaggagacccaaactatcctaggatggggcggaaccgaccatatgagccatattaacattgcccacactatcctctggaggtacctcctcgtggtacggctggatataggtaaatcctgtaaccaaatcctccaacccgtgaaggagaacactaaaacccatatagtggcctcgccaaccactatatgtccaacggcaggagaagctatctcccggatgggaaggaaaaccctaaaccgtgatgggaacttaccggccccatcagctattgggtacccggtagggacttgcaaccctaccctgtatttgcattttatagggaaccggtcggccctatatcagagtagaccgtttattaaatatgggtgaaaatattaacagtaaaagctatggtttggcgtccgtgtggtgccagggcggcggccaaacccgagctacttggcaccaactggggatggtagcttccgagcgattccctggcgacgtgggaccgatcgacgatggagtccaaacatccggaatagaggaattgagaaatacctattccaccaccggctcacatacccaaggtgaacccggtgcaactagagtacaacctatctgtggcggtaggtgccgaaccactcaggtgacgggcttgtttattgatgtctccctacgagacacgaattgtgacaaatccactccggtggacaattacccgatctatgaacctgttaccgatattagacaagaaaataaagaactgacaacgcctagagcttcaggcagcatgtctgtaagtatccagtcatcgagcgtgactgagggcgaaattgataataactctgaaactga

SEQ ID NO: 1151 - DNA, 394 bp, Caenorhabditis elegans
  source 1..394: mol_type = unassigned DNA
gctcactttctatcgtgttaaccgtacgtttacactcccagtgagtgtaataaaggttattcgatagagggtgtctccctctttcttgggtaattcttcggcggtccggggtctctccctcgtcttttttttaaacttttctttctcatccactcttttgctcctttttactaactcttgtactctatagtcttttctcatcccccatccgccgttgggcaaagtttatttactttgttaaatccatattttatctctctcacccgtacagaaagcgtctccttctcaaacgcttttctgtactttttcttatattttcattaacatatttttcctgtttatactaacctaacctccattgtcaattactaactaacttgtacaacggatttcg

SEQ ID NO: 1152 - DNA, 69 bp, Cryptococcus neoformans
  source 1..69: mol_type = unassigned DNA
ccctcttaataccccataacacataacaaccccctaatcaacgttctctgcaccttaaacaccaccaac

SEQ ID NO: 1153 - DNA, 102 bp, Chondrus crispus
  source 1..102: mol_type = unassigned DNA
acgccccctatccatttctgccagcctcccatcggctcgccgtctccgcaacccctcttcctcggctgtaccagttccgctcccacaacctccctcgccaca

SEQ ID NO: 1154 - DNA, 74 bp, Chondrus crispus
  source 1..74: mol_type = unassigned DNA
  misc_difference 2: note = a, c, t, g, unknown or other
cnccagccamcgatcccgccgccactcgcmgcccggccgtctcgaccgccacctccccgasgccccagcccatc

SEQ ID NO: 1155 - DNA, 714 bp, Acanthamoeba castellanii
  source 1..714: mol_type = unassigned DNA
taaccctaaccctctccctcggcccctctaccctaaagcgccctaatcgaccggcgacgccctaatcgctaccctctacgccctaatcgactttggcgccaaagcgactttccccggccgattttcttcctgcctttttcttttctctccaagcgacgcgccttttactttgccgccgttctgttttttcttttctctttgcacttcgcttctacttcacacctcctcctcctccttctcgacccgcgcggcctcgagcgacttgctgcagcggctcccggcctcccccacgcggcctgctactcccgctttctagacgcccccggtcttgctctcagtctcccgcatcgaagcggtagtcggggtacgtgctcaagtgactcaagcctcttttcagcctcggcgctctctcaatccgcctcagtcttagcctttcaagttgctcgattacgctctcgaatcgctctctctctcagtctcagtctcagtctcaatctcgatcttgccttcgccttcgtctcgacgccttgctctcgwaatcgctgccactacgtgccagctttttcgtgccttgtcttcgtgtcgacccggaccgtttgcaagccctcgccttcgtaccccgctctcgtagccgttctcatcgctgaagcgttctacgcgctggcagcaagcctcggccctagcttgtagcgccgccggtggccgctcgccaac

SEQ ID NO: 1156 - DNA, 200 bp, Fragilariopsis cylindrus
  source 1..200: mol_type = unassigned DNA
atcaatctaatactgaaggcaataccaaactcaacccgaaatcaaaatcgttagaatcaatatacgacccccgctgctgtacatgtccagccggatctcgttgtaaagaagattgcagctgtaaaaaagttggacttctttgttcttcctgtgaagaagttgattgtggctgttcaaattcttttcataataaagaatta

SEQ ID NO: 1157 - DNA, 832 bp, Hydra vulgaris
  source 1..832: mol_type = unassigned DNA
tttctaatgttacgtgatatgatatggttagttcatggttagtttatgtttatgcttagtttatggaaaatcgtttatttatggcacaatattgtttgctgtttttaaatttatgtaacgtgtgcatttgatgtatattcttgaactttttaatctgaatttttacttggtttaatacgtttattatattcttcgattgagcaatttatcctatcaaagcaatttatccttcgattcgagcaatttatccttcgattcgagcaatttatccttcgattgagcaatttatcctatcaaaattagcatatatactgcaattttcaaataatctacgaaataagttcacttactgaaaatcattaagtaaaagaagaaaggaagaaaaaataaaaataaaaagtagtaaatcctttcataacaataatcattctattattaaatttaaaggaatattttggttttgtactaaatcatgcgttcatatttcaccgaagaagggggctgctatatttttgtttgaagttgtttatcttaaaactttaaacttgtgttcaaccaaccgtaaacattagttcgctgttcgctcaaattatctacaatataaaatttatcaatcttttttcgttacggtaaacaataaacaataaaataactatagttattttattgtttaccgcatattgtttaactatagttaaacaaagtatttgtttatggaacattaccagtatctcttgttaaggtaaacaacaaaacatagacggcatctctttttaaggtaattaagtatacggctaataataaaaatatacagctaataataaaatcttca

SEQ ID NO: 1158 - DNA, 258 bp, Lactuca sativa
  source 1..258: mol_type = unassigned DNA
acattaaattagagaggttgatgtttcaatggaagaagatgaaattccaagaagctatttttgttgcccaccaagtgtttgataaaatgtccaaactaatttttctcttgttgcagctttattgttcaagataatgtagtttgcttagtttgagcgttccttgtgcacaccaacagtgtgttggtgtgccatttcctttccttcctttttaactattgcttcatagcttaagcttcatctcgaggcttgttctcttgt

SEQ ID NO: 1159 - DNA, 122 bp, Monosiga brevicollis
  source 1..122: mol_type = unassigned DNA
catcttggcgtgaaccacgttgtcagacaaaatctgcaaccccgctctttgcggcccgcgttttggcggcgccctcgctcccaccgtgtccgctcgcttgctcgcttgcttgccccgcggac

SEQ ID NO: 1160 - DNA, 453 bp, Hydra vulgaris
  source 1..453: mol_type = unassigned DNA
aatttaaaaaaaaaaaatcgtttatttatggcataatactgtttgtaatttttgaaaattcgtgcaacaactgcagttaaattgaagagctgaaatttaagatctgagcttttcaatcagagttttttaccctaaaacattaaattttatcataacaaaaatcgttctaatattattaaacttaaagaaattcgttcttatatcaaatcttatttcagtgtttcacagacgaagggttttactagatttttattttttcaacttttgaatttgtttattataaaactgtaaactagtgtgcaaccaaccgtaaaaawtagttagctgttcacccaaaatattattcagtatgaaaatatttaatcttctttattcgcagtaaacaataaaatatctagttaaacaaaatatttcttaataataaaaaacaaaaactttttcttaacaagtaca

SEQ ID NO: 1161 - DNA, 1461 bp, Magnaporthe oryzae
  source 1..1461: mol_type = unassigned DNA
cccgaacccgaacccaaacccaaacccaaacccaaacccaaacccaaacccaaacccaaacccggagggttcccaagtcgcctaaacccgaagggtttaggatattatttcgtttattagaattggataattatttacccctgttggacaggggggttgcaggggttaaattaaggttttttattatttatgcgccgtttatttgtttacccccccaaatattataaaagcgcgttccatcctcttaggaaaagcgaagcttttccttgtaaaagtcgctagacttttactataaaagtcgctagacttttataccaatcttttaacaaaaagcgtagctttttgttgccaatctattaaaaaaagcggagctttttttaactttttcttttttttttttttttcttttttttttttttttttcttttttttttttttttttttttatatatattattattattattattagcggtggggctatttatgcgctttaatttgtgcggggctatttatgcgctttaatttgtgcggggctattaatgcgctttaactttacaaattttatttatgcgctttaattgctgcgggcctgttaatgcgctttaatttacaaatttcattaatgcgctttaacttttatatttactaatgcgttatttatataattgctattattatcgttgctattattattattgctattattatcgttattattattgcaattttattatataaaccctcgtttgtccctcgatttatcccgtttcttttccatcccatcgcgcgttttcgtaagctttggttttcgtaggatttgctttcgtaggctttgctttcgtaggctttcgtcagcttttacctgcttttattttttctttttctttttattccccccccttttttttacctggtttattagcggtttacctgcttttattacctggttcccctttacctgttttattagcggtttacctgcttttattacctggttcccctttacctactttataagcggtttacctgcttttattacctggttcccctttacctgttttattagcggtttacctgcttttattacctggttcccctttacctgttttattagcggtttaccagcttttattacctggttcccctttacctactttattagcggtttacccgtttctattagtgggcatttatttcccgtttttattagcagttaaatttacccttttaaggttatttacctgcttttattcacagggcacccctgtttttactagcagttaaatttacctttttaaggttatttacctgcttttattcacagggcacccctgtttttaccagcagttaaatttacctttttaaggttatttacctgcttttattaacaaccctttattttttcctattaacgggtatttatttacctgttttattggaattcacccgttggacggc

SEQ ID NO: 1162 - DNA, 278 bp, Branchiostoma floridae
  source 1..278: mol_type = unassigned DNA
ttttcagtctggctcagccagtgaccgccgggaaagtccggctgactaccacgaatagggtggtgacagctggatagacagacgacagctcggaaagacggcattggggcagtatgggttggcacccctaactgcatctcccctaggagagcatcccgcaacacgctacaaagaaccacaaagagcaatacccccagggatgcccgagagggggggaggatgagcatcccattcggacggtccaatcggtattgaccccagcaaacggagaatcgaca

SEQ ID NO: 1163 - DNA, 251 bp, Danio rerio
  source 1..251: mol_type = unassigned DNA
ttcaagcctggcgcagccagtgactcctaggaatagactaggtggcaaccaagaatagtttggtcgactactggagagacagttgacggcacggaaagacggcacttgggacagtatgggttagcaccccagcctgtgtctttcgtgagagagaacccaaacaagctacggaaagccccacagagatatacccccaggagatcccgagagggggggaggatgagatctccaatcggacggatcaaaggtta

SEQ ID NO: 1164 - DNA, 214 bp, Branchiostoma floridae
  source 1..214: mol_type = unassigned DNA
ctgaccagcagacgggaagcccgcgaccaactagtctccgcaaatattgcacacagggcgaccctatggagctgattcagtcaaatttcctctgagatataccgataactatctacagaaactgcacagttagtttggaaagagcttttctactgaaagacagcaaaatccgccactttagacgagcgtcaagactgccctccccataaccaat

SEQ ID NO: 1165 - DNA, 12 bp, Danio rerio
  source 1..12: mol_type = unassigned DNA
aaagcagtagag

SEQ ID NO: 1166 - DNA, 217 bp, Takifugu rubripes
  source 1..217: mol_type = unassigned DNA
agactaggtgacaaccaagaacagttwggtcgactactggaaagacagttggcagctcggaaagacggcacccgggacagtatgggttagcaccccagcctgtatctttcgcgagaaggaacccaaacaagctacggaaagccctacagagaaacacccccaggagatcccgagagggggggaggatgagatctccaatcggacggacctaacgtta

SEQ ID NO: 1167 - DNA, 247 bp, Tetraodon nigroviridis
  source 1..247: mol_type = unassigned DNA
agattggtctggctaagccagtgacgtccaggaacagactggctgacgaccacgaatagagtggtgacagcttggatagacagctgacagcagggaaagacggcaaccggggcaggaagggctagcaacccagcctgcatcttccgtgaggaagaacccaaaacttgctacgaagagcccgaagcaaagatacccccaggggagcccgagagggggggagaatgagctccccaaacggacggataac

SEQ ID NO: 1168 - DNA, 227 bp, Schmidtea mediterranea
  source 1..227: mol_type = unassigned DNA
aaacgacatcatgaacgcttggccgcaacaatccagttatccctgcggtaacattgtggaactcataagacaagtactaaaagaagaattagaaaaattagaagaaaaaattgaaaataatttatttataaaatttaaaaatttaaataaatttaaaaatttaaatttaaatttaaatgaagataaaaatttatttaatccaataaataatcaagaaaatcaagaaa

SEQ ID NO: 1169 - DNA, 74 bp, Caenorhabditis sp.
  source 1..74: mol_type = unassigned DNA
aaggacgctggtttaaggccgaattcgttcgttctttttctggcggtcttgctttgagcttggtttccgatcct

SEQ ID NO: 1170 - DNA, 815 bp, Caenorhabditis sp.
  source 1..815: mol_type = unassigned DNA
gcgccccgggttacattgtcggggccacctttctcttggagtagagtacagtctactaattttttgataagctagtcgggtccgaaccactagagtttgcttgaaaatgcgtcaaaccagcattttagaactcgcccaaaagttcggccccgacccccaaacaaatgggaccttcttgacgattttccctgaaaatcggaggatggaatggtcccctattcttgtaaatagkactgtgcaataccccttcgtcatctgtggggaacagatgacacgtgacgtcatccgtgtagacgtcacgttttcccgtgcctgcgggagcccccaatcgagcaatttttgctcttttgagtgtctggaacgcttgaaaccccagacaaatcaggcccagtcgtcggaaaatttctttttgaaattttttggcgcctgcgaaaaaaattttttaaccgccacaaacccccgggaggcgcggwtagggatatcgatgtcatcgactcgtcggtgatctttgattttctctctgcgtctcctattttggaacagtctcgaccaaaaaaccgggcctggcaacccaccgaatccggatgtcggagggatttggcaagaaatgttggaaataacgaaatttcgttattttcagcacaattgtcaaaccggcaagaaaactggatggacaagacacacaatttaccggaaattgtgcttgttacgtcgaatttcccaattttgaaaaaattcctcgttccactggtcgggacgcgaggtcagacgatctgcacgtctgaaacccaaaatcttcggattttatgcagtag

SEQ ID NO: 1171 - DNA, 14 bp, Caenorhabditis sp.
  source 1..14: mol_type = unassigned DNA
cgcgaaccagtcat

SEQ ID NO: 1172 - DNA, 19 bp, unidentified
  source 1..19: mol_type = unassigned DNA; note = Description of Unknown:Trichomonas vaginalis sequence
gggtgagtagtctagtggt

SEQ ID NO: 1173 - DNA, 389 bp, Caenorhabditis sp.
  source 1..389: mol_type = unassigned DNA
gactcgccttggggaaggtwtttcaggggksaattgccgmaggcaaggcagcccccsmmtagcttacaaagtaagtacmcattttcatttcttgtgaattctttaaacatatttttcttgttttttgatttcttttttctctaccttcccccaattcttcccctcatcttgtgtatacatccccctcctccaaccaatcaatacattgacctctctcttctgtcaaaaaatcaatactagtatattgtcccttgtatagtattatttgacgtcgtctttgtattaggagtaggtaacaawctgtgtatggcttcaaaaagcatgcacaaacwcctgtcaaaaagtawttcccatcmtgtgaatagctcaacgacwkgaagmccaatgat

SEQ ID NO: 1174 - DNA, 839 bp, Caenorhabditis sp.
  source 1..839: mol_type = unassigned DNA
ccaactctcatcgtattaacctacggtattcactcctagtgagtgtaataaaggttaattacgttttctcttgcmagagaaaaagaaaattcgaatcctttttgtgtaactcacaaactgacagagacctatcgaatttcctttgtttcgtatataggaatagtcactctggaccacgaagtggacagttgtcggcggacttccagagtggagagaaaaggtgtgaagagaggaggtctagaaacacttcggctgtctaggaccagttcctgagtggaaagaggaaggtctagaaacacttcggctgtctaggaccagttcgtgagatctctcgtggagagttgaaaacagtcagctgaggctactgtatttcttgatagccccgcccccaatccccctcccccccccctcgacagatttttctgtttgacctcctggaatttgcgaggagtgcgcgagaattttcgaattcttcgcgcgttttctcgaaattttccagaagattcgagcggagaatcttcgagaaagtgagctgaatttcgcgcgaattttccgcgattttcaaattatcgatttttgtcggaaaatttattttctggcaaaatttgattgagttcacgcgggagagaaggaattgttggaaaagggtattgatttttgtggcggaggaaactcccactgaatcaataactctcaaaggagaactcatcgaacaacctcgggtgacctgaatcttgggcgaaattttcgcattgacacaagataamacaaattactgtkgaaaataaatcagaacaaactgtcaaaaagagagacaaaaagtattgattaacaacatc

SEQ ID NO: 1175 - DNA, 320 bp, Caenorhabditis sp.
  source 1..320: mol_type = unassigned DNA
cccttttctatcgtattaactacgataaccgctcatttgagtgtaaaaaaggttcccccctcctcgcctgccttacccacgcatctctgcctctgggaaggcggagggtcaacttgcgggtctgtggatttcctttcctatccaccgcccatattctctgtcgaaagcctacctagatcagccgggagtttttcctatcccattcaggcgatcgctcaaggctgttttatcgacactccttcttgacaagtatttatttcttgacaaattctatttttccttttatcgattttctcttatttatcgattcttgtgaaaat

SEQ ID NO: 1176 - DNA, 992 bp, Schmidtea mediterranea
  source 1..992: mol_type = unassigned DNA
ttaaatcatttttaaatgtgtttgaatatcttaaattatcaaatcatattaatatcaatgctaaaaaaaaatcgtgckcatcaggcgcacgaaaataatggacacaactcgtcgacctgctgtcgactcacagagaacctcaatttggaagaatgggaagcctataatgctacaattccgccaacccctatttgaatgacagatagtcaaatatcaaaaaatatacaaactgctgtcaagcgtgactcacttccttccaatcgaaaaataggaakatgtaagaaacatgaaagtcaagctgaaaaaccaataatatgtcctaaaataaaacaatttgaaaatatgcaaaaaatacctataaaatcacagccgaataaattcccatccgttctaagcagaaaccgctacgaactactgcaagaatcggatcaagtatattaatttccccccmgggggaaattaatatacttgttakaaaattaattttttaataaaaataaataaatcgaataaatataaaataaaaataaatcaaattaaacttttattaacaataaaatcgcagtaagtaaatttccactgttattaaatttaaaacaaaattcctttaaaaatgcctctctttttcagtaataacaccttttcttgcttttattactatttcttgtgtactgtacaaatcgagcacagttattgcaaataggacatagaaattcctttttaagtaaatttaaatccatgagaaataaaataaaatccttttgattcaaagtttctatgttgctttctaatagaatggtgtaagcattaatgggtcttgatttttataaattaaatatatttaatctattaaattaatatgtttttattaattattaatttttatagtggggggaaattaatatacttgatcccaagaatcaactgatgatgaagaatatgttatttcaaaatacatacaagaagctggaaaaaacaaatcaatcgctaca

SEQ ID NO: 1177 - DNA, 1123 bp, Girardia tigrina
  source 1..1123: mol_type = unassigned DNA
gtaggtaactatgactgcaaaataataattctacacctattgttgataactcatctcgtgcgcaaacggagcatgttatttctaatcatttcgtcacacaggattcttctaattctgatagtaatattatagatagagataggaaccttgttgatttagatgcgtcaataacttctcctactattatacagccagaggatagtaagatatctgaggatgaggacttcatcttagtcaataggaaaaagagcaaaaataagaaaaaatctaagaaaacaactgaaaataaaaatgaaattcctattcaaaagagtaaagataagaaaaagaagtctaaaattaataccgaaaaactaactgaaaatattactacttctgaaataccacttgaaattgctccttccatacctttaccttcagcaagtacctcgggttctcaacaaccggccaatcctccagaagacgctactctaagtgatacggatctcttccttacacaggatgatcccgatagtcttattctttctggaagtactcaaccaacctttgttgacctcaacccttcacagcaatcggaacttccttcaaatactgacagccaaagatttgaggcgggtgaaacacccaaaatcataacttcttacagggatgaccttttctactctacagtccttcactacaactcagatacaggttacggtataagtgttgacaatggggagcagaggtttcgaattcttgctaggaatcttgtcaggaaaaccaaggataagttcccctctttatatgctggacaagtaattagacacacagtcttcttcaatcacttcaaccaggcatactacgccaataatataactgatagtaaaggtaatctaattgagttttctgatgataagccttttcaaagtataccgactgacccaaaaactgaactagagcaaattaggagagagagacaacatctagttgatagagctcttagacataatcagttacgggaaacttatattttaaataaacttaataataataatggggggggtggcgaacatttgaaaaggaaaaagatcaaagtcaatacggatgatgtctccagcaatgatggagacagaaaacatag

SEQ ID NO: 1178 - DNA, 43 bp, Chrysemys picta
  source 1..43: mol_type = unassigned DNA
gtttaattccttctgatggacatctgcaacacccgtcctgaag

SEQ ID NO: 1179 - DNA, 107 bp, Acanthamoeba castellanii
  source 1..107: mol_type = unassigned DNA
cccgtcaagggtgctccacgagatccctgtcgctagccgaccggttttaccaccccaccccgcccggacaaccacggaccctgctccgcagcaggaccccacgcacg

SEQ ID NO: 1180 - DNA, 188 bp, Acromyrmex echinatior
  source 1..188: mol_type = unassigned DNA
ggtgcacaacggatgcatcatacgtgtaccggagcatacgggctgtcacggcggctgcatgcgcgatctagctcggagattttatttatttatttattaatttatttatttattcatcgagtgtgagtgttcgcgttttgccgagaagcgattttcgttaagtgatacgcgccgcgttcataggttag

SEQ ID NO: 1181 - DNA, 1264 bp, Alligator mississippiensis
  source 1..1264: mol_type = unassigned DNA
tgctggaaagacggagaaccgcttcctttttccctgcgcctggcctggtattgcagtacctccaggattagcgccaactagtccggcagactgtcggaatacagcaatagaaagwgagctgactagcagcttgctttccttcctccggtgcagcatgggttctcgtcagtcmtgacgggctagggaaggcggtgctgccagtacgtccgaaagagtgccggttgcgcaagcgaccgcgccactcaggtgagtagccaagggtcttacagttcaccggacccgawaacgcgaaaaccccaactcgggctagtagccgaagacctgggtcccccccmggtcagagtaggcgaacgccwgkgctcagaggacggaacgcggaaaacacccccaggtcccaaggacgccctgatccactgacaagaacgctcgaggcacgccaggagacccccagctagggtggaccgccgactgcaggtccggaggaccctcccaggagggtggaccagcgaacccaagttggcgacgaaccctgacgcaccccccacgatgtcaggaccccgacaggcggcggtggaccactgaccatcgaccgacccccagaggcagagagactctcagagcccggaaccccggctgacgagagccgcctcccggcggaggaccccggagcctgaggatgccccccggatgacggcggagcgccccgagcgacagcggacccctccggacccccacggcccctcggtgacgatggcgggccccgaacgacgacgacccccggaccccggcggtcccgaggacgccccccccgagggtctccccacgctggtggaggagccccggacccccccgacaccggacccccccacggacgacccaggcgaaggcgtagacatgacagcactcacgttcctccccttccccctcccggcgaagctgttctgcccgacctgccacccgccaagacagtacaggtcgcacggcgacatgaacaagcacctacggcgcttccaccagctgcgcctagccttctactgcgccctctgcggcaccgagtacgaggccctgaagctcctgaagaaccaccagaagggatgcgagggccacggagccgagaggagacccggcacgctggtgaggtccgctgccccggcccgccggacccaggccgcggtgcgaaggcccgccagactggccaccccgccgacaaccccaccggaccagacctccagggaccacccgacggagagacctgccccagtga

SEQ ID NO: 1182 - DNA, 200 bp, Chelonia mydas
  source 1..200: mol_type = unassigned DNA
ctcttcttatgaatacttgcaacacctgcactgaagatggattctccggctgctatttttgaaaaactgatgctgctttgaaggtgtattctgctgctgctaccttggaaggaaattctctctctgctcctgagacatccccagctgcaccgtgtaccaccaccaccactgctgctgctccacagaaggtttctcggaca

SEQ ID NO: 1183 - DNA, 460 bp, Chrysemys picta
  source 1..460: mol_type = unassigned DNA
ttttttctgatgcttgactgcaaacacccatccagaagatggaatctcctgcagccatttttgaaaaaattgatgctgctttaaagatatactccattctcctwktttgkaagaaaactctttttcagcttcagctattctgtcatcggctgctgctgttcctgcttcccagaaagctcagcmaaaacctatcctgaagaccwcccttggtgcctcacggaagacccggascacctgcaagaaccaaaacattaggagctggctgaagaaaccccccgtggatacctcwgcagggagacctggstccagmaggacakctcttcgggacctcmcatcsaggagcaagaatatctcaacagctcttcaggagggggacccccggagaaccctgcccgcttcccagaaccaggatgctgatcgccgccccaccgggaaggatgccaccgcaggagccccccca

SEQ ID NO: 1184 - DNA, 380 bp, Drosophila sp.
  source 1..380: mol_type = unassigned DNA
aaagtgtagttcttttctgttttagtgtagtgggaagtctgtttctttttattatgttttttacgaaaaagtcctggtctttgaaattcattgtctaaattttaaataaaattataaaatttaaaaagaaaattaattaaagaagcgatgaaatatctctgaaattcaatcaatcaattaatcatggcgtctcagcgagtgcacgtatttgcctaccccttcgtgggaccattccggtgctccgtatgcatggatgcgtccgggatgcatcccactaggtcgctgggcgaatacggcacatacgctgcggcatatcagcacataacccggcgccacccacaagtggttattacataccgttgccgggtctgtggcgctga

SEQ ID NO: 1185 - DNA, 557 bp, Gavialis gangeticus
  source 1..557: mol_type = unassigned DNA
  misc_difference 325: note = a, c, t, g, unknown or other
  misc_difference 444: note = a, c, t, g, unknown or other
cgctggaaagacggagaaccgcttctttttcctgcgcccggcctggtattgcacttcctccaggaccagcgccaacctagtccggcagactgccggaataatagcctcagaaagagagctggctagcagccctcttttctttcctccggtgcagcgtgggttcttgtcagtcctgatgggctagggaaggcggtgccgccagtacgtccgaaagagcgccggttgcgcgagcgaccgcgccgctcaggcgagtagcccaagggtcttacggttcgccggacccgataacgcgaaagccccgactcgggccagtagccgaagaccntgggcctccctccccaggtcggagtaggcgaacgcccgtgctcggaggacggaacgtggacaaaacacccccaggtcccaatgacgccctgatccactgacaagaacgctcgaggcacnccaggagacccccagctagggcagaccgccgaccacgggtcgcggaggaccctcccaggagggtggaccagcgaacccgagtcggcgacgaaccccgacgcaccccccccgcg

SEQ ID NO: 1186 - DNA, 10 bp, Lytechinus variegatus
  source 1..10: mol_type = unassigned DNA
atctactatc

SEQ ID NO: 1187 - DNA, 102 bp, unidentified
  source 1..102: mol_type = unassigned DNA; note = Description of Unknown:Nasonia vitripennis sequence
ccattccttcgtacgggttttcgtgccggcatagccgggtgggagactcgcgcgggggaggtcatatctcaccaccatcctcgagctttttgctgcacctga

SEQ ID NO: 1188 - DNA, 1097 bp, Phytophthora capsici
  source 1..1097: mol_type = unassigned DNA
  misc_difference 169: note = a, c, t, g, unknown or other
  misc_difference 956: note = a, c, t, g, unknown or other
gcccgccggtggagtagccatgttggccaccaccgcccaagtctccgccgcagctgcgactgctgctgctcatcgagtcgcagtagtcgcagctgcacaagcaccacctcctgccggacgcgccgccgtggagcaccacgcgcgcgctgagccgtaccaagaccaaggnttccaggctcgcgcgcgcgtggmgctcccagccagcgacgcgttcagcagcagggtcggctgcggcagctcgacgctgcacggggacggcagcgacggcaggcaccaagaccacgacgaccaagccgtcgctgccgtccccatggacgtcgaccaaggtgctcggtggccgacagcggatcamcacccgctgtcgccgccaccggagctccgagtcggcggcaagcgccgccgcctgaacgacggcgacgacgaagacatccgcgagctggccgagcttctgctgcccgacgaggaggaggccgacgaccacaaaccagcgcccaggttacccgcgaccagcgctcatccggcctccgtcctcgctgtgtacgcgcacaacgcgcagcgcttcaactgcacgttgtgcgtgtacacggctgccagcttcgctgctcttacgcgacacagggactctcggcaccggcgcgtgaccttcctggacaggttctcggcgggttgcgcgtgcggcaaaccttttgcctcgaggctggccgcagcaagacacgcacaaacgtgcgccagcctcagcaccacactggtcgcggtttcgacgacaggaggagcatcaagccacactgtcgtcggagccaacaccaccgtcgccacggcggtcaccgccgaaccccccctgctccaccatcaagcctcggaactcactgtgcccccccccacgtgtgagttcccccgacgtcgatgtgcagctgcacagtccgccacaggaagatcagcacgaggacgccacccancacccggagagcacgcaacaccaacctcctgaggcaacccgctggggttcgccgctcgcgcccacgctcgttgcctccaggattgctcagcgactcggcgagctggaacctccacgctggggcccaccattaccccgcgcg

SEQ ID NO: 1189 - DNA, 378 bp, Phytophthora infestans
  source 1..378: mol_type = unassigned DNA
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccagaacccccagaagacgtcgcgagtgtgcttgccccacccggcagggcaggcagc

SEQ ID NO: 1190 - DNA, 142 bp, Patiria miniata
  source 1..142: mol_type = unassigned DNA
ctgatgtggataccttggaattactcaaccgtgtcggagtcttttgtcttttgcgcccaacacctcatggataccatgcttgtcgctggagcgacgttacaagcgtgagggcgccctccatgccggacagctggtctgtgcc

SEQ ID NO: 1191 - DNA, 291 bp, Phytophthora sojae
  source 1..291: mol_type = unassigned DNA
agacgagcaacgcgctggggcccaagacctggcacgaacgacactgcccaggctgtgaacgacgagcacgctgctaacccggcagcgcaccggcctctgggctccgctgcaccggttaccggtgcaacacggtggggtccacgtcacggcgcgatcggggcagcggctgtagctcgcctgctcacaggcctacccacggcaccagcaccagctacgcgccggcctgcttcggctcggcgctgcccagacccgcccgctccccccgcggccacgacgacagcccccgatgcg

SEQ ID NO: 1192 - DNA, 698 bp, Pythium ultimum
  source 1..698: mol_type = unassigned DNA
gcggtgtacgcgcacaacgccgcgctcttcgagtgcacgttgtgcgcgcacaccgcgcgggatctcgccgcgctccagcagcatcggcgctccgcgcaccgcagcgtccgctttgtggatcacttccacagcggatgcgcgtgcggcgtgagcttccactcgcgtgcggcggcaaccaagcacgcgcgcgaatgtccagagagcgcgttctcggtcgccgccgccgcgcgcactgcagcggccaacaccgcaggtatgtctctcggcgccgacgaacgcgaccacctcgcgtccgtcggcgccttgcatgatgttgcatcccccgcttttggcaacattttgccggttgcgtttgcgaccgcggcagacgcatcaagcgccaccgtgatcgcagacgcagccatgcagcacagtgctgtgccctctgctgccgcccaatcccctcggcgtgcgcacgtcccccccgtgccgcgcgccaccacgacaccatccgcgctgcggattggtggcaaacgccgccgcctgaacgacgacggcgacaacgaaaacagcgacggccgcgacgccgacatcgagatgcgcgccgacgacaccgacgcaccagcgccgaccaaccccgcgaccagtgcggctgcaacgcccgcgcgcacagcaccagcaccaacggatgccgcgaccgcgcgccgccgccacacgcg

SEQ ID NO: 1193 - DNA, 485 bp, Strigamia maritima
  source 1..485: mol_type = unassigned DNA
ggagtgttcttttcggagacgccgcctactttagaggagagaatccccacgggcatcctcatttgatctgatccatcgagtatctgcgaatagtcggcgcactccttttgccatgatcccgggggtctcatggtaaaaaggtttgtggcacggcttagttgacgcccctcttccacgtcactcggcctgcatcgatcgactgctctctcctcttcctccctccctcctcttcacgctctcttcacgtgaccccttcccatcccgcccctcggcttttggcaaagatctgtgtgtcctccaaagcacccatctaccatttgctcgagttgcgattggtcgaagctgccacgccactcgtctactctgcctctctgaccccttcccccctctctccctctgccgccctcgcctctcgggtcccttcccatctccctcctcccatccacgtgctccctcctctcgtcacgtgatcgttgcggctcgac

SEQ ID NO: 1194 - DNA, 1328 bp, Strongylocentrotus purpuratus
  source 1..1328: mol_type = unassigned DNA
aaggctcaaaccaggctgccaaccaagctgccagcttaggcaccaaccaagctgccagtccaggctccaaccaggctgcccaccaatctgccagcttaggctccaaccaagctgcccacctagctgccagcttaggcaccaaccaagctgccagccgaggatccaaccaggctgcccacctagctgccagcttaggctccaaccaagccgccagcccaggctccaaccaggttgccacccgaaagtctgccagtttaggcaccaaccaagctgccagccgaggctccaaccaggctgccactcgaggctccaaccaggctttcacccgaagcattacccaggctgcccgtttaggcacaaaccaggctgccagccgaggctccaaccaagcaaccagcccaggttccaatcaagctgccagccgaggctccaagtaagctgccagccgaggctccaaccaggctgccactcgaggctccaaccaggctttcacccgaagcattacccaggctgcccgtttaggcacaaaccaagctgccagccgaggctccaaccaagcaaccagcccaggttccaatcaagctgccagccgaggctccaaccaagctgccagccgaggctccaaccaggctgcccaccaagctgccaacttaggctccaaccaagctgccagcccaggctccaaccaggttgccacccgaatctctgccagtttaggcaccaaccaagctgccagcctaggctccaaccaggctgccactcgaggctccaaccaggctttcacccgaagcatcacccaggctgcccttttaggcacaaatcaagctgccagccgaggctccaaccaagcaaccagcccaggttccaatgaagctaccagccgaggctccaaccaagctgtcagccgaggctccaaccaggctgcccaccaagctgccagcttaggtaccaaccaagctgccagcccaggctccaaccaggttgccacccgaaactctgccagtttaggcaccaaccaagctgccagccgaggctccaaccaggctgccactcgaggctccaaccaggctttcaccccaagcatcaaccaggctgcccgtttaggcacaaaccaagctgccagccgaggctccaaccaggcctccaaccaagctaccagccgaagctctgccagattaggcaccaaccaagctgccaccgttagaggcccagagcccaccaatcccataacgtgtgagatatgtgaagcttccttccacacctccgccggtctccgtcgccacacggccaggcttcatcgcaccactgctgaacacactgacgacagc

SEQ ID NO: 1195 - DNA, 232 bp, Trichinella spiralis
  source 1..232: mol_type = unassigned DNA
tttctggtatgaatcccaagcggattcgttacgaaatttgcataagtttttgaaaaaataggcatttggtcgagtgctcgcaccaccatttgtcgcgggtcgtcctgatattgcactacattcaggaacggcctattcccttcggggaattgtgttttaggaattggaatcggtttggttacgatcggtcgagtggttcgtgagatcgagtgacagccgggtggcagcgaca

SEQ ID NO: 1196 - DNA, 927 bp, Chelonia mydas
  source 1..927: mol_type = unassigned DNA
ggcagaaactgcacsttctagaagactcactgcctatcctgaggaagactaccgctttggagatggattctactgccgctgcttcaaaagaaaatcttcatgctgcttcggaggctccaggacagastgagaagatgatcgctccctcgccgattccacagaaaccttcaactgccgctcggaccgctgctgctccacggagcgcccatcggggaacagcctctaagagaccctcagcgcttccaggacatcgcagatgagcagcatcgattggaaaagcagcgcctccctgaagaaaacccgtggagatgctgctgcagggawatcttgcacctcgaggacggcctcccaggacatcgcagccaggacaaacatcatctcgcctgctcttcaggasaaggatgccmsaagaacttmtcccacctcctcmactgcccaggatcctsatgctggtcgtcgtcctgctgtgctggaagmkaccccaactggcgagacctcagaaaccacccagmwggacckcaacatctcactagatgcctgcccagccgaacctctccatgcwactctcccagagcaacsagaaccatccagmgaatccgctgatatgactgaagccmatccaacagagggagaaggaaaggagaatgactgcatctatctccagtatcccctccctacggacacgctcctctkccccttccgctatccgagggttccagtacattggcagtctcagcamacacctcaagagaatccatascaagcggatcaccttccggtgtgccctctscgacctgcctttcgagacgcagatgaaatgtaagtctcatcaagtcacctgcaaaggacatctcgaactggaagagtccaactttaccagtctatgttgccgccaccccatctctgctccgaaagcagaaacaccac

SEQ ID NO: 1197 - DNA, 840 bp, Phytophthora capsici
  source 1..840: mol_type = unassigned DNA
  misc_difference 125: note = a, c, t, g, unknown or other
  misc_difference 574: note = a, c, t, g, unknown or other
  misc_difference 588: note = a, c, t, g, unknown or other
  misc_difference 611: note = a, c, t, g, unknown or other
accgcccaagtctccaccgcagctgcgactgctgctgctcatcgagccgcagtagtcgcagctgtacaagcaccacctcctaccggacgcgccgtcgtggagcaccacgcgcgcgctgagccgcntcaagaccaagaattccaggctcgcgcgcgcgtggcgcttcaagatggcgacgcgaccagcaggagtggccgctctactgacggcggagacgaggccaagaccgaggacagcgacgcggacgcagccaagcgccaagccgctcaagcagcaccgagaccccatacccmggacaccgcgccgtacgacggccacagggactcggtgctggctgtgtacgcacacaacgcacctgcattcacctgcgcgttgtgtgtgtacacagcacgcaacttcgccgagctgaccaagcatcgccatgcagcgcatcgtcacacccgcttcgtggatcacttccacagcgggtgcacgtgtggcatcggcttccagtcgcgcgcggcagctacgcgacacgctcaagcctgtgcagacagcacacacgccaccgtagctgcctcgcgcgacccggcmnccastgcssccsgngccggmagcgasgaggaggaccncgcaccccccggtcctctsstcgcggcagcatctgcagctgcagcagccgcatcaagcgccactccagctgcagatactgccaccacgcagagcgccgtgcccatcgctactcctgggccccagtacgccccccacgtgctggagccacctccagagctccgagtttccggcaaacgccgmcgcctcaacacgccgatcgacctgcagccgctggacgtggacgcgctg

SEQ ID NO: 1198 - DNA, 377 bp, Phytophthora infestans
  source 1..377: mol_type = unassigned DNA
gctcggcctcgcggctgccttcccaggcgccgccgacttcgcgctctggcgcggcccacacgccgccgccgagcctccaagcgcgcccgttggcttccgcagacgcagggctcgcggcgacggccctcgccagcccccaagaccccccctacgatgtggcaccacccggcagggcggccggcaggctgcccgactcggtatcgccgggtgctacactctcagccgccacagctcgggccttggcggtccgccattggcccttggagctcgacagcgacagcagcgacgacgaggacgctcaagacccccacgccgccgccccaggaccccccgcagacgtcgcgagtgtgcttgccccacccggcaaggcaggcagc

SEQ ID NO: 1199 - DNA, 166 bp, Phytophthora ramorum
  source 1..166: mol_type = unassigned DNA
tcaagccccgccgccaagcccagctgcggctgttgccgcccctccagcagcagcagtcgcagctgaacctacagcccctcctgctgatcgcgccgccgtggagccccgcgcgcgcgccgagccgccccaagaacaagcacccccagctagcgcgcgcgtggagccc

SEQ ID NO: 1200 - DNA, 867 bp, Pythium ultimum
  source 1..867: mol_type = unassigned DNA
tgactggtgtttgatcacgatcaatgaggtgattaacatgagccggagcaggccccttacacgctggtgctgtaatggttcaggaatgctcttatgagtaactccacagtataatttttgttagcgggggtgagcgcgtgcgccgcccccacctttctcttttcgtttgtatttggttcctctggagcgacttccgtggcttttgtcgcgcgctatcgcgcccggcatgaggatcgtcgctcctgacgccatgtgcgccagtatatcggagccccgtgctccgcttgggtgtgtgttccgccacgacgccacgcgatttgcgtgcacggcatgcgctggcgacttccgctcagtgcgcgaactcgcggtgcatcgtcgacgtgcgcaccggtctctggccttccaggactggtatgagtcgtcgtgcgcgtgcagagcgctcttcaccgcccgtctcgacgcgttcgttcattcgagccgttgcgaccacaatgcgaaccaatcagcgaacgccgtcccctcgtccgccgcctcgacaacgagagcggacgcggatgcgacggccccccctcccgctatctctcttccgcggacgggcttcccccgcccctgtcctagttgcgccgctctccttctggatgcggcaacttggacgacccacgtgcacgcgtgcgctgccgccagtgcgacggcgttgatccagcgtcatctacacgccgttcctcccgtatcgacagcaaccgatctcaacggcgatgatagccaacctccagacccgcgtgccaacatccaacagcttccagccatccattcgacaacgacaacgacaacgacaacgacgacgacccgctgctcgacgacgtgctc

SEQ ID NO: 1201 - DNA, 56 bp, Phytophthora infestans
  source 1..56: mol_type = unassigned DNA
gtacggccgaatccctggcctctcagcctgtacgcggggctatacttggtctaagt

SEQ ID NO: 1202 - DNA, 568 bp, Phytophthora ramorum
  source 1..568: mol_type = unassigned DNA
tgcgcggcagaccaagacgcgcagccaacaacagaccgtgcagcgtgcgggtggaaagcgccgccgcctgaacgctggtgacgatgaagaccagcgagagctggccgagctcctgctcgtggacgaggacaaggctggcgccgaacaccccgcgctcaggctgcccacggccagcgctcatccggcctccgtcctctccgtgtacgcgcacgctgcaactcgcttcgactgcacgctgtgcacgtacacggctgccagcctcgcttcgctcaagcgccaccgctcgtctcggcaccgacgcacggccttcctcgacaagttcttggcgggctgcgcgtgcggcacgcccttcgcatcgaggttggccgcagccagacacgcgcaagcgtgcgccaacctctgcaccacctcggcgacgacttcgacggcagcaaaggcatcaagccccactgctgccggaggcagacccaccgtccgtgcagtggtcaccgccgcgcccgacctgccccgccagtatccctcggagctcgttgcgtcccccccgcagccgagctccaccaacgttgca

SEQ ID NO: 1203 - DNA, 378 bp, Phytophthora infestans
  source 1..378: mol_type = unassigned DNA
agctcggcctcgcggctgccttcccaggcgccgccgacttcgcgctctggcgcggcccacacgccgccgccgagcctccaagcgcgcccgttggctttcgcagacgcagggctcgcggcgacggccctcgccagcccccaagaccccccctacgatgtggcaccacccggcagggcggccggcaggctgcccgactcggtatcgccgggtgctacactctcagccgctacagctcgggccttggcggtccgctattggcccttggagctcgacggcgacagcagcgacgacgaggacgctcaagacccccacgccgccgccccagaacccccagaagacgtcgcgagtgtgcttgccccacccggcagggcaggcagc

SEQ ID NO: 1204 - DNA, 190 bp, Phytophthora ramorum
  source 1..190: mol_type = unassigned DNA
ccaggaatcacccccgccgcccccaagcgctccgccgccgagcccagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgtggagccc

SEQ ID NO: 1205 - DNA, 130 bp, Phytophthora infestans
  source 1..130: mol_type = unassigned DNA
ctcaagcctagcagcggctaccgcagctactccagctccggtagctgctactgctacaactgctcgcgctgctgctcgcgtcgccgtggagcaccacgcgcacgctgaaccgaaccaagaacatctaccg

SEQ ID NO: 1206 - DNA, 190 bp, Phytophthora ramorum
  source 1..190: mol_type = unassigned DNA
ccaggcatcacccccgccgcccccaagcgctccgccgccgagcgcagctgcggctgctgccgccccactggtgacggcagtcgcagctgcccctgccacctctcctgttggccgcgccgccgtggagccccgcgcgcgcgccgagccgccccaagaacaagcacccccagctagcgcgcgcgcggagccc

SEQ ID NO: 1207 - DNA, 1193 bp, Ciona intestinalis
  source 1..1193: mol_type = unassigned DNA
atcaacccactactacaccctctacaaagaacccactacagcaagatcttggcgaccaactacacctgcagcctcccgtcgactcttcaccacctgcgcacctccctccgactccaagcggcagacagtggcaccaccagcactccaagggtccacagccagaagagtgcaccccccactgctaggaagagctaggccattgcccgctgtgggccttgtgctggctgtctgccgctgattggcacgttagggagtgtgcgctgagcacgatagggaggctgctgaagccgaagaacccgcgccggggactttaggactttaactaaaatctgtaacactaaaattggaatactggattactattggattactactggacaataacctgatctacaacaaccaattggattacagaaccaaattacaatctcaactacaaacaaaaagtgagtccccggccgggtttctatattacccaattactgtttttacaattttaaaattttatagtattttactaatttttccgccccgctagcacttaaattggcaccccccccccccstccaaaaaaaaatagataaccctccaccacctaaaccccggtcaccccctcagaactaattggaacccggatcttttccctctatcaaatttccggttcagtttggcttaattacctaaaacccgtctttattttatccctttattgccccttaaaccaaattattcaaattgaaatccggccaaattgccttgctgaaccaccatttttgtttttcttataaaagtaaatttttcaacaacccaaaatcataaaattaaaactgttatctgattagtctaaattctgttattgacaaaaacctccataccaaccttaatcttatcattatcttcacccagactgctcaatctagttcttttttcaatcaataaggaggtgttttctttggtctgttgttttatagtttaccgttataatagtctgttgtcctatagttttccgtggtgtatttctggtctactatagttggtgcctctaaaacattattataccgaagagtgctagcgatttctattattaactcacccaccagtactgctgtgcatccacgcagcaccacgcctgccatcacgtacagtgcgcttgctgccttgtgttttgttttgcagacaccactggacgatag

SEQ ID NO: 1208 - DNA, 360 bp, Schistosoma mansoni
  source 1..360: mol_type = unassigned DNA
  misc_difference 137: note = a, c, t, g, unknown or other
atctcacgttttaatttatttttgaactactgcagtctgagtgcttctaacgacccgaaggctcagaaactacccacttcttgaactgctactttttgctgtttatccacaacaacagttgtgattctattctccanatattccttgtgcttttgtcaacattattctataccaactgtaccacctacttcttcatctcacgttttaattctggtcttattttctcatcattagtcacggagagggcctatgaacggtccgtgacgcgaaattctatccgcgatttcgacctctcctgctagtggtccccgaagtacggttcctctggcctgtcagttgtgttaaaactatataataacg

SEQ ID NO: 1209 - DNA, 332 bp, Bombus terrestris
  source 1..332: mol_type = unassigned DNA
tcaatagttactcgggggcaggcgggatattggtcttgccttgcccaagtcacactcctacctcctcgtggtaccgccggtaacacgcgcacgtccacatcagcgaggggcgtactcccccggatgtggcggcgcgtggctaaacggagtgtggcgacgaaggagcgaaagactaacaactataacggtcttccgtaacggctacttggagccgtgaataatggagcctatattaaaccctggaactcgttccttcgttctgttgacgactggaacggcaaaggacatgatttggataacaattggaaacttaatatcgaattcacaattaa

SEQ ID NO: 1210 - DNA, 422 bp, Crocodylus porosus
  source 1..422: mol_type = unassigned DNA
aggcgtctcctttaagggcaacggtctggttacgcggtcgcagcagkcttgckccaggtacctccwcgtggttcccgccgggtgccgmagmcccaggsctgtcggtagctcgatcctggcacagtamggccaggggagtkcttccttgctgcwggtgccccacaagcgtktggcagsmcmcctgcttcwtcgcaamaatmasagkgtsmtcagtagtcggccccgccgctagccaaaactgttcgccacscagttacagatggtgcctgtgctgacckgkkgccccgtgggctcggwggtgcaggggwggccggcccatggctgggccagacstgggccktggagcccgctcccamcccagagttccccctcaamgccgccaggkcagmamcakccggggagkgmcacggccccggccgtga

SEQ ID NO: 1211 - DNA, 149 bp, Drosophila willistoni
  source 1..149: mol_type = unassigned DNA
gaagctgggtcggatgagcgcagaaggggtgttctttggaacactgtaattcataagtcgtaagtctgatcaagtcgactcgaaacctcctcgtggtgtttcctgggtgctgttgagttcctagtctctaggttcttttcagtagctaa

SEQ ID NO: 1212 - DNA, 290 bp, Gavialis gangeticus
  source 1..290: mol_type = unassigned DNA
aggcatctccttkaagggtaatggtctggttacatggtcatagcaggtttgtgtcaggtacctcccagtggttcccgccgggtgscamagccccagggctgtcggtagctcgatcctggtacagtacggccaagggagttcttccttgctgtcgggtgcctcgcaagcacktggcagccccaatcgcttcattgcgaaaaacacaaacgtcctaaggggatgatcagctagtcagttctgccgctagccaaaactgtttgccacccagttacagatagcgtctgtgctga

SEQ ID NO: 1213 - DNA, 247 bp, Ixodes scapularis
  source 1..247: mol_type = unassigned DNA
gttccaaaggaaggcactcctttggttcgtgatgagatgttcatggtgcttgcctagctggagaaatccgactcacacctgcacgtggtccctgccgcctgccagtatgccgaggaaacgggtgcaacttaatccgtggatactggtagcaacgtgagcaacggtacggtccttcgcggaccaccctgggcgttcgggttgccagcccgttcgcccgaaatatcttggccctgaaactaaaagaaaa

SEQ ID NO: 1214 - DNA, 473 bp, Mnemiopsis leidyi
  source 1..473: mol_type = unassigned DNA
tgggggccccttggacttgctccctggggcaggacaccagtgaaaggagatcctcaagacaggacagagagacaggcacaccaacccttcgaacctgaggagacacccagatctggttaccccattcctgtaaccatggttgctctccgtgcgctgttaaggaaacccagcctagtaccctcggggaaaggttgcgtagtacttagcagtgtgcggatcaaacctctaccggtctctctagcgatgaaagtttctccgactggaacttgagggactggctagcccagctagcctgtagagcaatgcgtatacgatgccttggcgacaatggcgaccgctgcttagcagacggaggttagtgaaagggcgacttgctgttcatagtcacgtgagtcgtctagaaactgcaccgatgctgccctctgttccaggagaaggacagtggaggactaaatcgtagcgcgagcggtgtt

SEQ ID NO: 1215 - DNA, 1124 bp, Petromyzon marinus
  source 1..1124: mol_type = unassigned DNA
ctattaatgggatgaagaagggggacacgagtttgtgtgtgcatccagtttccatggtgcatgcaggagtggtggtttaaatggcgagactctacagggcttccatggctacacgggatgcaaggcatcagacattttggcacaggcaatccttttggtctctaccgcaatcatgtcttagacctcagtagcgaccactacaaccacagtggtgactgctgttgagtgaaggacgactgagcgctggataacaactttcttgcgtggcccaacatcgaagcaaccacttcggagctggcacaaggcaagagggcagcccaaggtgtgaatcatctcaacttcactgcaggaagaaatgctgtgcaaggatgagtgtgaacgacaccaacgggattgttgctgaccaggaggtgccaaccaaatttgaatggattgactttgggcctggtttctcctgcgtgtattgcacggaaaaacaagtggctacacgtgtggccgtcgtgtcctggggtttcgcaacacaactccacaagatcgacaactatgaggatgacaatgtacttaaagaacaaagagactgacgccaaaggggatttaaaccgccaaatcgtacattgggtctcactacaatttttttacgtgtatttattttcctaagtgtctgtacttgccattcttcgctgctttttctgcattaattgcatatcgtatgcaaataagcgaattaaccaccaccgtgcaactatatgcagatgttacagctgagccctctatcataccggtgtactaatctggtatggtgttggcatgctatgcttgcgtaacgacctttgctgattggttcagtcggctgatggtgggttcaggcgaaacatttgtatattggtttaatcaaaccgaaacactaaaattttgaacacagttttccattacaccagttgtattgctagaagtgcaaatcgaaggagtcaattttgaccgacgattagctgccgatgtgcggtgaaaaagctgatcacaatagcatacacttgggccgacaaccccgtgtgctataaacgtaagtcgcgaattataaagaaaacaaaccggacggactactcggtgacgaactaacatcgctc

SEQ ID NO: 1216 - DNA, 1090 bp, Schmidtea mediterranea
  source 1..1090: mol_type = unassigned DNA
cagtgctattcgaatgtcaatgtgaagaaattcaactaagctctggttaacggcgggagtaactatgactctcttaaggaattaagaatttacctgccktaktaaaartgaaatcmgttgttcatwgcaagtggtattgtacaccttcccgcggtgctagtcgtttaaaactaagttacaaaccacgaggggcgtcctgacggactgsaaaagcattgagrgtcmtgaagagaggctcttattgtacgaatctcttcaacgatcgaagtctggaccgatatgagaactaatacattagttgacaggtgaaaaatactgttgattacttagttctcagtcatgtggtatattgccagtcaattactacatwaatattagtgtggctctcaaaggaacacgattgrtcggcagtccaatgcgcgactggcgggcttgttgtttgcatttgttaccggctacttgaaaaggttatatatagcagacgcttaaagcgcgactgtaatttacatytcattgcccagtatttgtcttttgtcagatttagcaaaatttcatattttgttaattaccttaactggttaaacgatcccataattgcttgcaattattataaagtaattcaggtaaaaattacatatctggctgatcctgccagtagtcattttacttccgccgcgctataaaacagtttaaaaactgaataggaatcaaaaagaacatggcaagcgactatatgtaactgggcattcaacattccctattacatatggtggtgcctggggtctgttttatataatgggtacccgggaagtggatctgtatcaccagtcatggtgccatatctttkgataaagatacagtttaaaactgcgatgatactaatagagatcctcttagaccttcgtaaagaagtggggattgatgacattagcattggaagaattaaatctccaaggaaatggagtaacttcaatgaagtcccacaaccccgttgaagggctgggttcgagtatcgagagaaaactctaaattctcttcggttmtgtccaacggaggggacattactgtaaaatatcctctaaaaacaact

SEQ ID NO: 1217 - DNA, 743 bp, Strongylocentrotus purpuratus
  source 1..743: mol_type = unassigned DNA
tctcgcgacgcgttcttctgcctgatgaagtcacgtcaggtaatagacttagaaggttgatgagcgttcctctcctggaccgggggtgaggatgtgttctactgaatcatcgttccggttgtgaggtccgctgcaaataggccttggggtggtctacctccgggtcgctactccttttgagctagtcgatccaggtgagagtcggggaagcccacttaggtgggccagctaagcagatcacccccccagcacgacagtgcgctgtaatatagcctgttgagagtgcacccatttatactgttataaaagtataaatggttcttagctaacctatccaatgatttttattgttatgtataatactgaccactttagtctagtgtcatgtaaggatccgagacaatagcctatgtctctagtctagcaataacacaagagggataatccacctccctactccagccaccacctttacctttcttatcttccatatagatgccaaccagacgggtcgatgggcagtgagaaacaagaatggggataatttggaatttgacattctttcctaaagcagacctgaagggttaagagtcacaagcggagtccggactgtctttataaacagacaatattttcttattttaccacctatatggggatatttcccaactcgtaatatagggcccactgtcaagtggctggtataagttaccctgtgggtaacaaataaattcaaacaaaga

SEQ ID NO: 1218 - DNA, 1496 bp, Salmo salar
  source 1..1496: mol_type = unassigned DNA
aatctttaaccccggactcttggggttcttacgactctgtatgaggaacagtcgaagagagggcgctaccaatccaagtatatgtcccaagagggctgggacagggtggaagagtgcacctcgcgatctggggcagggaaggaatggagagaagtcgaagaaggcttgtagagaaggggctctcctagatcctaacctgtatgacgcccgtaaaacggtgaccccagtagcgaataaaggaggcaggtgacaatagagggcagggccgacttcccaggtttacattgttgtacttgtcaacataaagaggtgtctcaatagtttgaatcaacaagggagaggaataccgacctgctcccttggggcgggggtactggtcttagcccggttccccgcaagtttcctttgcctgggatgtgcctgactggctccatcccctttccccattaggcacggctagatgacgcaccgatgggcgggtgtgtaggtcgctaccgaaggggactgggggtgtccggtgaaccaggacttcccaaaatggtctcacatttttaagcggcttgagtatcgcccagtatcctcgcgcggcactgggaacccagtcaaccgctctgtgccccggcgcaggcgggggtttaatgtctccccggcttcaccggcgcttcggcgacgacgcagaggagcacccggaggcccccatgaacttaaaccaacctatcttgaaatatggcctctcgttcgggtgaagggcaggtgggaagagagggctgcctcacgataaacacctagtcaatagccagtcgggaaaaatgtggaatgttaggacagggaggtaagggaggcggctttttcgtaaggctccttcaacccctacctgtagtccacctattgcaggtgttgacaacatgcaagatgacctgcctcgttacgggtcgcgtatcattgctacaggtcgtgtgccgcttctaagaggatagtaaggagaggttatagggaggtcctgttagggcttcctcaacccctctctatgcgattccttacaggagtggatcgagaagtcccggacgtaatacaccctggaggtaagggagtggccttctagtagggctgcttcaacccctctgatgggagtgtaccgggaacctcgacttgtaagcacaggttagtatgggagcagaagggggagccgtaatgggcttctctttcacctgcttacataatacctgtggtgcatgtatctaggtcttggcgggagagtactgagagacaaggttgagaccccaagattgggtctccctagcctctatagctgcgactcttagcggggatatggagtaacatgtaccaagggagtgaataataaaggaattgacggggtacaagtgactgttggcccgaatcctagccacttgatgaccagggatatattacagactgagagcgaatctagagacgtgagaataaagtgagaattggttgagcgaatacagaggaag

SEQ ID NO: 1219 - DNA, 173 bp, Tribolium castaneum
  source 1..173: mol_type = unassigned DNA
agtcatagagccagaacctcctcgtggtcccgctgggcacagggattaatttttctgtggcaaatttgactggcttcagagagcgtttttcgaagtggwctgtgtgactgcgttccccccttagttgctatwtccgctkmgattaacatctcacctcgacgtwtaagatcatt

SEQ ID NO: 1220 - DNA, 305 bp, Tinamus guttatus
  source 1..305: mol_type = unassigned DNA
ctggggaccgtggttacaacccgggcttagctgcagagacagtacctccccgtggttcccgccggaccccgtaacatcgggtgactgaatctgtctctgccccgggagtagttcctccttgccctattgaccagcggtcgccggctgctcaatagtattctaggcgtgaaatatagcgatagtcctagtggttgtcttactgggccatagccccttgcttcaggggtcattcgcgaagtctctcaggagaactgggggtggtgttcttctgggtatagctaaaccccctagactgtgtccgatcc

SEQ ID NO: 1221 - DNA, 131 bp, Trichinella spiralis
  source 1..131: mol_type = unassigned DNA
ctcctgactaacctgatttcgtccgtgcggcggcgttttcttttcgctctccgctcgtcgaaatttgctgtagttgattcgcttttctttgcgttttcttctactttcgcagttttttctgcattgccacg

SEQ ID NO: 1222 - DNA, 481 bp, Tetranychus urticae
  source 1..481: mol_type = unassigned DNA
ctctcttattttaacatattcgatgtactcgtacattgaatatgcttttattttttttcaaagttttttgggtgcatacccctggaaaattctgagatgtataaatctcccatcagctttggctgaaacgttggctaagttttgtaggttgtttgccccctactacttagtcgcaaatggtatttgctaacagttgttaaattgttacatttacaagtcctatccagtgcctcctcgtggcgctacccggtaacacttagagtaatctgagtggctaaactggaagggcggaaaatgcaaacaggcggttggtagatgcttcggcattttgccaaaaatccacggctttttagcccaacaacatcagggtgatggacccgccagcttgtggtcaggatcccatccatgaataaagcatggctctgcttctggtgcatcctcaacgggatcggcttcggctggatgtaagtcttgcggaggc

SEQ ID NO: 1223 - DNA, 157 bp, Drosophila willistoni
  source 1..157: mol_type = unassigned DNA
gaagctgggaagctgggtcggatgagcgcagaaggggtgttcttcggagcactgtaattcataagtcgtaagtctgatcaagtcgactcggaacctcttcgtggtgtttcctgggtgctgttgagttcctagtctctaggttctctccagtagctaa

SEQ ID NO: 1224 - DNA, 153 bp, Petromyzon marinus
  source 1..153: mol_type = unassigned DNA
cggtgcgttcccttgggtaaggaacacgagtcttagtggccttgacctccacgtggtcccgctggtaacatcatctcttgatgatggctaacaaggctaatgcacccattccatctcctatctcgcatggaggccgctatgcgtgattactag

SEQ ID NO: 1225 - DNA, 364 bp, Schmidtea mediterranea
  source 1..364: mol_type = unassigned DNA
agtcatagggtgaactgcaattctgacacgatgaccgagctgtgtcagtttgcagctagtcgctaaagactcgatcagtccgccaagtgaggtggccgggtatctgcagcactagagccactggtatcaagagcagagatacgcgagtggaagttgagtacgactaccttcacggggtcctcctgataaccacagtggactgtgggaactaaatgtgtgctcagcgttccctactttctcgtagggtaaagggtatgataacccagagaatatcccatgggagatatccatggaaaaagcaccacgttagacaatccgatggtctaactcggctccgaggggctaactatcccaaagggcttaa

SEQ ID NO: 1226 - DNA, 661 bp, Tribolium castaneum
  source 1..661: mol_type = unassigned DNA
tggaagaccccgcccatgaggcttggagagtgtgatcctgatcacacttgaaaagttatgctgagtacgtcgtgagagtcggtaactgtcccaggatggtctgggataggctaaacctcagcaggggaaagttgtaggggcctgccacccctacacttttatagatatggcattcgatacctcaaatagagcctcggacttggaggagcatggttcccctcctcctcgtactagacctggaaccaacggtcttgacaaccccattggacctacgggagcggaccatgctcatggacatggattccgaagacgaagcgggggaacacggaccccccgccgataatgctcacttaacgtcaggcgaacccatcgaaatcatcttgatgttaccctttcaaagcaggtcatgcggcatatgtctcaatgccggaaagggtggctcccgggcgtaacggacatctatcgctgatggaasctagctcgctcttgaagaacggcggacggggacttggaatcgtggtgtggttctgatgtaagtcctgaaattatggcgtgatggcccgcccgcccgaccggagggacttagaacccccttccgcgagggtcctgtctgtaggtccwccatctccgtaaaacgagttggaggaaaccgcagacgggg

SEQ ID NO: 1227 - DNA, 26 bp, Megachile rotundata
  source 1..26: mol_type = unassigned DNA
tctagttagcaagcggccccctctaa

SEQ ID NO: 1228 - DNA, 1095 bp, Apis mellifera
  source 1..1095: mol_type = unassigned DNA
tggtaatcaaatgcctcgctattttagtagcggtagcgctccgcccgcgcaggaaccattgacgccgccgtagtgtgggtgattttatatccaaccaatcacgtcaactacgatcatttgtaatcaccgacggtacttggtaggggtaccacatgggcattcttgctcattccacaacgccgcctccatcatggcaacaatttaaaatatatataaattcttaaggtttgaccgtattcatatatatatatatatatttaatattacaaccataaatcttatatcgagccttctatttggtctcaaaagcaatacgttgtcagatcttgtagaacatcaggagtgagcggtgcgctgtggtatccgtgctttgtgccgcggcgacaaaccaatacgctgctgcctgtcgcaaagcaatacgctgctgattctcggatgcgggtgtcgacggtcacgcaaagcgatacgctggtggggtttcaaaacaatacggcgctggtgctaaaaagcattatgccgctaacggctggattgtcgatcgccgctgcgggggctagtggcgcacccagagaggtgcgacgcgcaagcattggttctgtgcgaagcggagttcttgagagtaatggttgctgggggcacaaagcgcaacatatagcctcttatgcctcaagtcgtagttcgtacctccacgtggtcccgctggaatgcctatcgactcctccccggaggatcatagagttcgaaaccggctacggcgaggcaagggcggtgaggtgcacaccgatggggagcagcgaccccacctacccttagctaagagagcaggcgatccgccaactgtcagcacgaaataaactaatcatatgtatacgagggagaatttacaacgggtaccttgtgcccgaaccgcctgtaggtatcacctacaggtgttaaaatgaatctgatagctggcggatcgtcgaccctctttgatggctctgcgccaacgactggaaagaataggaacggaagtctaatggaaggaaagtgtcgggagcactataaattcccaaagaagaaaagaaaagaaaaaaaataaaaaacccaaattaa

SEQ ID NO: 1229 - DNA, 655 bp, unidentified
  source 1..655: mol_type = unassigned DNA; note = Description of Unknown:Nasonia vitripennis sequence
gactagactatgggttcagtcagtcccaaatagccgatcctggcgcgtccggcagtaatgccacgtatgagtcggttacccatctctaaacgcgtagaggtggggagctaaaggccaggcggtttacccgacgtcgaatttctccaggtctgtgtcagtcgacggaataaaggtactacaacatctactatctatcgggatcggaagacgccttacagcgttttccgatttttgctctttgagcatttttcttcaaattgcgataaccgacccgatcacgcggggctttgacaaagcaatgcgtggtcggtaagatggttgcaatcttttccacctcgtttcttttacggaacgaaagcaatgcgtgtggggaacgttaaaaactcccttcatgcatcccaggatttatcctgcttactgcaaagcaatgcgtgtggagcgactttaccacgagtcgctccaccgcaaagcaatgcgtatcgcgcaaaagcaatgcgtgtgggggacttgtcaaagatcccccgccgcaaagcaatgcgtgtcggcaccacgtagagcaaagcgtgtaggcagactttgtcaaaagtagttctgccgcaaagcaatgcgtgtggagatcttcgccggtgaaagcaatacgtgtgggcgaacttag

SEQ ID NO: 1230 - DNA, 286 bp, Ciona intestinalis
  source 1..286: mol_type = unassigned DNA
cgacggtgaaccaccttgtcgcggtgtaagagctttagtgtctcgaacaagaaatagcttgtgtgctgtccttctgggcggtgcacatacttcttaacctcccgaggccatgccggcgggggctttagcccccggcaggttttaccatgccggacgggttcgagaggtagaggccaaactaagagttcaccagcagacttcgcacgcggctggccactggccgaagtttaaacaacagggccgcatcttcccaaactcaatatatggtgttaagtgaaccgtgccg

SEQ ID NO: 1231 - DNA, 189 bp, Nasonia giraulti
  source 1..189: mol_type = unassigned DNA
cgggttcccccgacttcggcttgccgtggtctggggctcactgctttttgtggagtcatggttacatggtgaccctggttcctcgcacccccgctggaaactatctggggaggccatgattgggtaacgataaaggtcctggtcgtgtcctcctgagataggctgaatgggtcactaagtggcacctaa

SEQ ID NO: 1232 - DNA, 165 bp, Lepidurus arcticus
  source 1..165: mol_type = unassigned DNA
ggggtagcaattgatcgattcccgcttcctcgtggcgctaccctgggtaatactatgaggaattgatcacaccgtagcgaacgtcatcagtcacagctgcacgaatccagatagaaatataacagacgagtaattcttttaaaagctcgtcagtaatcttcccag

SEQ ID NO: 1233 - DNA, 183 bp, Lepidurus couesii
  source 1..183: mol_type = unassigned DNA
tttggggtagcaattgatcgattcccgcctcctcgtggcgctaccccgggatagcctcaaagaaatttgacggtaaagcaaagaggaattgatcacccaaggcagtacatcggccttcctgcaggagctctgataaagatattagtgagttattctgttgaagctcgctatttcattcccctg

SEQ ID NO: 1234 - DNA, 192 bp, Lepidurus couesii
  source 1..192: mol_type = unassigned DNA
ttttggggtagcaattgatcgattcccgcctcctcgtggcgctaccctgggataacctcaaagaaatttgacggtaaagctaagaggaattgatcacaccgtgacgaatatcatcagtcacagctgcacgaatccagatagatatataacaggcgagtaattcttttcgaagctcgtcagtaatcttcccag

SEQ ID NO: 1235 - DNA, 184 bp, Nematostella vectensis
  source 1..184: mol_type = unassigned DNA
ggttggggccttctcgtggcggagtcgtgagtaaggggtataggggtaagggacaccacggaccgagaacggttaccgctcaaggcgagtggtggaaggcataaaatcgtaacgccgccctccgacctgctcctgaaactaatgccaaccaactgactgtggggctaacctccccagagtcagg

SEQ ID NO: 1236 - DNA, 340 bp, Schistosoma mansoni
  source 1..340: mol_type = unassigned DNA
atgttttaatttatttttgaactactactgtctgagtgcttcttacaacctgaaggctcagaaactacccactttttgctgtttatccacaacaacagttgtgaatctattctccaaatattccttgtgcttttgtcaacattattctataccaactgtaccacctacttcttcatctcacgttttaattctggtctaattttctcatcattagtcacggagagggcctatgaacggtccgtgacgcgaaattcaatccacgaattcgtcctcttctgctagtggtccccgaaatacggttcctctggcctgtcagttgtgttaaaactatataataacg

SEQ ID NO: 1237 - DNA, 176 bp, Triops cancriformis
  source 1..176: mol_type = unassigned DNA
tttttggtctggcatttgatcgtttccgcctcctcgtggcgccagactgggtaagctgatttatcagtgagctaagagaaacgatcaccgcaggagtccatctacctgcgctgcacgtgatttcattgtgcacttggcgagttatcccttgtggagctcgctcgttagcttttgag

SEQ ID NO: 1238 - DNA, 124 bp, Drosophila ananassae
  source 1..124: mol_type = unassigned DNA
agaatatggatttgattgtgcagagggggtgctataccgtaactcgtaagccatgcaatcagatcaagtcgactcaaaacctcctcgtggtattctctgggtgccagtatttactggtagctga

SEQ ID NO: 1239 - DNA, 285 bp, Drosophila melanogaster
  source 1..285: mol_type = unassigned DNA
ttggggatcatggggtatttgagagcagagggggagtattcttctgtaattcgtaagtcatatcatatgatgtgcggaaggggaattttactctgtaactcacaagtctctcctttactcaagtcgactcaaaacctcctcgtggtggtcccggtaatgctaaactcgtttagcagctaatttgagcggaaaaacttttccgatgggctggttccccagaggaaatttattcatattggaactacaagcacaaataacgagcctcggatacctttacacaatctg

SEQ ID NO: 1240 - DNA, 120 bp, Drosophila persimilis
  source 1..120: mol_type = unassigned DNA
aagatatggatctgaataatagcgtagaaggggagtcattccgtaattcgtaaatcgtaaaaatcagatcaagttgattcaagacctcctcgtggtatcttctggatgctattagactga

SEQ ID NO: 1241 - DNA, 128 bp, Drosophila pseudoobscura
  source 1..128: mol_type = unassigned DNA
caattggaaagatatgggtctgaataatagcgtagaaggggagtcattccgtaattcgtaaatcgtaaaaatcagatcaagttgattcaagacctcctcgtggtatcttctggatgctattagactga

SEQ ID NO: 1242 - DNA, 177 bp, Drosophila sechellia
  source 1..177: mol_type = unassigned DNA
gggatcaggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaaacttgtttagcagctaa

SEQ ID NO: 1243 - DNA, 160 bp, Drosophila simulans
  source 1..160: mol_type = unassigned DNA
gggatctggggtaattgcgagcagagggggagtatttttctgtaattcgtaagtcatatcatatggtgtgcggaaggggaattttactctgtaactcacaagtctctcctttactcaagtcgactcaaaacctcctcgtggtggtccccggtaatgctaa

SEQ ID NO: 1244 - DNA, 135 bp, Drosophila sp.
  source 1..135: mol_type = unassigned DNA
gggaacatggggtaaaggtgagtagagggggagtattttttatactctgcaactcataagtcttgcctttactcaagtcgactcaaaacctcctcgtggtgtttcccggtaatgttaaacttgtttagcagctaa

SEQ ID NO: 1245 - DNA, 334 bp, Kalotermes flavicollis
  source 1..334: mol_type = unassigned DNA
gagaggtcactgttgctgatcagctggacacctagctgactgcgtgcatgcgtgcacgccgcgcgccgcctcctcgtggtaccgctggtaacgcagggtcactgagactacctgcggctaaaggcgcgcgcgagggattgtaagtccaccacctccacgtggttccccgcgggcaacggcatagttcatctgccggccaagcgtgccgttccctcgatcctcctctgattagggataggaggggggcggtggctcccgccgacgacctggcaaacaccttggacacgctaagataataggccgtcctccgggccggccgaatcataagcacaca

SEQ ID NO: 1246 - DNA, 1138 bp, Reticulitermes lucifugus
  source 1..1138: mol_type = unassigned DNA
ctcactgctgtcatgccattgttaatgcgttgggtgatggcgggtgatgggagacgagttacagcagagctggcttcacggggggggctgtagttgcccgaaccagtctgcttctgagtgcctccacgtggcctcgctggaaacgtcggagctgcttacggctaacccgtagacaactccggcggccaaactcagaaaacggccttactaccagggtcatccctcgcggcggcgctaagaccttactgtatgtactacggactacagttgagtagcgcgggagagcacttgatgtgagggtagcaacttgttgctacttcgactgtctccctgaagatttccgaaggggtgccgcaagtccatgggggcggtcctgctgtgggagttatcttgcacccgggaagccctcagtggataaatactccaaaatggcttagccacctcacgtggagagaggggaattaggggtttactcctaagggccgatgcctccaatcggatttccccgggcaacggctattatcagccggctaagttcggaccctcatctactgatgggatactctctctccccccgcctgcgtgattagttgggaatgcacgcgggcgggtgattctgacaagcccagcccaaaagttcttaccacgacgtacccgggggtgtcacccgaactaatatattttccgccgatcggttcgctgtggggggatgtcggggcctggtggccgggaaccgtcagccgctctttgagtgtcctgcgtaacccggaggcggtgacgtcgaagggctaggctagcacggtccagacccctgaacgcctggggagacgggcccaccacctgagtaggagtgggtcctttacctcatttgaggtgtctcctcgttcttgtagggggcgaaggacgaggaatgcatccgtccctccaggatgctggtggtttccgtctggtgggctcatgctgaaacgcgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtc

SEQ ID NO: 1247 - DNA, 1137 bp, Reticulitermes urbis
  source 1..1137: mol_type = unassigned DNA
cacactgctgtcatgccattgttaattcgttgggtgatggcgggtgatgggagacgagttacagcagagctggcttcacgggggggctgtagtggcccgaaccagtctgcttctgagtgcccccaagtggcctcgctggaaacgtcggagctgcttacggttaacccgtagacaactccggcggccaaactcagaaaacggccttactaccagggccatcccttgcggttgcgctaagaccttactgtatgtactacggactacagttgagtagcgcgggagagcactcgatgtgagggtagcaacttgttgcttcttcgactgtctccctgaagagttccgaagaggtgccgcaagtccatgggggcgacccggctgtgggagttatcctgcacccgggaagccctcagtggataaatactccaaaatggcttagccacctcacgtggagagaggggaattaggggtttactcctaagggccgatgcctccaatcggatttcccagggcaacggctattatcagccggctaagttcggaccctcatctaccgatgggatactctctctccccccgcctgcgtgattaattgggaatgcacgagggcgggtgattctgacaagcccagcccaaaagttcttaccacgacgtacccgggggtgtcacccgaactaatatattttccaccgatcggttcgctgtggggggatgtcggggcctggtggccaggaaccgtcagccgctctttgagtgtcctgcgtaacccggaggcggtgacgtcgaagggctaggctagcacggtccagacccctgaacgcctggggagacgggcccaccacctgtgtaggagtgggtcctttacctcatttgaggtgtctcctcggtctagtagggggcgaaggacgagggatgcatccgtccctccaggatgctggtggtttccgtctggtgggctcatgctgaaacccgcaggtgccgatttgtcgaagaggacatatggggtaacccatagaacctaggcaggagtaatcccttagctgggggggtcagctggtgggtcctgtcaatttatcctcccctccatgccagagccggtccgaggttagagacggactcattttctcctttttatatgtc

SEQ ID NO: 1248 - DNA, 1379 bp, Rhynchosciara americana
  source 1..1379: mol_type = unassigned DNA
cagaacgtggagaaacggaataactacccagatccgttggttaaccggtggcaaagttaatcaaggttgccataggcttaataaccctatggaaatgtttccacacacctccacgtggtgcctgccggaaattgttctagggtgaacaagctaagttgtgagaaacgggctccaccacaatatggagcctgccagggcgcgagactcaggactctccatgtacaaagtggttagttgcaaaaagagtgcgcctagcatgactgataatttttcactgaaataacgttgaactttatctgtgtcatgtgcacaacactatggtgtctgatcaagcaccatcagtggtggacctgctaatgtattagtagaacgtgtccaggcgataatgcacacacggcctccgggcccatcgctttttttgagattccctagaaacttcagtgtgtgcgacaactgtataacccataagggatggacaaaggttatactagggggtaaaaaccctaatcggctaatggcaaatgggatgtagaaatgccaaagattactcgcaccgaataatggtggccgaaaagcgggtaatcgaatgaaatggtaatgctgtagcggaaacatgatcacattctgtgacagtaaaccattagacctagggggaactatgattaacaagataccagcttacatggaagcaatgaaatgtaagtcacagtagtgataagtggtgaagagtcttgtaatcaccgtaactaggccaggttctggggatgccatgaacttagggggagtatggttagcagatctaccagctaacactattactgataatatgtaagccgcagtagcgctaagtggtgtacagatttgcaaccaccgtaactaagttctgtttcgatggactagggggaatcatgattaacaagataccaacttacatggaagttatgaaatgtaagtcacagtagtgataagtggtgaagagtcttgtaatcaccgtaactaggccagatgtagtcaaagcacatgtttagggggaacaaggttaacattggtaaaagaccaatgcaacctccgtaactaaacgtgaaggcacaaaactaaaagtccagtggatgacaggtgaggtcatcactggacccaaatgttttaagctcatcataacaacacggtgaaaaatccagcatttatttgcctgattgagtagcttccacactattccaaagccgaacctatctgggtttttcttgaaaggccgtatagggcatatgtcgagaaataagtccaaggtgaggtagtgtggccctgtacccaggggtaaggtactatacggtcgagtggctcagtaggcctaactagccactgagtcactataatgactagtt

SEQ ID NO: 1249 - DNA, 979 bp, Ciona sp.
  source 1..979: mol_type = unassigned DNA
ccaaaattacttccagcacctccacagcagacgaacgaagaaagaagacttacgaaataagaataagcagtttaaagacgaagcagacgaacaccactccaccaacgacgctctgcagctacaccaccaccatctcgccgcaacaagaagaattttccgctgctctccactctgctccaacaccacctctcctgctctgtggactgctgccttgctgctggaccaacctctacccgaaggaacccttcgaacccagcagcaaggtacgtgtcaccacctctccacagagccaaggccagagtggatagagcagcggcctctacaaccaagttctccactccgacgacaaaacacctgcctcgtggccagagtcctgccgaagaagaatcttcgaccccaacaccgtctcggcagggctccaagcaacgacatcagccacgagtgcccaccggagtggacgcggcgaacccgaggaccgctgtcgccaagaacaataacatcaccgcctgcagcagctaccaaacaaaggttagtctcctacctcacctacaaactcgtctgaatagacgcccccgcgtgggagctaaccttggtagctagctgcagtgccctgcgacagcggcctcgaagagctgcagagcgtcagcctgcttcgacctcgcttgttctcatttcaacctactccgtcctgtggaatcaaaagagccccactaacaattacattcataaaatctagcaagaacgaagagaagcgaccaacttttaatccataacttttagatctttttatttattactgtttttaagccctaagcatattgcctttttttagatcttataattataaaaatagattcaaagttaacaccaccaggccgctacagagcattttatttaatcaatttgttaccgacctcctgctgcttctttttactttctccagactactacccggatacaacccttggaaacgagagga

SEQ ID NO: 1250 - DNA, 418 bp, Bombyx mori
  source 1..418: mol_type = unassigned DNA
gctagctccctaaaatcctaccttacgtccgaggcgaacatctgtccacgtggggagcggaaacgcgtactatcgaaacttacgcggctaacaaggtaaaggtaacccattaatatggagacaagactaaaaagaaaattgagagggccgcttcccgggggcgatcgccggggcacacctggagctggcgctgggtgttccagcataggatccgtcagcggcggagagttgagcaggcgggctctcgccggggatttacaacccgaaaatgctacagccgccaacagaaatcacgatgtagaaagtaggagcaatagcccatgtgaaccttacagcccgagtaccggttcatacaacccctcggtacaatcatcaccatcatcctcgggtcatagaggctcaccaacgtcgactatgg

SEQ ID NO: 1251 - DNA, 17 bp, Anopheles gambiae
  source 1..17: mol_type = unassigned DNA
gaaggctaaccacaata

SEQ ID NO: 1252 - DNA, 539 bp, Bursaphelenchus xylophilus
  source 1..539: mol_type = unassigned DNA
gggatcctgggttcctactacctcgctccacctcctcgcgatggatcctggggaagtctccggactgagctaagagagcgttaaagtagagggtgacggcgtaagtacctccaagttgcggtggagcggaacatctactcttcggagagaggggaagctctatggcggcgttagaaaggttggactacggcaacgccagggagatggggaaggttcatcaggtgatactagttcgctactgtcattcgatgtatccggaaccatactcgccaagttgtgaactatgtgaaagtctggatccaatccaagaccacggggcgcaattaaaaggtgtgaagcagcttgctggtgatcaccacggtggtacctacaccggcgggggaacatctttaatgccgagatgaccgcgcgaataatagggagccggcaaaagccgagcgtaagtggaaaggatacagaaatttgctcaaaagtataccaacccgccacttataaaagaccgagaaaagggtaccactagagctcattataaaacatct

SEQ ID NO: 1253 - DNA, 919 bp, Heterodera glycines
  source 1..919: mol_type = unassigned DNA
tggcgatactcggaacctccggggagcctggtaggagttggcctacaggtcgcgaaagtccctaggtgctgcacgggttgcgctaatccgagggcgctgggttaccttcccatcggccaaaaacgtctgggccttcttagccgcgggtccagtatttctgttgagcctgacagttcttcccggatatggcgaaagattacagggcggtatttcgtgaaacctaaaaawggtcgggccgaatggcacggacagactcacttcggagtgagctcgggggcatccgtgtgttaccccgctgcaccacgccgaagctgtcatagcgagcccgaaggggaatggccatggagactccagcctcaccctgtaactcgaacctaagtccaggcccctttctggtgttggctcgcactggttaggaacacgacagtctcgtgtaatcccacacgcaccgaaagccctagccctcgtaggcgaaggctgcgttgctggtttcagaactgtgagcwagtggggttcggatggccgagtgtaccaacctgcttgctaacaggtagcatagagtaatatgctagtaagcagggcacgagaaagggccgtaaaggctccggctatgaaggaccttgcgaccacgcgtgtgtctcccacgtgcggattcttgaagccagagtcttgcactgcgcgcaggatggagcctgtgcaactcctccctcgctgatcgcaggagtggaggatcaccactctttttaccttgctagcttggggtaccaccttgagctggggccggccttgctagcttggggtacgaccctttgagctggggctggccttactagcttggcgcgccacccttggagctggggtggcgcaagatcacttgtatacggtctaaccaatacatttgaaaagcgatcaaagcgaa

SEQ ID NO: 1254 - DNA, 488 bp, Parhyale hawaiensis
  source 1..488: mol_type = unassigned DNA
ccgaccgccagcgggataactggcaaaccctgtctcgaccaccggcccgtgaatccatcggggcgtatgagtctgacacaggggggtgtttaaggtgaccctgttgcgaggaaatgcgcagcaaaagccggatgagccttagaacatcgaaggccaacgacaacctgccgaaagactggcgactaatccagtcaacctcctgtaggtcaccggctggtcatgctgaatctcagcttaaccaggcgtacgaacttacagttggagggtcgagcacccctgatggctgaaaaggaccatcaaagtcgaaggtagccaacgagaagaccaacggctgattcaggcggaagagtcaactcgttgaatgcgttcgacagcttggggtagatggaactcctaagccctgaaaggcagtccatcttcgcagacgctaaggtgccccgccgcctgagggttatcaggccccgccgcctgagggttaccaggcaacc

SEQ ID NO: 1255 - DNA, 791 bp, Bursaphelenchus xylophilus
  source 1..791: mol_type = unassigned DNA
gaggatcctgggttcctactaccctgctccatctcctcgcgatggatccttggggaagtctccggactgagctaagagagcgttaaagtagagggtggcggcgtagtgacttccaagttgcgatggggcggaacatctactcttctgagagagggaaagccctatggcggcggtagaaaggttgggctacggcaacacttgccatgatcagattcgatcaaaattagcctctggggctggcaaccctacaacggattgtaaactgaactatgctatgcaaaatgaaaataaaaaatgggggctttacaatctaaggtgttggcagatcacgaaaactgcccgtcgatgagggtgagataacatcctacggaacagcccctgctggaccaaaccaaatcatccacaaattggagggttttcttggtagtttcccttggcacgtcttgtttcataagccagaataaaaacgataccatacagacatgaggctgggtacctgccagccgcgacacggaaaaccggtaggtgcaaccggagacagctaggggaaagaaaatagtaaagtgtcgaaaacaaaacaggtagcccctggctagagggaatgggacattgtccgattaggttgccttgacccaatgaaagccaaccgggtttacattatcggtctaccaagggcaatgaccagagaaactgcgactatgccgtaacccttcgcagattgccgatgagaaccatcgatcgtaagtcgaagccaagcggattgaccagtggagggttatcccgacaacagc

SEQ ID NO: 1256 - DNA, 1171 bp, Heterodera glycines
  source 1..1171: mol_type = unassigned DNA
tgtggcgatactcggaacctccggggagcctggtaggagttggcctacaggtcgcgaaagtccctaggtgctgcacgggttgcgctaatccgagccccttccggtgttggctagcactggaggggggggggtccaaagaatacgtgaagcggaccctgtgttttctctgacctcatacgggtatatcccgatgatatctatacagtgttcattttcatttcttaacctgctttttcctcaagagaaatatgaccacattcgtttgccatttcgaaggtgcgacttttgagggagttctcagggacatcaagctgttcatggacggcttgacggctcgtggcggcacgcagccgcgcgggccagttagggctggtgccaatgaggcagcgaagaagtctctgaaacgccaaaagcagcgggagaagagagagaaagcggggacgggttagagataatagcatgattgacggcgaagcaatactttgacttccaggtacggaggacggcggcaaaaagcaaaaaggggacgaaaccgatggcattgccaaaggggccgaaaccattgagctggacgctgatgggccgtctgccgcgcaaaaggaggggggagcccctccgtctgggaagaaggtgcggcgccattcgtccaacaaaccggaatagatcttgatgatctcagcaattgatcatattgatctctttttccagttgttgcgataaattatcgtgcattatttcttcgatttctccaaagcttaactcctttcctaatacctactcatgtatacgttagtaggcatgttttatgcaggtaaagatagacctggtgcccccgggcgacttgggatgtggatgatggttggcggagagttctgatgacgccgtagttccggaggaacagttcctactagtgccagcctgggctagtggagctggtctggcgagtgctttgctcgtcagataaggggtggttggggtggtacctctggaatgatgtgtcggataagcactctgccttataaagctgtcgttctgcccaggtttctcctaaccaggttgaacttgtaatgagcctttgggtatctggtcggggtctgcgcggagatagctcgtgaggagctgttattacattattggttgaacgcttttgggtcgtactgcacagataaat

SEQ ID NO: 1257 - DNA, 1414 bp, Strongyloides ratti
  source 1..1414: mol_type = unassigned DNA
cgtcagaagagcaggtgtttttcaaagcaaagacttattctacgaaggggaaagatgatcaaacatgcagatttggctgcaatgaaatagaatcaaactaccatgtggtgacatcttgcaaataccattcatacacaagaagacacgatatggttgtgtacaatatattaaaaagactaaaagaaaagtataagttagatggtgatttacaatatggtagatcagtatttaatgggaagaaggaaaaaattaggatcagatctggccataagtttttgactgaacaaccgttagtaaacaataaaccggatattgttataacgatgaaagaagggaaaaaaaagataacgtacatactagagatgtcgataccacatatctagaacttgaagatgcaagaaagaataaagtataaaaaatattgtgtgagctccatggtaaaaataacgaatgataatgttgattcgatagctcgtgattttaatctactaaatttaatggaaagaaaagaaaggtgtaagataaagtttggatcatttgtatttggctgttatggagaatatgtcttgactgaatctgctctaagaacacagaaaatcctgattgaattgggattctccaaaaaagagatggatagcttgatcaaagagtgttcttacagttaaatgaatgagacagcaagaattattatgaaacatctagaaggcgaaaagaatcaagatgaaatcagccattaataacttttatttacccaattatttattgcgttaacttgattatatgatatttattgtatatttattgtttaatttagtttcatagtacaaataaaagaatatactacgattctttacttttaagttctacgagaacgttgttttagaatattttaataatatttctactacaattaagtaattagaagaaatcaacgaaagcagctaaacttactcgcaaaattcgttgatcgaggctggaatggcaccaactaatatactaaccaacaatagaaaaaaaaagaagaacttcagtggacttcaaataaaataaaattattggtagaattgtatgataaaactgagaaaatttgactaaaacaaaaagattagagcaaatatgtcatcattttcctaatcatacaattaaagcgatgatgacgaaattgagagaatttgaaagagaaaaaagggaaaattgtgaaattaaaatgagggaaaatgaggaaaaacctgaggaaaaattaaattttgacaactatgaagaagcaaaattgaaaagaggaattaagtgtaaaaaagaagtaaaaccaattgttattgaaaacaaggattaggaatttttgaaaacggaaaaattatttctcaagtttgtcaacacaatcaattaccaaagaaagaagggtaaatcaaccaga

SEQ ID NO: 1258 - DNA, 722 bp, Bursaphelenchus xylophilus
  source 1..722: mol_type = unassigned DNA
gggtcctcggttcttactaccgtgctccacctcctcgcgatggaccctggggtaggcctccgggctgagctaagcagagcattaaagtaaagagtgacggcgcagttgcttccaagttgcggtggggcggaacatctactcttctgagagaggggaagccctatggcggcgttagaaaggttggactgcggcaacactagccatgatcagattcgatcaaaatagcctctggggctggcgaccctataacggattgtaaactgaactatgctaacctgtcagtaaagacagaacgggggctttgcaatctaaggtgttggcagaccactaaaactgccctttgatgagggtgagataacatcctacggaacagcccctgctgatccaaacaaaatcatccacaaatcggagggttttcttggtagtttcccttggcacgtcttgtttcaaaagccagaatataaaacaataccgaagtacagaatggctggaacctaacagccatggcacagaaaaccggtgggtgcacaccggagacagcaggggaaagattgcaaagtgccgtaaataaagatggtagctctctgacctgagggaatgggacactgtccgattaatgccttatcccgaagacggtcaaggttctatcttatcggtctccaaagggctctggccatagaagctgcgaggaagccgtaaccctacgcagattgccgccgtgc

SEQ ID NO: 1259 - DNA, 1793 bp, Bursaphelenchus xylophilus
  source 1..1793: mol_type = unassigned DNA
tgccagcggtgttgattaggtccaagttctttggccaaagatccgccctcggtttagcagtaccgaacgagtataccttcaagtggtggcactgaattagactgaatactctgaactgtagacttttgtgcaactgtgtatggtgtggaagacttgtttgtaccactatcagctttattggggctcgttactgtttcatacaggtagatgtcccctttagagatttccctgcagtttgcgctccaagtcgctagcctcttgcgtgtagtcaaaggaatacattcgccgtcggtgacagggctatacccggcgactacggacttgtttattacgtagtgcagcctcgtttaagacgaatgtgaaaagaaggtgtgattactaagcgttatgagtcgggttatctggaaactccgccccgccgcaatggcttcaagggtcaaactgctaacattttaaaccaatatttggcagcagcagactatgatgtcagagtgccgggggtctatcgatataagactgaaagcgatagacgtggagtgaaaggattccctttgttaagagaatcggtagaattcactttttacttattcaagaacttaacagcaacaagcactcgcgaggattaccgccccagattcggtcggcggtacttcacctgctttcttccactttcggaatctggcatcctggctttcagtgtggtgatggccggcttgagttttcttgagtcgtgcgagtgcctcatctgggacgtccggaccgattgatggagtctgcagtggacgaggacttgatggaccgtaaccatagtatatccctcatgcgtcttctcgactcgagggggtagcttgcactacccacccttctcttctccgattgggatttagacctagccctctggtgtgtctcgacccgcgatatcagattcctgaatcgactgtgagaaatgtctacgcgcaaagatcgacccattgccacccggctatgtggatcgggctcttgactgcttatctccggctttaatcgcttgaggaaaggggggtgtcgcccgaaagggttacgcgatcatccgattcctaccgtaaaaacgtagttgaagtaggattgaacctgagtaccaagtgaaaagagtggctataatgctccatggtataccctagggataaccgtgtcgagcgcactgctcaataccctgatttgttagtgtaggtatgtctagtggctgcctaggcagattcgcctattcactacgtaaaatctgggtgagtaccataagaacctcctgtagggccaggagtcaaactagtccaggttcggtatgcttcggtatactctctcacgggctagtcacctaagagttaagaaccgcctttttctgcactgtgaatagaaaaagaagggcgggagaatatacgggcgaggtaagcacgtcggaacggggtgtgcccaactcgtaccgtacgcccggacaaggaccatctttcgtaccccgttcacccggcacaagtccgattgtctctcccgagaggcgtcggcggaggttggctaacgccgtctctccaaccatcggtttgggtttaagtaacgccccagtggccggtagccaaactgatggaggcagaaatgccggtccgttgctaaatgcgggaacggaccaaaacgccggtgtggtggatacaggtggaagagtcttttggtctacgcaagaaaagaccaggctcaagtacgaatacgaccgtcttcgtgaacgacgccgtcgagacaaagttcgaaatcctacggtcgataaggcc

SEQ ID NO: 1260 - DNA, 450 bp, Ascaris lumbricoides
  source 1..450: mol_type = unassigned DNA
ggggccggtgggtttactcacttctgacccaccaccaacggaacgagggaaagcagagctggggccctcttccgattggcatggaaccgacctccacgtggtggccctgggcaacggaattcaagagaggatttaatcctctctatcatttgcaagatggatgagatcgaggtatccggcaaacaggttccaagtgagcacctttcccatagctgggaatatgggttaggcgtcctctgacatataagaggaatcagactcgttcgcgcccggtcattaacatcgatcagcgggagggccggactgaagtaaatttcctgttggcccgagtgcaggtggagctcggacccgaaaaacgatccctaagaggaccacaacccgaagggatggacgcagtcgccccggcacgtttggtgttggttatcctggagtgttgtgggacgaatagct

SEQ ID NO: 1261 - DNA, 100 bp, Heliconius melpomene
  source 1..100: mol_type = unassigned DNA
ataaataataataataataataataataagccccctaaaatccaaccatacgtccgagtcgaacatctgattctcgtggggggcggacacgtgaaaataa

SEQ ID NO: 1262 - DNA, 129 bp, Takifugu rubripes
  source 1..129: mol_type = unassigned DNA
ttctatgcgccttatgcgactggataggccagtggtttacgccgctgactttggtgcggaaggttgtcggttcgaatccaggcgagcccttaggcaaggctccttacgcatatatgcctacacctcggt

SEQ ID NO: 1263 - DNA, 325 bp, Taeniopygia guttata
  source 1..325: mol_type = unassigned DNA
ttcaggttatttagatgcttagtttttgtacctttcttgttttgtttaggattttgatagtgttagtatttttatatttttgtacgattgcataatgttcttttttatacagttctgttttaataaaatagacgatagctagagacgttagggcagccacaagccagttaggtagcggatagtaggtaggaacagacttttactatttcataacgcgtcaattaccacctgatttggaccaattcacgggatttgtccaaggtggacgggccacctttacttaacccggaaaaggaacatatataatttatgtgtgttcgataaa

SEQ ID NO: 1264 - DNA, 289 bp, Geospiza fortis
  source 1..289: mol_type = unassigned DNA
ggtagataatctttgtatagtggggggggatctcatgtaccgggtttcttttatttgattttcaataaaacagacggtagctaggttcgcaaggcagccacaagccaaagataggtagggtgctcatagtgagtagggacagtgccttttgattcacaacgcgtcaataccatctgacacggatacccttaccggacttgtcatgatctcccagacttgtccaaggtggacgggccacctttacttaacccggaaaaggaacatatattaattatatgtgttcggaaaa

SEQ ID NO: 1265 - DNA, 350 bp, Zonotrichia albicollis
  source 1..350: mol_type = unassigned DNA
gtagtcacattgcactttctgtaacttgcactgggtgtgggatgtgggcctggggtgtgggttatggggtatatatgtgggatattctggtgggaatgtccattcactgtatgcctatctttttaataaaaagacggtagctaggttcgcgaagcagccacaagccaatagccagttaggtagctcatagtgggtaggtgacaggaacctttgactcagaacgcgtccattaacatctagaacggaccaaacttcggacatgcaccgattaaccggatttgtccaaggtggacgggccacctttacttaacccggaaagggaacatatatagttatatgtgttcgtaata

SEQ ID NO: 1266 - DNA, 1449 bp, Danio rerio
  source 1..1449: mol_type = unassigned DNA
aaatcccagcgggatacagcaagaaggtatcggatctaataaggttgagcgaggagagggtggagatcctttggggggggtcgggctaagttcccctctcgggtcctcccacggtgacgctctacccctccctcctcgctcgtagaacccaacggtgaacacggttggcaggatgaagtgacgtgaggggtaagacatgcgtacgtgagcgcgcatttttgctgttctctggactgggtttcgtccccctcacaaccatcacttacactataggggcacagcggctcctacctccctccctatgacccccccttcccataccgatccatggctgttctagtctggaccgagggtcggacggggcatttgaaggtagctggaatcctccgctgctgcgagcctgaggtcgatggttagaggtgaaatacttgggaggagacacagcctccggagagcccctcccgggtggtcatcatggcaaccgggtgaaaccttacggtttcacttacgaaacagcaccataacagcgccgtaatagcgcaccggtgtgactactgtccagtgctgatattctcatctggagaatacaacacgggtaatggcagagtattcaaaacccaaatgtttacgatcgaccaacggagtcgttcccttgcatctaggccggacccgaaactgccgtaattgcccgtccccaaggtagcctcttagaaaaccgaagcccggtcggggcggtggttgcggcggcgctgcgggggcctgctgctcgggcggcgtcggtgtgccgcggtggttgcggtggtgcggcggggatctcggtccttgcggtgccgctgtgccgccgcggtcgcgtcggtggcgctggggtggtggcccgagtggcgtcggcgtgccactgcccatagtcgcccgcgggggcgaccgatctggaggggcgagggggctcgcgggactttaacgagaaacggaacgcaacttctcgcatcgctcccgggactttcccccctcgttcagccgagggatgccaaaaggcatgaaaggtaagtaccataccggtccgcaaaactctcttctgactcggttctctgttggttttctagagtaacaacgaggtggaggagagggacatggcagggactcccattcgtgccagcgggtggggacagatcgaaggaacggttcgagggcgtaacagacgagagggaatccggtcacacattgatgccatgcctaaataggcgaggtttgtatttctactttgtgggttcagtatagtcggagcatatggtcggttgtcccgttgttttcacggcgggcaagcgactatcatgataaagtagaatgggagacgggctccctgacaaacccggaaaggcgcccccccgtggttcgtagcagctgacggatcacgctcgaagaaaaatgagtgagaggggacgccgcaaccac

SEQ ID NO: 1267 - DNA, 1155 bp, Gasterosteus aculeatus
  source 1..1155: mol_type = unassigned DNA
ggaggggagtaggtctctactctgacccgaagggcccccccgtttcagacctgattctaggctacctgtgcctaattgggggggtcccaaagagatgttgtctgttgtagaagggtttgcgccactgactgcacggaagggtgggcctcgacaggtaggggttacatgactccgtgctgctcagcagacccgcgcctctgagaccgggtagggctacttgaacaagcgacgccctggtgtatgtccgtatcctaacctggtttgggaaagccgataccggcaatgcccgccacaggtgtcgcgcaccccacgggatgacgtatgggccccgggggacctcatggatactccactggacttgcacaatcctggtgtactggatgcagcgacgttggtgacataagcaatcgctaagtcggggtaggggaggtggggacctcggcacggctgtaggaacgggtgtatgggctccggcagccgtcgtcactcccatacaacacaggggctgcatcctggtggccggtgctagttggttctggaagcccgcccgggctggttcgcagaagcagggtgcgcccagggtaggtttggtatatctgggtccggtgcgatacctatcgatgggcagcgagggccgcctcgtgacgcgctgtgtggagctggagccggcctgggtatgaacagttcttgcggatgtggcgtagctagatagtacccgtggttgtgggcgtggtgtcgaccaaatgttgtcctgtgtgcacataggccaagggttacgtgggtggcagtcagaagcacccgcacctggaagtgattgccccgggatcccggctctctgtgaagagctaccttgaggaaaggtgttccgctggaactcaagaccctacagtaggggatatcaactggctttgaggtgctgtgattccggaaccagggcgagggcgagtacttagagcatgtccaaaagcccggggaacgttccgggggcctgcttgggtcgttggacccacatccgtaaaacgatggatctcgcgtcggcgctcgggagaacttcccgcatgaacgctgattgcatgtgagaacgcccccacggcggcggggcaggcgctccccctgggtgtaaggctcgggggggtcacggctccgctctaaaag

SEQ ID NO: 1268 - DNA, 245 bp, Bombyx mori
  source 1..245: mol_type = unassigned DNA
gccttgcacagtagtccagcggtaagggtgtagatcaggcccgtctgtttcttccccggagctcgctcccttggcttcccttatatttaacatcagaaacagacattaaacatctactgatccaatttcgccggcgtacggccacgatcgggagggtgggaatctcggggatcttccgatcctaatccatgatgattacgacctgagtcactaaagacgatggcatgatgatccggcgatgaaaa

SEQ ID NO: 1269 - DNA, 507 bp, Hydra vulgaris
  source 1..507: mol_type = unassigned DNA
taaatgccaaaagttgcttgggctaaatgatacgtacgctagaaaaagcgacttgctgcacggatgacggttcatcagagcccgatatgtgcatgtcaaggcggcagggagaatcactagtgtagctgttctttccattacgacttacgcggttaacgtggcacgatagatttacaccaggaaataatacgtgaagggttccaccatatactggagtttagatctatgagggaaacatttgtaataagtcagtctggtaacctggcgccgctgttgagtcaaattaactatgtcaatactcattaagttatcgactttgatatggcatggggtgattccgcgttatatcaaagtcaaacatgatgattgcaatgagaaactaccacgcttggtcacgtttgtgaggagaacatctcattcaagcctcccggatgtcggcacccgctgacatcttctggcttatgaaaattttcattaatttttgtaagtcatgggcggcttgaaagc

SEQ ID NO: 1270 - DNA, 523 bp, Hydra vulgaris
  source 1..523: mol_type = unassigned DNA
atgcccgaggtagttgggataatgatgcacaagctcgtaaggcgacttgctgcacgtatgccgctaaacgcttagctcgatgagtgcatgtcaagacggtcgggagtatgatcagtggagctgactttccagacaactcacgcggattcgcgtgcggtggatacaacacctggtataacatatgaagggttccatctagtacagggataacgatccatgggagcaaactaattagttggaggtaatccaacgccgctgttgagtcagtttttaaccgccagtcaactcttgtaggttatcggtcttcggcagaccttggaccgcctagcgccggccaacagtttgtcgtcgactaacatgatgatttgcgagagaaacccacgctttgtcacttatgtgaggataaaatctcttgtccatatgatcctttgaagggaacagcgctttgagcttgctcggcgttggcacctttagtctgtaatattttcttgatattatggacgaaaaaggtagtatggttgca

SEQ ID NO: 1271 - DNA, 303 bp, Adineta vaga
  source 1..303: mol_type = unassigned DNA
actagtctccttcttctattagtcagtctaattaatttttcttacattctacatctagttccattattaaattggtatgatcagtgctatctctgctacactcaatgcttaatcgtatgttattgacagtctgacacttgattactcttacgacatatgcactgtttgcttcagagaaaccactgttcatatagtgaagttcctcagttttctgttgatatattcttctttcattctcgcttctccttttctactgtgttctttttatcagttttttgtggaaaaattgagaataaataaagt

SEQ ID NO: 1272 - DNA, 108 bp, Oryzias latipes
  source 1..108: mol_type = unassigned DNA
gggggacagctgggagtctcggcatgattacaaatcttgcgctgcactcggatgtcgtccccgtgacggacacattaatccggaaagcgagtggtgactcgcctcaag

SEQ ID NO: 1273 - DNA, 148 bp, Limulus polyphemus
  source 1..148: mol_type = unassigned DNA
attttgtctctttccccaatgatgtctactagcacgctgccgaagctagatagattgaggaatctgcgtaatctgtaatgattacgcctcatgggcatctatcggtagcgtcgaccctgacgttaaattgggtaataagaaatatcga

SEQ ID NO: 1274 - DNA, 1570 bp, Caenorhabditis elegans
  source 1..1570: mol_type = unassigned DNA
cctccagggcacgccgcacgccaaaagtcctggcataactctgcaaataacatcaaacgtcaatcaactccacaaactctccactctcttcaagtcttctcggtgcttccaacaccacaatggtgaaagctccttcaccttttccctccaaaattcttcccatgtggggaagtcctgttcttgtaagctctccggaggctgcaagagcagaagaaattcttctttctgacaaggtcagaaggaagtcctgttcttgaggcgtccatcccgggcgtcataggagagatcagatgcaccttctagcaggagctagaagggctgccctgtcttgagatccccacgggggtcaatagacgggaggggctgctggctttctctttttaagaggaagcaccaatccggagatccttaggggtcaaaggattaaaaggcagcaggtccaattctcctcactgacttcggtcagagaggagtcccgccttggagacctccccggggaggttgctgaagaggcggaagctccttctagcaagagctagagggagttcccagtcctgaaacccttgcggttgatgatggaatggaagagtacttcggtactgctcgttgctctctctgcgttttactgccgagggccggatttgctcgaatcgcgaaaggtctcaatcgaccattcaagatgacggcttatctaaggtccgaaagcagttgggagagtaacgtgttctcctacctttcaagttgaatggtcgttttactgtttgggatagctgacttgatgctagtacgcttcatctgtggatgacgctccccaagcagtcaagtagacttgaaaggtgccctcgccctagttagctcttagaccttatgggtcgccatggttgtggacgggtatgcttgccggagccgagtcgtgtttcttagaaccaacctcgacgaggcgaaagcttgcacaagttagcacaattgtggtagggccgactagaaaatgagtcccttagggggttacgccttggcgaaagtgaggacaattggcattgacgggtgcttcggcactaggcaaaggcgccaccacactgtccaatctctaaaaagttcacattcatcgaagaactaccggaaccaaccacacatgtgttgaaacctacacggtggaagggaaaggaaagcttcgctggaacgaaaagaacggataggttccccttcttgatggctgtgaggcttaggatggacgggaaggccgtgaggcctcaggcgggtaactcggccagacgctagttgatcttcggatcacgacagccctggctaagaggaaccctggatggagtgtgaaggatgggcgggtagggggttaagcctgttgacagaccaccgactgcagtcacaaaatcagtgattatgcgggtggaccaatctgttggcgggtgtttccctctacctgaccccgcaatatggtatgtacgatcctcggatctaaaattcataatggcccaccacaaccataaacctccctagcagctggtggtcccgataattcgggttcttgccactactgcgacccaggctcgcc

SEQ ID NO: 1275 - DNA, 130 bp, Cryptococcus neoformans
  source 1..130: mol_type = unassigned DNA
tgaggaagaggaggttggattattttttcttttctttaataagttgtttatttaagtagtttctttcattcgggcaacccacacgacaacccaataaattaaacaacgaaaaatgcaacctctataaccc

SEQ ID NO: 1276 - DNA, 60 bp, Chondrus crispus
  source 1..60: mol_type = unassigned DNA
taagtccttgacgcctgccccgtgatacagcatcggtacccctagcatttgaataaaaaa

SEQ ID NO: 1277 - DNA, 69 bp, Chondrus crispus
  source 1..69: mol_type = unassigned DNA
taattcaccttcatatctgctagtgtctctgtaagcgcacccctcatgcattgataaaattacccccca

SEQ ID NO: 1278 - DNA, 348 bp, Acanthamoeba castellanii
  source 1..348: mol_type = unassigned DNA
taagccgcgcgacgaggacggccaggacgaccaggacgacggcgacggcgaccacctagcaccgcacgcgccacgacatattgtcgcgcgctgtacaggcggctaggtcgagcccagccgaccgttctgagcctcagtcggcttgagcccccggcttcccaaggcctaccggggcggctctttttcgccctggtttttgccggcctgttttttctctcccccttttccccccttttccatttgtacttagtttttccttcggccgcggcagcttgttgcccggcatagtgttaatatgtttaaaaaacgtgtaaataaataactgtttaaccctaaccctaaccctaa

SEQ ID NO: 1279 - DNA, 261 bp, Fragilariopsis cylindrus
  source 1..261: mol_type = unassigned DNA
tagcaccaccatctattcatatccacacactgaccacctccaccttcacaactccactctcaattcccctgactactaagaaatatttcatggtggttacattggaggtatcccaacaccaagcacaaaatgaacccactaaccctctcatcctatccacggggaccacctttgagcagaacaccattcatattacaacctttagctagattaagataattatttagtacatattttatactattaaaaaaaaaaaaaaaa

SEQ ID NO: 1280 - DNA, 32 bp, Hydra vulgaris
  source 1..32: mol_type = unassigned DNA
taacttgtatttttaaattgttttattagttt

SEQ ID NO: 1281 - DNA, 27 bp, Lactuca sativa
  source 1..27: mol_type = unassigned DNA
tgaactatattttatatattaaaaaaa

SEQ ID NO: 1282 - DNA, 528 bp, Monosiga brevicollis
  source 1..528: mol_type = unassigned DNA
taggtaggcaccgtctcgggggtccctctgtggggatccctgtgtgcacctgtcgctccctaggtggttcctcgttgtgtcttttgatggcttgacttgtatttttgttttaattttgctttaatttttgctgtatttgtgtggtatttttgctgaatttttgtaaggtcctttgtatgatgtctttgtcttctgtggtcggttgttttcctcaatccgacgttgtgtctcgttggatgtgagcgtgccgtggtgttctttgtgtttgtgctgtgatggcttgtagttgtgatgtgtgactgcctttttgggtgtcttgtgtttgaaatggccgtatctctggttatacttggtcgttttgtacgatttttgtttctatgtgcgtgattcttcgcgcttgtacttcttggcatgatagaagccaatgaatgtgtcttgttctcttgtgttgttttgcgtgccgtcgtgattttgatgtcggggttgcacagctttgctttcagctctgaggttcaaacacctaattta

SEQ ID NO: 1283 - DNA, 38 bp, Hydra vulgaris
  source 1..38: mol_type = unassigned DNA
tgagctcttataaatttatattatagcattttgtttta

SEQ ID NO: 1284 - DNA, 363 bp, Magnaporthe oryzae
  source 1..363: mol_type = unassigned DNA
taataggtaacgtccctatttttgtctttggttttgtttttatctttgtttttgtttttgttttcgtttttgtttttgttttcgtttttgtttttttttttgtttttgtttttgtttttgcctttgtttttgtttttatctttatttttgtttttgtttttactttgttttatttgttttatatttaccttttgattttttctatttttcccacccttattattataaccccaacctactaatattttttcttttttcttttttctttttacggttttattttcccgtttgttttttctattttatttgtacgacaaaacccttagcaaataagcttagaatataataaagcgcgaattaaaa

SEQ ID NO: 1285 - DNA, 85 bp, Branchiostoma floridae
  source 1..85: mol_type = unassigned DNA
tgattaaagacccgaaacacccaatgaccccgggttcatcactgatgatgtgtccctgttcgcactaccagagtgtattctagag

SEQ ID NO: 1286 - DNA, 127 bp, Danio rerio
  source 1..127: mol_type = unassigned DNA
tgatcaaccccggctgggtcacctgggtgagagtgtatgatgttgagagacccgaaacactcaatgatcccaggatacatcactgatgatgtgtcccaaatgcatccatgagatgtttcttgcataa

SEQ ID NO: 1287 - DNA, 270 bp, Branchiostoma floridae
  source 1..270: mol_type = unassigned DNA
tagaaacccacaaggctgagaaatgtagagcatctgtatggacaatattgatgattgaaatgttgtgattttagatcaaatttagaaatatgaaaaccgaactaaactaaatataatgttttttttaaagtaatgataagcaatacccacattgtgcaatactatctatgttatgtcctttgtcccccctgcatgtttggtcaataatgaccatcgtgtcctgggctccgtgtacctttctttactatgaataaagaatgattttactac

SEQ ID NO: 1288 - DNA, 154 bp, Danio rerio
  source 1..154: mol_type = unassigned DNA
tagcatgccacttggacacaggccggggtctgatcagcctcggtcgggtcgcctggaggagggtgtctgttgcaagacccgaaacaccctgtgagcccaggaaacaacactgatgatgtgtccaaggttgtgcatcaggagatgtttctgtaac

SEQ ID NO: 1289 - DNA, 123 bp, Takifugu rubripes
  source 1..123: mol_type = unassigned DNA
tgatcaccccggctgggtcgcctgggcgagggtgtatgatgtcgtgagacccgaaacaccctatgaacccaggatacatcctgacgatgtgtcccagtgcatccaggagatgtakctttaagt

SEQ ID NO: 1290 - DNA, 128 bp, Tetraodon nigroviridis
  source 1..128: mol_type = unassigned DNA
tgatcactcccagtcgggtcgcctgggtgagggggtctgatgttgaaagacccgaaacccccgatgaccccaggtactatcactgacgatgtgtccaagacatgcatcaataggtgtatttagaaatc

SEQ ID NO: 1291 - DNA, 508 bp, Schmidtea mediterranea
  source 1..508: mol_type = unassigned DNA
taaaatggcaaaaagatatttcaagatgaattgtggactcatctaaaaaatgaccaccttgagtccaaatatgcctagctatcatggttgctgatggaaacagtaaggcacctgatagctaacttttcactgtgaatatcttcagatattcacagtgacacgaaaggacaccactagtaaaaaccactagttttttctgacacctcttgctacaaactctgtaaaaatcaaaaggatcgataggccgcgctttcacggtctgtattcgtactgaaaatcaagatcaaggaagcttttccccttttagtcaacaccaggtttctgtcctagttgagcttcccttgggacatctgcgttaccatttgacagatgtaccgccccagtcaaactccccacctgacactgtcctcaaaacagttcaattgcatccgaagatcgcaattttttcactaaaataaattaacaaaagttaattatactgcttcattgagtaagtagaaaaacaatc

SEQ ID NO: 1292 - DNA, 659 bp, Caenorhabditis sp.
  source 1..659: mol_type = unassigned DNA
taaacccacacgagamctacgacgccataagatcaggcatgtacggatgtgaatgagactgatgaacggaatgagcacgtgcccataagatcgggtatkaaagawcagagacgatccctamcatcgggaaaacacgagttatactgcttcactgamctcgctaagctctcataatgaccgaacttgttcgcaactgcctcctaaccgggcgggtgtgagaagggaggtcgccttgaggcggacgcaatgagggatgtgtgcaggttccccctcttgagatccgaaagtctaaaagtactagaccgaaagatcgaggacggacgggatggccgcgaggcacacggcgggtaacacagccagataacctagtagatcttcggatctcgtcggcctggagatatgtggaaccctgggaaaggagaaagttgtttgttgggctggcaagagtgaagtttgaatgtgaaccaccgtcatgcaaccactaaaccagtggcgatgcgggtggagtcatcacaggaaaatgtttctgttgcttgacttatcagtgtttgatatcgccctcaggcacaagtatgaaggcccccacccacataaactccctagcaactggtagtccagcaagcgctggtwcttgctactattgcgccccaggctcgccc

SEQ ID NO: 1293 - DNA, 680 bp, Caenorhabditis sp.
  source 1..680: mol_type = unassigned DNA
taaaagccaaaagccacggagcatcgggaaagaaaaatggaaaaggactgaaaacgagactgaaaaatcccaaacaaaacaaatccaaaacaaactgaaaaaaaaaaaaaaacaaaacaaaaactggacagacactggaaacagtgtcaggcaaagtcgccgattatactgttccacgccttaaaagtcccgaaatggcgcaaaacaacctgaatctatctgaaagtgctccaaaccacgcacaactcggagaaaatcagggacaagttgcttcacgcaacgggctgggacaggtaccccctcctgaaaccgcgaggttgaggatggacgggaaggccgcgaggcttatggcgggtaactcggttggtgtgctagtagatgatttatatccgacagccccaactaagaggaatcctgggaaaggaaaacttgaaaaagtttttacagggctggtaatagttcagcacaattgtagtctactgtcttgcaaccacaacaaaccagtggttctgcgggtagatcaaactataatttgtgtgttttcttttacttgacccgggcaacacattataccacgtccacaaggacgaattcataatggcccctccctaaataaactccctagcaactggtggtccggcgaagccggttcttgccactattgcgccccaggctcgccc

SEQ ID NO: 1294 - DNA, 893 bp, Caenorhabditis sp.
  source 1..893: mol_type = unassigned DNA
tagccgatcgtaaaagaaaccgagccgtaacaacaagcaaagtaaacaaaagaaaaatcaataaaaaggaaggttgacctcagaccccgaggagggaagagagacaccsagaaaaagagagacgcagagaaaaggagagacacctctcataaggagaggtaggtcaatccaaatgtaaacagaaaaaaccagtggggaggaaagaaagactgatttcacccactaaaatgaatttggaaacagaatttggaagagaaaagagaaagggaaacctaaagaaaatagttctcttgccaaaattctgtagaggaatactttgtcaaaacatgatagaaaccagtaatctggtacgaaagacaagtaagacctgaactgacaagaaggaagtcagaaagaaataccgctcacaaagcctgtgatcgattctcttacctactgaacttgttctcttggcctcgtaaccggctaaagggagaaggaatgttaattggagatagacataaagataggtggagtgaaggtcctgttcttgaaactaggaggaatgtggaaagagcagaaggccgcgaggctttagacgggtaactcagtcagttgctagtggtcttcggatccaacggcttcggacatagtgaggaaccctgggtacggagaagaaatggaaaagagatagggcgggcaaaggctaagttcatacactgtcatgcaaccactaaaccagtgggatctgcgggtgaatcactttcgaaaagaagtgaatggacgtgctgatgtctgactttaaagaagtctgaaattaaaaaaacagatataaaggcccctcactataaactccacagcaacaggtggtccggcgaggccggttcttgccaccattgcaccccaggctcgtc

SEQ ID NO: 1295 - DNA, 409 bp, unidentified
  source 1..409: mol_type = unassigned DNA; note = Description of Unknown:Trichomonas vaginalis sequence
taagaagagataagacgagtgagaagaacagaagcatagtaggattggcagagcttaagcgatgtcactcggtacgaaacgtgtaccaaacaccggattccgtgctaggaatcacaagccaaaataaaagagacaccacgaaaattactcaccctccctcaaacagataataatattaacctcccatccatcagtccgtatggtctgataacagactagcaccacatccatgatacactcattggagtgaaaaccaccaacaacaaatccacctagaccaaatcctgccccacctccacccaagtagctcgcttcgctcgctcacctaaaactttgctcgctcgcttcgctcgctcgtcttaaccctttccgaataaacacttacaattcccggctcgccccatttttt

SEQ ID NO: 1296 - DNA, 1468 bp, Caenorhabditis sp.
  source 1..1468: mol_type = unassigned DNA
taaaccggctcctctgggaggaggtatgtcagaggacattctccgtgggcggatgggaggagtagggtaacgacccgtcattctggatgcctaaaccaccacaatctgtcaaggcaaagtgccccaaaagcacacgcgtggatcggtttggatgccgactgagccagagggcaaagtcgaaggccggtaggctcccggcgggttgtccgtcatagtcagtggtgcgcctacacccaactgctatgacacacaaggacaacccaaaataaataagccaaggcggcgttagcttcgagctaacaagctccccgagaggatggttgccacagggcaccatcctggggaacgacccgatctttcggatgcccaaccaccgccaatctgtcaggcaacgtgccccaaaagcacacgtgcggagcggttggatgccgactgagccagagggcaaagtcgtaggccggtaggctcccggcgggttctccgtcgtagtcagtggtgtgcctacacctaactgctatgacaagcgtataggaggcccggaaaaacaagccaaggcggcgttagctgagagctaacaagcttctcgtggatgggtgccagagggcaccatcctggtgggtggatggggggagcttgggaacgtcccgatccttcggatgcccagaccaccgcaatctgtcaaggcaccgtgctccaaaagcacacgcgcgggttggtttggatgccgactgagccagagggcaaagtcgtaggccggtaggctcccggcgggctctccgtcatagtcagtggtgtgccttcacccaactgctatgacatgcgtacaggaggcccggaaaaataagccaaggcggcgttagcatagggctaacaagcttctcgtggatgggtgccagagggcaccatcctggtgggtggatggggggagcttgggaacgtcccgatcgttcggatgcccaaccaccgcaatctgccaggcaacgtgcttcggawggtcattggttctagacttgtaatagaccattggccggaagagcacacgcgcggttggttggatgccgaccgagcctagagggtgcaaacctgaagggcgaggtcgaaggccgtgaggctcccggcgggaaactccgtcatagttagtggtgtgcctacacccgacgactatgacacataggaggaatcctgatctgatatgatcatgtatatagggagggcgaaggtaaatagtcagkgtcaaagtccacgtggcagctactccccagcatagtagtgatgcgagtggawccaactttgacactgatgttccctgagcctgacccatctgcacaaatccaacagtgtatgatggcccacacactgaggacgagtatcacttgtgatactcagaggtgtcccccatgatcaaccaatatcacagctagcggacctaccgtgaggtagacccccgccgctgtagcaggctcgcctc

SEQ ID NO: 1297 - DNA, 635 bp, Caenorhabditis sp.
  source 1..635: mol_type = unassigned DNA
tgaataccgtcagataagcccccaacataaaaataaaagtcggcgttagctaaccactaaaccggctcctcattgggggagagtatcattccggtgctctccgtttgggcggtagggaggagttgggtagcgacccggaagtatggatgcccaaccaccgcaatctgatctggcattgtgtttcggatggtctctgtctctagatctgaaatagagctctggcctgaagaacacacgcgcggaccggttggatgccgactcgatctggagggtgcaaacctgaaagggaaagttgaaggccgtgaggctcctggcgggaaactccgtcatagtcagtggtgtgccaacacccgacgactatgacatagttggaggaatcctgatctgataataatcattgttcatataagggagggggatggtaaatacccagggtccgaaaccatcaaagcagctactgaccagcatagtagtgatgaacacatagaccctggggttccctgaactcgacccatctgcacaaacccactttgtacaaatgaaccaaactgatgaagagtttaatgatttcttacatcacagctagcggacctaccgtgaggtagactcccgccgctgtagcaggctcgccattg

SEQ ID NO: 1298 - DNA, 1425 bp, Caenorhabditis sp.
  source 1..1425: mol_type = unassigned DNA
taacatgccttggaaggcaccacgccaaaagtcctggcaactgatttgaataatgtataaaagtaactggaaccaaatgcccgataggtagggcgggagaaaatgacctagaaaacacaaagtcccaagcccccggattcgaaagacctataggaagtcagtgaatagagagaaatatcaaacaaatctcacccattcacaaggacttactggtcgagtagaaaacaagccaaaacatcaagcacgacgcaaaaaggggtaactttgggcaactaattaacggatacctccgtgtatcaggcaaagccgccaccaacagcaaattactgcccgataggtagggcgtgagaaaatgacctacaacctccaagacccgagcccacggaatcgaaagacctataggaagtcagtgaattgatggaaatacaaaaccaaatttcttccattcacaaggacttactggtcgagtagagcacaagccaaaatatcaagtatgacgcaaaaatgggtaaccttgggcatccaatcaacggatacctctgcgtatcaggcaaagtcgccaccaaactgtactactccgaaaaaaccaagaaacatgattttcccactccgttaaagcatctcaaccaagctaaagcggtaaggttatcatgtcaaaaggtgtagctacagcaacctaaagcccgaaaggtagggccgtataaaaagacctacaccctccaagacctaaacccacgaactcgaacgacctacaggaagtccgtgaatggagagaaatatctcaccaaatctcttccattcacaaaggctaactggtcaagtagagcacaagctaagcctccaagcacgaagtgatatgggtaatttaggcaaccaatcaacggatacctccgtgtatcaggcaaagtcgccacaaacactgtactactccgttactcccaaacacatggatctccttctctcaccaaaaagctttataaccaagctaacggtggaaaggacatcatgtcacgaggagtagctacagtaacctctctcttgagactgcaaagtcgaggatggattgggaaggccgcgaggcaaaaggcgggtaactcggccagacgctagtgatcttcggatccgacagccctggccttagaggaaccctgggataaggagcacgacgggaaggatgttccgcaaggatttcccttcccattagtcagggctggcagttggtaatatagcctttctacacaccaccgtcttgcacccactaaaccagtgggatatgcgggtggactcaatgtagaaaggtgttcccactgcctgactcgccaactttatatgtcttgtcaacataatggcccctcactataaactccctagcaactggtggtccggcgaagccggttcttgccactattgcgccccaggctcgcc

SEQ ID NO: 1299 - DNA, 146 bp, Schmidtea mediterranea
  source 1..146: mol_type = unassigned DNA
tgagtgtgctacgaggcagcgctggtaattgcatcggcgttgcagatttgtgtacgatagataaaaaccaatagtaataaatgctgagcctagctcgcatatctaagccgaaaggcagcatatatatgagacaatttaaaaaaaaa

SEQ ID NO: 1300 - DNA, 178 bp, Girardia tigrina
  source 1..178: mol_type = unassigned DNA
tgatccgtgtgtttgtgtcgtatgattgtttccgtgtgtgtctatatttttcttttttatactttcaattacctcgttgtaatgttataacttcatatggaatatatgtaatttagtttagtttagttagtttagtttagtttagtttagtttagttagtttagttagtttagttagt

SEQ ID NO: 1301 - DNA, 338 bp, Chrysemys picta
  source 1..338: mol_type = unassigned DNA
taaccgagaccgccgaccagggaaataacccacttccttccctgacgaaccaagggacgcaccccacccatgtacttattcgctacaccgatactgacttggactccttatacattccatgggtggcgtacccgagcccacttatccactgacactttaaaaactcttgcaccccaatctgggtctatgccggttatgcgatatgtatgtatctcttcatccttgcaaccgatacctgtaatccctcataacccaagcctgaccccagatgtacagtaccttccctcttaactcgtgtatatttaattttaaacattaactttaataaaatttttaaa

SEQ ID NO: 1302 - DNA, 124 bp, Acanthamoeba castellanii
  source 1..124: mol_type = unassigned DNA
taacaaccatgtatggtgaaccacacctctctcgatcttgtattctgtgattggacatcagagttcctgcgaagggatacactctgccaatctcgtgggttgtaataaatccacaccttcaaca

SEQ ID NO: 1303 - DNA, 668 bp, Acromyrmex echinatior
  source 1..668: mol_type = unassigned DNA
taaattattttgtctttgtcttggccccccctttttaaaccaagcaggagagagtggcccaatgcccaactattatatattaactatttactgtgatatttattatttgactgttgggcgggcccctctctgctggttttatttatatatattttttactcgcgtactttttgtactactctatttttctttttattttagctatgctatttttatctctttctttgtctctattttctttctttttttctttccttttcttttctttcttttattcttcttttatttatctttttttcttttctgttgtggggccctgaccgtccgagtgtgaatgccgcgaaaaacaatattatgttttatacgagtgtgcatgtgcgtgatatatttatctattttattttatttatttattataatttattgccgcgcgcgctcctccgggacttttattcgttgacaatactgtgatatttttctgckcaggctgggggggcttgccccccagccccttagttttaattgcctatgcggggggggcttttgtcccccgcaaatgtatatatatatatatttagcgcgcggcttagccgcttttgtttgtattaccccagaggggaattgtccctctggggaaaaaaaatgattggaaaaataaagtgagctaa

SEQ ID NO: 1304 - DNA, 408 bp, Alligator mississippiensis
  source 1..408: mol_type = unassigned DNA
tgaaccccccctctgcaccagatggaccttcacttcgagaggattcttcagcaatggacgaccccgctccacccgaagaggacccccgcgatgagactctatatggactgagacactttttcttcgaaccacttcctccaccattgcggaccattgtaacgggtttgtgtgtatctatcttctttctctctcagcgtcgcgaaccccctccctccccttcccctccccctcccccccacccccgggcttagttggctaacattgtatctcctgtaacctagttgcgttcccctcctcacccccatccctctattgttagtccctcgctcgggcgctctgtatttccctaccggctttgtcatcttttttggattcacaatcctaaacatctactaataaaagtcaatc

SEQ ID NO: 1305 - DNA, 401 bp, Chelonia mydas
  source 1..401: mol_type = unassigned DNA
tgagccggtacgacatcgtgcatcaactatgagaaagggactgagagactttttccattggaccatatgaactggaaccataaactcactgaacattaaatctcaccaaatgagggtaaatccatcctcatcatcgtatccactcattatactccacacctgaacatagccattatatgaacaacatacccccatatctcaatgtctgtactttgacccgttaaccttttacccccaatcggggatattgcagattatgtattccttacgccacccgatcctaaaccgaatttcgcaccccttgataatctgtaccttattccctgataaccagaaacttctatgcttaaactctgtaccgtttttttttatttcaacatcatcttaataaaattattaaa

SEQ ID NO: 1306 - DNA, 402 bp, Chrysemys picta
  source 1..402: mol_type = unassigned DNA
tgagccagagtgacatcgttctcccactacgagaaagggaccaagtgaccttctccgttggatcatatgaactggaaccataaactccctgaacattaaatctcaccaaatgagggtcaatccatcctcatcatcatatccactcattatamtccacacccgaacacagccactctatgaacttcataccctcatatctcaatgtctgtactttgacccatcaaccttttacccccaatcggggatattgcagattatgtattcctcatgccacctgatcttaaaccaaactttgcaccctcgataatctgtatgttattccctgataaccagaaacttctatgctcaaactctgttcactattttttttaacatcatcttaataaaatttttaaatctgtt

SEQ ID NO: 1307 - DNA, 228 bp, Drosophila sp.
  source 1..228: mol_type = unassigned DNA
taaaaaattaaaatgccttaaaaataaataaatatatcaaaatttaaaaaaaaaaacgaggaacaaataaacacaaattctgaaagatttatataatttaaaawataaatcgaaaataaatgttgaaaacaaaaaaaaaataataataataataaaaacacaataacactcacccggcctgccccagaggcaggtaaacatttactggccatatggctttttttttaa

SEQ ID NO: 1308 - DNA, 408 bp, Gavialis gangeticus
  source 1..408: mol_type = unassigned DNA
tgaaccgccccccctccgcgccagacggaccttcacttcactccgagaggattcttcgaccacggacgaccccgctccacccgaagaggacccccgcgatgagactctatacggactgaggcacttccttcgaaccacttcctccaccattgcggaccattgtaacgggtttgtgtgtatctatctcctttctctctcagcgtcgcgaaccccctcccccaccccccacccccgggcttagttggctaacattgtatctcctgtaacctagtcgcgttcccctcctcacccccatccctctattgttagtccctcgctcgggcgatctgtatttccctatcggctttgtcatcttttttctggattcccgatcctaaacatttactaataaaagtcaatctgttcttt

SEQ ID NO: 1309 - DNA, 297 bp, Lytechinus variegatus
  source 1..297: mol_type = unassigned DNA
tgaatagcatttatattgtgttccaaacaacatactcattattatatctaaacatttttttttctgttcctgacaatctacgtaaagtctgctaaccaactggcatgatgaaataagataaaatccccttacacattaatttcttgtcacatcataatgctttgtcaaagcaatgtcctacataatatctcgatgtcaccccaattaattttacatccttcggtaacctttataccgttggatcaacatatatgatttgtaaaactgttatttctgagttttttctatgctaataaa

SEQ ID NO: 1310 - DNA, 257 bp, unidentified
  source 1..257: mol_type = unassigned DNA; note = Description of Unknown:Nasonia vitripennis sequence
tagtggggccataacacctaggccccacagtgtggcgatgtccatgtgtgtcgtccttacttatttatttatttgtcctgtcgagctgtttaatctattcatatgtatgtgttgtgtgtgtcgtccctcgtagcagttttattccgtccaaccagaggtcgaccaatattaaaataagcatggcttgaagcaggccaagcgccgtgttctaaccccgttttaggggaagttacttaacctaaaaatacaacttttcc

SEQ ID NO: 1311 - DNA, 246 bp, Phytophthora capsici
  source 1..246: mol_type = unassigned DNA
tagacggcacagttctggcccacgtaggccgaaagggccccacccatgtagggaaccgccctcgggaaatccattccggtgttcgactgaagagatgctccttcgccttgacggaggtacatctcgacagtcgaacttcaactcgcaacatatccgatacagttacaaaccacagttagatatcagataggaaccttcctttaggaagctaacgggtacactggatggtaaatacacatacatttc

SEQ ID NO: 1312 - DNA, 948 bp, Phytophthora infestans
  source 1..948: mol_type = unassigned DNA
taagctggtcatcatgaccgacagggcactacccaggtagggaaccgcccttaaaaaacccaggaagacacaaacaccctccacttagtgacatacatattttagcctagatttcagttacggagaggttactaactggtaaatacgaacacatattctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgcctcttctggccaatcagagaccgggccctgtcctcggacagcgaggcctccacggccagccaatcgagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgcccaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggaggatccctggcctctcaggctgtacgcgagaccc

SEQ ID NO: 1313 - DNA, 1277 bp, Patiria miniata
  source 1..1277: mol_type = unassigned DNA
gattagcgaacactaatatcctgccmtagacgtgattgctaatccgcaaaccaaccggatctacagcctgaacactgaactttaatcttcacccatgtcacatctggacactaggtttttgctctgtttgtgttttcctgcctttwcmttggawctttcgcmctggaatttatttgtcgcttggattattttttttctcacaatttggatctattttcgtttgttcacttcgaactctagctgccctttcttcggacactgaactttaatcttcgccatggctgtcagtcgccggttcacttgctgcggtgggatcctgttgtgataatccccgtgcattgcccatggatttatttccgccttagttgttcctaaccttggatttattgctgtgggtgatgcccgggttttgtttacatcgggatcccgctgcggctcggtgttccatgcgactggcagcccctttgtttactctsgactctattcattgttgtatttcttccacactggccagtgatcacactgctgtgtttcccgggaagatatcctctgcggttttcacgctctgggtgtctccccgggcaacgcactggttgcttgctgcgccatcacccttttcgtttatattcattttcagtctgccgttatcttggccagcgctcattcttttgtgatggccgtggactgaccctctgcggttttctgcggtcascactctcggtgaatgctgtgccaccatttttcatttgtttactttttcagctacaattatcctggccagctttcactcttttgtgatggccgtggacggaccctctgctggttttcacgctccgggtttgtctgcggtcagcacccttggtgagtgctggtcgtttgtttgctcattttgcttagttcaccattatctttmttctcttttgtwtggttttcctagcggttgtctgggagttgagctgcagttgtctggtcttggttttacccccatttgttttcttttaacgcggggcgtattgccttgaccggccgtctcagcttttctcctagagcaaccttccgttcatccaacttttagttttctcagttcttggccattccggttggttaatttttatttatacttaattttatgtttacattttctggttggagaccattttagcttgttttaatagcttttcttctttaattaataccctctgccattgagggtttttattactattaattttgtttactctttgtaacttgtttgattgaatattttaataaaccac

SEQ ID NO: 1314 - DNA, 346 bp, Phytophthora sojae
  source 1..346: mol_type = unassigned DNA
tgaagctgcacaagcgcgaggctcgacagctggaccttcagctgtcgagccactgcatccgcgccagccaccgcacctggggctggtactgccggcgccaccgcgaaggacaacggagcggcaacgcctcgcgagcgccgcgtgggtctggggggggcccgcggcgcacatcgcaggctcgggcacggcggtaagctggtcatttgaccaacagggcactacccaggtagggaaccgcccttcaaaaacccaggaagacacaaacaccctccctttagtgacatgcatattttagcctacatttcagttacggagaggttactaactggtaaacacgaacacacat

SEQ ID NO: 1315 - DNA, 159 bp, Pythium ultimum
  source 1..159: mol_type = unassigned DNA
tgatgcgggtcatattgaccgaaagggcaccatccacgtaggacaccgccctcaaaaacccagttcagtttattgacaccctccacttagtgacatgcatattcaaaccgatacatattcgttaggagaggttactaactggtaatatatcaccatttc

SEQ ID NO: 1316 - DNA, 371 bp, Strigamia maritima
  source 1..371: mol_type = unassigned DNA
tgatgggagagtgaggaatcttctccactgtgcaaaaccatacagtcagaagatgctaactactagtttgataccctgtgccccctgcaatgtcccgcgtgtcgtacccaagcccggctggcattgagacacattaggctctcgctcccccgtatactctcataatttcgtgtacgctaatcctaccctacccctccctttgaccactcacccaaccatgtgtatagctgtgctggtgatcccggggcggttattcactggttatcatatcattctaaaatgatctttgatctctcaattaacaactaacttatttctgtttgtttcattgtttcacctcgtaagaggaagttcattgtgcgataaatcaa

SEQ ID NO: 1317 - DNA, 317 bp, Strongylocentrotus purpuratus
  source 1..317: mol_type = unassigned DNA
tgacgaaatgttcaatatatgacattctaatgttcatgtattttttgtttgcttgacaaagctagatgaatatattccctgtcctactacatacatctcgatgtgcccttgctagacgatccattggtaaccatgatatcaatggattaacacatgatctgtaaacaatatatgatttacacaatgtatttattgtttcaataaatctgttcttttcactttaatacatgaaacatgactgtgccttctccaactggagacctacataatttgttaaaatgatataaatatttcgaagatgaaattattattaataa

SEQ ID NO: 1318 - DNA, 134 bp, Trichinella spiralis
  source 1..134: mol_type = unassigned DNA
tgatccgtcccgaaccaacggaaccacattgccgcatgacttcgatttcgcttttgctctttttgtatttaattttgctattaacaattcagtttgttaactgttttgtattcatttgaagatccaaataaaac

SEQ ID NO: 1319 - DNA, 394 bp, Chelonia mydas
  source 1..394: mol_type = unassigned DNA
tgagctggagtgccgatgagaagcgcagtcgggaaagtaactgaaatactttcctcatggattgtattttctaaatggacaacctacctaattctcaattactgagggacaatctccactcattgatatattttgctttccacaaccaaatctctgtacaacttttcatgagtgatgtacccgagtacttggattctaatatctaaactgtattgttaaatctattcacctaaatttgggttattgctgattatgtactctatgtatcatatgacttttaaaaacaaactttgtatttgtggataatctaagcactatacccagatgtacagacactcttttcccaacctatgtattatatttttttaacattagctttaataaaatttttaaa

SEQ ID NO: 1320 - DNA, 155 bp, Phytophthora capsici
  source 1..155: mol_type = unassigned DNA
taagctggtcatttgaccgacagggcactacccaggtagggaaccgcccttcagaaacccaggaagacacaaacaccctccctttagtgacatacatattttaggctacatttcagttacggagaggttactaactggtaaataaaaagcacttt

SEQ ID NO: 1321 - DNA, 1015 bp, Phytophthora infestans
  source 1..1015: mol_type = unassigned DNA
taggcggaaaccaggcccaagacggccgacagggccccacccaggtagggaaccgccctagaaacccatttcggtggtcgactcgaaggccttacctattttttccttagacattcaattaggtagcgaccaaattacaaatttggtaacgagtaagccaaatggtaatacacaaaacttttctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggctgtcggatttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcgacttcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgaacgcggccccatacttgatctaagtatgggagggatccctggcctctcaggctgtacgcgagacccgtacggccgaatcccctggcctctcagcctgtacgcggggc

SEQ ID NO: 1322 - DNA, 380 bp, Phytophthora ramorum
  source 1..380: mol_type = unassigned DNA
tgagcaccttgggttgctcaagcgtgatgcgaagcggctggaccggcagctctcggtggcgtgcatccagtccagccgccgcatctggaacctgcactgcagccagcaccgcgcgcgccagcaccaagcaccagggggaagtcgggcggcggagaccggggggactccgccgcgcaccggccgccgctagacggcacacaggcccacagcggccgacagggccacacccaggtagggaaccgccctcaaaccccgccggtacattatggtccgacacctatgaggtgcaacctgtacacaagttacacaccacatagcgactaccaggtatttactacctggaagccaaggattaaccggtcggtaatacacataacttt

SEQ ID NO: 1323 - DNA, 210 bp, Pythium ultimum
  source 1..210: mol_type = unassigned DNA
taagcggggggtccagaccccacaagagagaagcaggaatcatggtccgcatggaccagtagggcacgctccacaaaggttatcgccctcaaacccatcacacgaaggatctaaaaagaaagcaacaatcgaaatagtaaatagtaaatagcttagaaaggtcaacatgcgaaatgcatgaggaacgtaagatggtaatacatttttata

SEQ ID NO: 1324 - DNA, 1098 bp, Phytophthora infestans
  source 1..1098: mol_type = unassigned DNA
tagacggcaaagttctggcccgcgtaggccgaaagggccccgcccaggtagggtaacgccctcgggaaaaccattctggtgtttggctgtttttcaacagtcgaacttcaactcggagcatatcagatacacttactcacacatttagatatcagatagggaacctttattagggagataacgggtacaccggatggtaaatatacaaaaccttctctgttctaatcagtgtgaaaactggttttcgccttttggcggactttttcactcgcatttttgggcaatcgtctgcggctagcttgctagcggcggacgagcggtctccgggggcgttcacctttcccccgcgaggccaactacaccgatcttctctacacttttctaattcgcctccgtcttcggtcttcggttgtcgggcttttttctttttgaccaatcagagcgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggggtttacacttttgcccccgtttcggcttcaacttcaggccaaaatggcgatttggaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgacctaagtatgggaggatccctggcctctcaggctgtacgcgrggaccaagtacagccgaatccctggcctctcagcctgtacgcggggctatacttggtctaagtatgccccggtcgctggcctctgagcccgtacgc

SEQ ID NO: 1325 - DNA, 242 bp, Phytophthora ramorum
  source 1..242: mol_type = unassigned DNA
tagacggcaacactctggcccgcgtcggccgaaagggccccacccacgtagggaaccgccctcgggaaacccagtctggtgttcggccaagaaatgcaccaccaccacggcggaggtgcatttcgacagtcgaacttcaacccgccacatatcggatatagttacagctctagttagacatcggataggaacttcttagaaaattaacgggtataccggatggtaaataaaataaaaacttc

SEQ ID NO: 1326 - DNA, 1036 bp, Phytophthora infestans
  source 1..1036: mol_type = unassigned DNA
taaacgggtcacttgaccgacagggcaccacccaggtagggaaccgccctttaaaacccaggaagacacaaacaccctccacatagtgacatacatattttagcctagatttcagttacggagaggttactaactggtacataaaattacacattctgttctaatcagtgtgaaaactggttttcgccttttggcggactttttcactcgcatttttgggcaatcgtctgcggctagcttgctagcggcggacgagcggtctccgggggcgtacacctttcccccgcgaggccaactacaccgatcttctctacacttttctaattcgccttcgtcttcggtcttcggctgtcggatttttttctttttgaccaatcagagtgcgccatgcgactcttctggccaatcagagaccgggccctgtcctcggacagcgaggcctccacggccagccaatcaagtctcggcagcgacgcgtctttctatagcgcagctgacgaggccgatctggcggcccccgattggtccgactttcggccaatcagcgacgacgagggggcaggagtttacacttttgcccccgtttcgacatcaacttcaggccaaaatggcgatttcgaccctccacgcgccgtgccactgctcggcaccggcggcgattcagcgggtgcaacttcgggcacgtgtgcaacacatgcagcgcccattgcacgccaagcggcatcgcgggacgacgcctcggccgctcaagcgcagccccgcccttccagcacgacctcgcgccgtttggcggatcgccatcaagacgtgcgagagccaggcggggtcgggcaaaatatacttactctaagtatgcccgaatccctgccctctcaggctgtacgcggccccatacttgatctaagtatgggaggatccctggcctctcaggctgtacgcgagacccgtacggccgaatccctggcttctcagcctgtacgcggggctatacttggtctaagtatgccccggtcgctggcctctgagcccgtacaca

SEQ ID NO: 1327 - DNA, 193 bp, Phytophthora ramorum
  source 1..193: mol_type = unassigned DNA
tagacggcacacaggcccacagcggccgacagggccacacccaggtagggaaccgccttcaaacccggccggtacattatggtccgacacctatgaggtgcaaccggtacacaagttacacaccacatagcgactaccaggtatttactacctggaagccaaggattaaccggtcggtaatacacataacttt

SEQ ID NO: 1328 - DNA, 1063 bp, Phytophthora infestans
  source 1..1063: mol_type = unassigned DNA
tgacgcaccgtgacatagtgcggcacgtgaagatgcacatgaagctccgacactgggccaagtgggcggccatgcgcgaccaaggcaagacagctcgtgcacatggtggggttggtagtggcttcctcacacggccgcgaggcctgtgggaagccgactaccggttcgcggtggccggccgcttaaaccaggtagacacgcacagtgtcctcaagcgccggcgcctccgagcacatgacaggtgcagacacccaggatgcacgcgctccgagacgctggcgcatgtgcttaaccactgcgacggaaccatggacgcagtccgtggccggccatgacgccgcactcaagattattgagcgtgcgctcctcgcatcgtcggccgaccagcaggaccgtgctgagctccgcgtgaaccagaccgtgccgtcactcgccggccccgcgctacggcccgaccttcagctctacaaccacaccaagaagacggtggcggtggtcgacctggccgtggcgttgaggagcaggcgagtgacgacgcgagtagctcggcactgtcccggatcgccaaccacaagcgagccaagtacgaccacatcaagctacacctcgagcgccaaggatggaaggtacacctctcggcactcgtgtacgggtcgcttggggcggtcgctagtggcaactaccaggtgtacaccacacacctggggctactcaagcgcgatgcaaagcggctggaccggcagctgtctgcctaatgcatccagtccagccgccgcatctagaatctacactgcagccagcaccggactcgccaacaccaggcgaggcccagccaaggaccaagaggcagccgggcgacggagaccggggggactccgtcccagacaagccgccgctaggcggaaaccaggcccaagacggccgacagggccccacccaggtagggaaccgccctagaaacccatttcggtggtcgactcgcaagccttacctatattttagacgtagcgaccaaattacaaatttggtaacgagtaagccaaatggtaatacacaaaacttt

SEQ ID NO: 1329 - DNA, 415 bp, Phytophthora ramorum
  source 1..415: mol_type = unassigned DNA
tgatgcccgccaactacaaggtgcttactgagcaccttgggctgctcaagcgtgatgcgaagcggctggaccggcagctgtcggtggcgtgcatccagtccagccgccgcatctggaacctgcactgcgcgcagcatcgagcacggcagcaccagggccaagcgccaaggggcagtcgggcggcggagaccggggggactccgccacagagcggccgccgctaagcggacatcgggcccgtagcggccgacagggccacacccatgtagggaaccgccctctaaacccgcccggtacattatggtccgacacctatgaggtgcaaccggtacacaagttacacaccacatagcgactaccaggtatttactacctggaagccaaggattaaccggtcggtaatacacataacttt

SEQ ID NO: 1330 - DNA, 1562 bp, Ciona intestinalis
  source 1..1562: mol_type = unassigned DNA
tagccaaaagatttggtgttcttggcgagctgcagtcccggcagagtaggcgagatcgtgagctctacaccgcttcacgatttgacgagttcttcttgagtcgatccccaacggcaacgcactccaaatttaacgaccgcatggcgacgccactgatctcccagtcatccgtgctccgagggcacttaaggggaaccgattcactgatgctgcaagttggcgggggcgcactcaccaatggaagatgagggagcccaacgatgccccgaactaccgcaccgtccccagcaccgtgtccttgtgagtaattattttcactaatccagggacggggccatgaactgaactatgtctgcacgctgccccgcctagcctcggccacaaataaatagtcaagccggggcgtactaccaattgattcggatttggcggggcccatcacgcgcctccgcccccacacacaaaaacacttttaaactcttcggttccccaaccactacaacaaagcgagcggcccctcttagatccaattttaaaattttaaatcagtgcactcaacttttttacgtgttgtgttttttgtattttttcccacagattttgtatttttatattatattttatatacacaacactatttttatacactaccttgcactgtcccactttttgtaattatcaccttttaccttttatgccgctcgctgagctccttgcacggatgaccagacaaacttttataaaattataacattgttttaattgtcgcggggtatcagtggcgcccccttgcggccgtgaaagcccttttcaccttaattcgccccttagtccaaatttttccccattgcctgtaaaagtgcgttgccgtcgactcgaactcgtcctttttaccgcctctctgttactgaactatgaccagcttggctgttgaagtcggctttaattcgccggcttcacattatatttttttgttgggtaatctgttttttttcatatataaaaccattcggcttaaaatcaccaatccccatcatccaccctggtcacccattgaaacatctctttttagtcaattattttttcagattacccctcccaaattgtcatatagtttaacaccccgtttgccaagttggtcttttccccatccccttctgtccttccggtaatcccataacattttattctttaattcggccccataaatagtgtaatcttaagacgaagtccccagaggcccggtcccccccttctttgtcatggaccgggccagcccccctgttaccacaacaacccaccattttattctttctttctttttattagtatttatttatattgccgcccaactgtcgtgtcgtggcgcaggggggttccctctgtcggcccagtggacgaccgtctaaaaaacaggcacaggcagcaggcacttatcacccggtacctccgggtaccggaggctggttttcagcgcactgtacgtgatggccaattttattcattgcattttatccgcgtcgtggtgtttgcgtggatgcattaataaaagatgaaattcc

SEQ ID NO: 1331 - DNA, 602 bp, Schistosoma mansoni
  source 1..602: mol_type = unassigned DNA
taacggctgaacgaatagcccccttcactcttagacattcccccactgttgttgcttatcttcatgctcttgtgttaattgactgctctcttctgggttgacgtctgattgtctctctctctttccatattgcttgctctgcccgcttacttccaatagttgtcatattatgtctttgtttacttgccatgtctaacgacaattactttatctaccttagtttgtcctcttggtttcgattgccttcatatgttcatggcggaatctgatgtttataatgactattcctattaccaccactacaactactattattattttcattactattaacattattataaacattattactattattattattactattattacttctacaattaatattatggctactcctctcagcacaccaataaaatatcaatcaaacatctcaattatatccacctattaaactctctctatttcccctgagttataaacttacaattcagtctaaccgaatatctctcttttacaaatcttaagtatgtaattttgtgccaaacccatttgggtctgtacaatttgatacttaaaaataaatgttattagcc

SEQ ID NO: 1332 - DNA, 90 bp, Bombus terrestris
  source 1..90: mol_type = unassigned DNA
tgaaaacacgataacgattatgaatcaaaataagaaagtaaacatcccagaaattgtctacgtcttatttgttatctatttatttgttta

SEQ ID NO: 1333 - DNA, 1815 bp, Crocodylus porosus
  source 1..1815: mol_type = unassigned DNA
tgaatcccactctggggacccccaaaaattagaaaaacccaaaacagttgtgtttaagtgtgttcttgtttgtccctttggcttcacctccaagttgcgatcccccatctcccctgcgctgtctttctgaatgaccagtggtgttgaggctggtgtgacctcggtcacctccaaggccaagtgccctggccccgagtaggaccaggtggcccagcttgctgggcacccgtcaccgcccagggcaaatggaagggatctatcctgaccactaccaggctaagtgtggtgctgcctagcctgccgtaaggtcaagcgccctgctgccgctcgggtakcagtcctcgttcactcgtccctcctagtaccctccgcmtctgcgcttctgctatccactgtggccggwgatgccgaggwtgswmcawcctcgacacctccagggccaagcgccttggccmcaggtaggacctggcacctgcccagggggccagacactgcctgcggcaagggaaagggagccgtccctgaccgttaccgggcttgatggtgctggctagcccgccgtatgtcaagcactccacagctgctcgagttcgctggcttcaccttcatcccwcctagtgccttccgcctctgcgctattttcgtcccgactcgtacctccccacctctgcgctacmgctatccctgmaaggaccaagtgggcaggggsgttcgccccccgcccgcaggaggctcggcgtatccgtggcktcwtgcctccaccgtcttgtgccgctagaggggtacctcmgagaccggcgcaacacgaccttgacgsttagacagtagggtgmaacakccctgctgcaggcstgaagggccaaacggctgtgccatgagaggggaaccttgaagaccgggscagtcagccagttagtcagttgggcgaaacaatcccagctgcaggcccammagggctgtcaggtgagggggtatccccawccaccccccgccgccgactacggaggcakgaagtccctagtgacttckgacccccacgtcttgtgccgggagaggggaaccttgaagatcggggcaagccgcacttgatagttagccagtckggtgaaacaatcccagctgcgggtccgaaagggccgactwccaggcgaggggggcctgcggaaamccccctccatggtacggagktctggcgtcctmaccgacwccttgccaccaacgtcttgtgccgggagaggggaaccttgaagatcgggscaagctgcacttgatggttagtcagtcgggtgaaataatcccagcwgcccccgctgtgactgctaagmcwggtccccaaggggcatgaggcatstgcgctgagccggsaggggtgacacmcggcgatcggcgcagcacakastgaagggaggcacttgctgagactgcttctgaggccccagacttggggtggtgcagccttgtctggggtatggtacagcaccctactgctccctttggkcagcagaattcgtcccgacctcttacccacccgagtctgcgccttgttccgctatcctgcatctccgatccacctcgctgtctccccgctgcgctgcttttctctcaagtgggttaaatcttgtcatgattacctcccacgtttccgctcaagggcaatgcccaamatgacggggatcgctggtgcatggcagtcatgagaccatccggaccctccggtggtcgctatagtcattttktgttgcatggggcatsctgagtcacttaaccgaaagactcwaaataactcaaaagaggkamcctctgsggttcggtaaa

SEQ ID NO: 1334 - DNA, 236 bp, Drosophila willistoni
  source 1..236: mol_type = unassigned DNA
tagatgtactaacctctagcttttcttatacttttgcctgctaccttggcattacatctaaaaaggtacaaacatcgcattgtcataaagaggtggttttagtacgtaggcgctgtgggacttcattgtcccggtgatgcagtgaatcgtgcatacgagattgtccagtagttggttgctcgtatctttagaagatttccttcctcggcgatcaaaaaaaaaaaaaaaaaaaaaaa

SEQ ID NO: 1335 - DNA, 2018 bp, Gavialis gangeticus
  source 1..2018: mol_type = unassigned DNA
tgagaagttgcgagttcttatgcaagttgaataccactctkgkgaccccaaaaaawwaaaccccaaaacagttgtgtttaagtgtgttcttgttcgtccctttggcttcacctcsaagttgcgatccccccatctcccctgcgctgcctttcagaacggccggtggtgtcgaggctggcgcgacctcggtcacctccaaggccaagtgccctggccccgagtaggactgagtggcccagctcgctgggcacccgtcaccatctggggcaaatggaagggatctgtcctgaccactaccaggctaagtgtggtgcggcctagcctgccgtaaggtcaagcgccctgctgccactcaggtatcagtcctcgttcacttgtccctcctagtaccctctgcctctgctcttttgctatccactatggccagtgatgttgaggttggtgcatccttggtcacctccagggccaagcgccttggccacaggtaggacctggcacctgcccagggggccagacactgcctgtggcaagggaaagggagccgtccctgaccgttaccaggcttgagatggtgctggctagcccaccatatgtcaagcactccacagctgcttgagtttgttggcttcaccttcatcccacctagtgtcttctgcctctgcactattttcatcccaactcgtacctccccatctctgcgctcctgctatccctgcaaggaccaagtaggcaggggggttcatccccctacctgcaggagactcagcatatccatgacttcttgcctccaccgtcttgtggcgctagaggggtacctcagagaccggcacaacatgaccttgacggttagacagtagggtcaaacaaccctgctgcaggcccaaagggccaacagctgtgccacgagaggggaaccttgaagactggggcagtctgaccatgctggttagtcagttgggtgaaataatcccagctgcaggcccaaaagggctgacagtcaggtgagggggtatctccatctgctccccactgccaactacggaggcatgaagtccgtagtgacttctgacccccacgtcttgtgccatgagaagggaaccttgaagattgggacaaaccgcacttgaaagttactcagccgggtgaaaataagtcccagttgcgggcccctcggggctgacagtcaggtgaggagggctgcaaagcccatctcctgactccagaggcctggcgtcctaaccgacttcttgccaccaatgtcttgcgccaggagagggcaaccttgaagatcggggcaagccgcacttgatagttagccagtcgagtgaaacaatctcagctgcgggtccgaaaggactgacttccaggcgaggggggggcctgcggaaaaccccctccatggtacggaggtctggcatcctaaccgacaccttgccaccaatgtcttgtgccaggagaggggaaccttgaagactggggcaagccgcagttgatggttagtcagtcgggtgaaataatcccggctgcaccctgctgtgactgctaagcccggtccccaaggggcatgaggcatgtgcgctgagacgggaggggtgacatctggcgatcagcacagcacagactgaagggaggcacttgccgagaatgcttctgaggccccagacttggggtggtgcagctttgtctcgtgtatagtacagcaccctactgctccctttgggcagcagaatttgtcctgacctcttacccacccgagtctgcgcttttgttccacctcgctgtctccctgctgtgctgtttttctctcaagtgggttaaatctcaacatgattatctcccacgtttccgctcaagggcaatgcccaacatgacggagatcgttggtgcatggtagtcacgagaccatccggaccctccagtggtcgctatagtcattttgtgttgcatggggcatgctgagtcacttaaccgaaagactgtaaataactcaaaagaggtaccctccggggttcggtaaa

SEQ ID NO: 1336 - DNA, 437 bp, Ixodes scapularis
  source 1..437: mol_type = unassigned DNA
tagtgtgacggagtcctcaagcccccacaagtgcctgccaggtggcaggaaagggcaactactggtgagcgacccaagcaaggcggagccaagaccaagctggagccaagagcaactccaggaggcaggggtggatatcaagagcaaccccaagggacacagaccacgggcaactactggtgagcgcccaagacaggggtggatattaagaacagccccacaaagtgttacctatattaacaataaagttgaagcctcaaccacgcattgcgggttagatggcgtggcttggcccgccgccatgatgagctggaaccctccacctggtgggccgcacgagaccaccggctctttctactaaggccggtctccgtgactgcggttgggataaactccaagcactgagcggtaaaaaaaaaaaaaaaaaaaaaaaaaaa

SEQ ID NO: 1337 - DNA, 970 bp, Mnemiopsis leidyi
  source 1..970: mol_type = unassigned DNA
tagtgacgagaaaagtcgctttatccttacataacagtgtgatagtcatccttatcacaactgtcctggcgaacaaaatggcagagggatagtactcggtccaaccagaaggaagcccacacgatgccaaacttgctgtaacccacgtgagcggaaaacatcctccgagtatagtatgatggaaggatacaggatgtggaccgctctaggcggcggacggtgtagacggcgaccttaccatagctgcgactgctgtgcgatccggaacgggcctttctcacttacctcaagcaccgtgtcggatcgcggggtgggcgcgggattcctgctgggaagttgtctgcacccaagtcgtcagctaactgtcggtacttatacgcacccagagccatgctcttaccaggccacttgacggcgctacaccggtctgtaggagggtatctcagcgacttggacaaaatggatcttgactgcctgagggcgcttatcgagtgacccagagtaagctggtaggaagaatcttgcagttgagagggctagtagggccagcctctgctcgtcaactgtcctaggcgttaacgtgtgcctccctatgaggtaaccgtgaagtattacttgtttccctgtagagaccatataactagctgagaaacgccctgcgggttaatatacagttaccgccgtcctgcatccccgagttgtgaccagcgtacagccatgtaccacggcacttccagcattctctggtctaagaatgtatcagctggcccgccgaaagatagagcgaccccgcctctatcactagagtaagcaggcacgcgaaatatatgcaggacgccttggctcagtagctctggtactgagtatagcatggctgaacgcccctttaagttcggtggcccagagactctccgagacttcccagtcctggagagggtacacctttaccagaactttctgtggtcggttg

SEQ ID NO: 1338 - DNA, 153 bp, Petromyzon marinus
  source 1..153: mol_type = unassigned DNA
taatttaaggtaaaatcgtgggattgttttgatggcaatctgcctagtcgcggccttccattttgggtaggcagcagacccatctatataacaaactactttgcctttcataggggtacccgaccctaccaactttcggggaagtaaaagaaa

SEQ ID NO: 1339 - DNA, 1231 bp, Schmidtea mediterranea
  source 1..1231: mol_type = unassigned DNA
  misc_difference 260: note = a, c, t, g, unknown or other
  misc_difference 446: note = a, c, t, g, unknown or other
ggccacgcgcgtcgtccttgtttgatcactagtggatcaaccttcgactccccggaactgtgggagtggcggaagaaaggccagaggatgtcctgaaaccatatatttatttatagaagttttacttcatcctatttacgtatttcagtatgaaaatgagtaaagttctcgactcgatgagttgggggcaaccattgggggtcctgaagagaggctctcactgtaaaaaatctcttcgtgtctgtttattcctaggcacntgctgcattatgaagcggwgaaagtaaagttagagctgagagataggtacttgctgcattatgaagcggagaaaggcctcgaataaatagggtgttagagttattgatggagagtatactagtaagcttaagctgcgcctcgcgcggtgcccaaaaatatacttaatgagagcaataactcaaggngagtttaattcatatgcgcatgcggcaccaaggtgctgaatggcatcgattaaacctctcctgttgtagaagcaggtcataaatggaggrgggcaaccactgaaacttatgagccagaagaagcttaactacawaagttttaggcaattactgaacggagttaactgttagttaacactaccatgtagttgtttataaagcaaatatcaggtttcagtctatatactaaaagtattttttgataccgtggtatataggcaactagttaggaaatagtaagggatgacgcattgtctctctttatggtactgaggaaacttatcgactcgcgagggatgaaacccgtaaaccgatcgatytagcctataagtaccagcgacagttaaaccatcttacgcgaggggtaaaacctgaggaccgattatggtataacttctcaagattagcacaaaatgcgagtgcaacttgaggaggaggatttgagtgttaattcataatgtactaatctaattaaactgtgacgggaattgcagcttcggctgtaattactttgaggcctatcacggattgtaaggaacatattgacaccgtaagtctaacgtgttcccgatttccaaccaggtcatatgaagggctgcccttgataaggcggatttgacccaattcttcatatgagaggcttattccagccttcccgtagtaccgtgaggttttcccgcctcgaacggaacaatgttgcagggtaattaagtacatcgggctatatmgcgatatttaacgtttta

SEQ ID NO: 1340 - DNA, 813 bp, Strongylocentrotus purpuratus
  source 1..813: mol_type = unassigned DNA
taaaccttgcctccccgggcccccctcagtgactaagacaactttcaccgtaataatcatatatttgtataccatgtattaatctaggtaacaattgaaagtaacattgaaccgtattcatactttaatgagtacaatagtgaagggaactgtatattacatacctcgagatagaggtttttgtaccttaagggttcgtgagaatccatactgcataaaggggttaacttgtaactcaaccccagggagacaagccgacaaattcggcattactatgtgagggtcataagtgttaaaggacccattgtatataacttgtaaatgtacagagaattcgagttgagttcgaagaataaacaaacaaaaaagaaaacaaagagaattcgttcgtccatagaagcggaaaaagcgcaaaaaggcgtcctaacctcacggtctaacccagaaacatttaaggggggaaggagctcattactccaatccaaaaccacgttccctagcccaaaagcgcgcttcaatgagggagccgatattggaggacagagttcatcaaaagccacctgtaagtaggcccatttctgccaaggacatgcgcaaaaggaagcagattatcaaaccagtcaaacaagcacaaacattggggggatgggataaccccggaaagagagggatctttagatagtggatggaaggggtgggacgttgaatccaaccatgccgtttttatgttcccgataaagaaggataaggtcactccagcctgacacacaaagtggggtaaaagaactccgctcgtacggactccaaatagaa

SEQ ID NO: 1341 - DNA, 2663 bp, Salmo salar
  source 1..2663: mol_type = unassigned DNA
tagatccgtttgttatgattggagggagcctgccgagtggtatgagcgctccaactattgaacccatatgattcccgaggcctggccagacgcctagatgcctgccacaattgaacgcagccctagcttgctaggagatccataggaactggcctatggggcgtcatgacggttgaagttcctccatagcgtgcttgggaggggacgacaatgacgagtcatgacgtaccgagagaaccccaacccaggttgggggagagagccagcaagagcggagatgcttggtataccaagctagcagagagagggttgaagaggatgactactgggctcagagtcatctcaccctaaaaggcggtggggcatcggttgaacacctacccataccgggatgggaggtggtaggccgaaaaagaacaggaagatggtggagtaagttgagagcggttgctcgggaagttatgttgtgataactccattaaggccggtgggcatggtgcggataatggaaactataaaaacaataaaaagaaagaccaaaaaaatgttctgttatgatgccttacacatgtctgggagaccccataagggtctccccttatacttcactgggaaaccccataagggtatccccctatatttactgggagaccccataagggtctccccctatagatgtagagcgtaaggggtctccaaagtaccggccgatatggccttatggcaaactctggtggtagggacaaggaggtaagggcagtgccaacccctacttgatcgggaccatccagggaatgccatcctcccgcgaaggtgatgtggtgaggtaaggggggagcccgtcttcgagtttccccaacccctacccacaggtgagaggaggagaagaggaatctgtccccaacgggaggagggtgaggtgtaagggggagaccttctagtagggtcttctcagtcgcctgacgtcctgactgtggggtggatcagtaccctacaggtgagaccggtgaggtaagggtgtggccctcttgagggctgcgccaacccctactcgaggtaacctgagggagtggtggaatggcggcatgttagtgctgggacttgattgcgagggtttaatgagagtggcctgctgagagcaacacttgtggtgcttaaagcggggcggcccatgaccaccgtgagataggacactgcacagtgcagccatgaggttcctggaggatgatgcgatgaggtgggggcctcatcagcccctcctggcagggcgtcggccagggaaactaaatgtctctagcatgtcagtgcagtgaggtaaggggagagcactctagtagggctcttccaacccctacctgtaggtcacctggtccaggtgtcgatgatgtgaaaacaagagctactttggtaccggtctgttgcaaaaagggttctgcagaggacgacggctatccctatcgggagggaatagtcggtcccaggtagtggaaaatggggctttccactgagcatgaaaatgtggtagaggttgcgtccaacccaatgatttgcagcagagctcttggacacgaagtctgtatagtcccatgcaggcagccaaccagagaatggtggcaagaccccagctccgtatgggaggggagggccaagatatacggaacggctgctaaagcgttctgccggtgtcagtctaatcacagacagctgtgacgaaacaaagtatgggttccgacatgcttggtcagctcttagccgcaaggcttaaatcgaacgcagcccgccgagagtgaacattaaacggggatggaatgtgtctagcggttacgtactaccagggctcaggttcgcctgagccgaggctctacacgtcatggtgggagttctccccacgctcgtgagggcatgtagtgggatggcatgtggcggaccatcagctggcactaccaggcctcgggcttgcccgagtgcgggacctcacacattgtaggtgtgcttgtcccccctacgttcgaagacttgaggcggagaatactcataggccccacggcaaagggacacaacacggaggcttgtgtccgacgagccgtggactcctatagacagcccgggatatcactgggcacgctcatactgaagaaattcgatgaaccgggcctaccggagcaaatgcactctaatcgcctttgtgggcgactgtggccccctcatgcgagtgaggaatatcataaactgcaatggttcaaaaagtgattcctatggctcgtcggggagggctgactggggcaagcaaatgattgaaaggggaagaacctttttcaactgtttcttgccaagcccggttgatggtggcgctagtaattgcgacgggaaaatgcggtttaagtctccgaagtagtgcgtagcaccggatgtcgaccgggtgtaaaagcccttcgtaaagtccctggggaggtcagtcctggggctactgatgcgcagtatgtaattcgcagaatagggccatcgataccgcctgcgtgactcgactgggtttccacttgaggatatccgaccgtagcgtgcaccctcttgtagttgcgccggaaacggctgtgttccctcacgtatgtgaggaaactcaacaatgtgagtgggtaaacggcgggacgaactatggctctcgt

SEQ ID NO: 1342 - DNA, 155 bp, Tribolium castaneum
  source 1..155: mol_type = unassigned DNA
tgaaaagagtggcagttgtggagacttccttcggacgtcgggtcggattttcggacgccagggtacctccaccgctgggttcacaaactaggcgaacatctgccgataccctctttaggtcataggaccacatgtctctgcacgagattaaccca

SEQ ID NO: 1343 - DNA, 398 bp, Tinamus guttatus
  source 1..398: mol_type = unassigned DNA
  misc_difference 100: note = a, c, t, g, unknown or other
tagggggcttggcatttctcattgcctgctcctgaaaggatatgggtcctgcgtcgcgtggtaggcagacccattcgtccgagtagggggcttggcagtntccattgcctgtgcccgaaaggacgtgggtcatctggtctgtctgcctacacctctctagacttgtaacatctagtctgtcaacaagatcaaaattcttcacacagacgaccgagcttgctcagtcttcctgtacccgcagaattttgctcttgctctcctttggctgtgtcctggacgtgggactattccatctcgtcccaaatgccgcgtccaattataccggatttgacaaagcggacggcccgctttataagccggaaaaggtgccttgtaaaattgcaaggttcattaaatag

SEQ ID NO: 1344 - DNA, 304 bp, Trichinella spiralis
  source 1..304: mol_type = unassigned DNA
tgaggtttttgttttcttttttccttttaccattcttgttccattgttgttatttgctttaatcctgtattttaccgccggcaattccattgttattattactgttactgttattattgttactattgtttttacttttacttactactgttattatactttaattcgttaacttacgttattgttaccactacttactttgctctctcgcaaacgttcgttgttgtttcttttggaccaggtttagagaaatcgcacgcacagcggaactggaccgcttaagccagaaatagtaaagtaacaa

SEQ ID NO: 1345 - DNA, 155 bp, Tetranychus urticae
  source 1..155: mol_type = unassigned DNA
tgatgtatcccttcaatatattgtaatcctcattcgtccctatcctttcatttgataaaagaaactttgttgctccttttaatagttggtccctcctgtcccttttctggaacctggttgtatcgattattgaaagttgcaataaacggatttaa

SEQ ID NO: 1346 - DNA, 235 bp, Drosophila willistoni
  source 1..235: mol_type = unassigned DNA
  misc_difference 217: note = a, c, t, g, unknown or other
tagatgtactaacctctagtttctctatacttttgcctgctaccttggcattacatctaaaaaggtacaaacatcgcattggcaaaaagaggtggttttagtacataggcgctgtgggacttcattgtcccgatgatgcagcgaatcgtgcatacgagattgtccagtagttggttgctcgtatctttagaagatttccttcctcggcgatcaaaanaaaaaaaaaaaaaaaaaa

SEQ ID NO: 1347 - DNA, 162 bp, Petromyzon marinus
  source 1..162: mol_type = unassigned DNA
tgagaataatgaggtgctaacctccctgggcctgaccaaacccagaacacatcactggccaagatgatttcccgcagcacgttgcttttctctctcgatacccgagaatgttctgcggaactacgcagtctatgaacagtcacagacaacctctgatccaag

SEQ ID NO: 1348 - DNA, 257 bp, Schmidtea mediterranea
  source 1..257: mol_type = unassigned DNA
tagaagggaaacaaaggaaaaacgaaatgactggaaactatgaaggatatagctgaaagccgcaaggaaggctaagtcctgaaaccgatctacatcttcgatcccaagaggaactgtgggttaagcttgagccgacggaaaaagcgaatgcatgttagacgacgaggtacagtcacctcctcgtggtatttggcgggcaatgctcactaaattaactgtgagtagctgagaactgtatgtgtatcatgaaaaaaaaa

SEQ ID NO: 1349 - DNA, 233 bp, Tribolium castaneum
  source 1..233: mol_type = unassigned DNA
tgatgctcctttggttttaccatctgtgggggcatcggtcctcacggtttcctcgggtttcctattgtttttcctaaacccgacaaggagccctttggccctcctccttaaacacctctccttcatcctsttagtccattccggctaaaatgatgaagaccgaggagtgtcactctcttggcggggttaacccgtccaagtgtaaatgtgacctcgccattcgggctctgata

SEQ ID NO: 1350 - DNA, 214 bp, Megachile rotundata
  source 1..214: mol_type = unassigned DNA
taaatgtcgaaccgaattttgggtaacgtgcaccccaccatccttaatcggcagcacgcaataaagccgtgggcagtggttttagtgggtagtcattaggagtcccacagtacccagcgaacatcttagtgggtctgcgtaaacgcatttccactgcctatcctccgggaaaaaaaaaaaaaaaaaaaaaaaaaaaaaaaaaaaaaaaaaaaaa

SEQ ID NO: 1351 - DNA, 508 bp, Apis mellifera
  source 1..508: mol_type = unassigned DNA
tgatcgttaaaagtaaaaatctatttatttatttttattcctatattataacacattatttatttatttacttattgttttaaagatgacgaagccgcaaggccaatccaaatttaacaaaagaacgagactactggtcgacattaaaaagacgaagcagctgccagctgataaacaacagagcccgtctcggcctttacaccgagcggtgcaagtcctgacgtactattgtacgtctagggcgcggggcagattctaccgtgtagaatctggggcgacgcctccgcgaggcactccctggacaacgtacgctaaagcgtacggctaagtgcgcctcccgaaagggtccccgttcctaatttttccgagcccgcgggcagatctcgtggcagtgacgctagaaagttaagtccgcggacatataaaattacagccttaaataatgaaccccacgaaggaggtatcctcgaaattccgccacgatccttctgatcgtaggcgcaaaaca

SEQ ID NO: 1352 - DNA, 696 bp, unidentified
  source 1..696: mol_type = unassigned DNA; note = Description of Unknown:Nasonia vitripennis sequence
tgacctgaacaaaacgtgttgtcttgtcttgtctaaaactatttattcgaaataaggggaggctaactgcctgcaagttgaacgcgaaagttagaccttcccacctaaagcccaaaagtgatcggggaatgaatccgcgggtgaccccagagttgggtaaacccttgaaacgttggagaagcggaagagagtcccgccaccgagcatcgagtgctgcggcgcccgaatgaaaccgatcgcggatggtgcaagtcgtaggacggggcacgacctaagcctctgtcacggcggcgaagccaggaatcaccatgcaaaggtgtgaactggggcggatacctccacggggtttccctgggcatcgcgcgagcgatggccaaagtccgctttctcagctacaaaacaaaaatggtatgagacttcgttaacactaatttttccgagcctagcaggctcccttgacaacgcttatgaatctggaaaaggacacaaagtggaaaaagcgctgatggtggacaaaagtcagttgagacttgatatcagttgttttgactaagaattttattatcgttgacttttaaatattttattattgactgttaatatactgacttgggaccaagtcatctctgttacccggtaccggttcctgtcatcaaaccggaaagtccgtcccacgtaatgtggtagacgcaggag

SEQ ID NO: 1353 - DNA, 122 bp, Ciona intestinalis
  source 1..122: mol_type = unassigned DNA
tgacagtaatatgaaaacatcacatctgaccggcacagaatcaccatgccgtaatgcacccaactaaggattccaatgggtaaaaaaaaaaaaaaaaaaaaaaaaaaaaaaaaaaaaaaaaa

SEQ ID NO: 1354 - DNA, 112 bp, Nasonia giraulti
  source 1..112: mol_type = unassigned DNA
tagcggactggactgtctggaggagtgtttaactcgggttctcatgggaacccgacaacgttgttatcttgtatgacaattcataaaaaaaaaaaaaaaaaaaaaaaaaaaa

SEQ ID NO: 1355 - DNA, 345 bp, Lepidurus arcticus
  source 1..345: mol_type = unassigned DNA
tgataatcgctccatcctgcaactaattatgaatgcaaatctgttaagtgacattagtgatacttacctgatacttaccctggtatttatttgacctatacttaccctggtatctacctgacatatatttatctaaccacctacctatgatgactcccgcggaaactctcacttaccttattacccacttggtcttttattttctcgttccttattactttgttcctttggtgtagggttctctggtttttggaacggcttccttagccggaattttgtctgatgtatcttgcttgtgtccttgaaatatacgacccaggcttgcgtcatttaggctctgggaaa

SEQ ID NO: 1356 - DNA, 380 bp, Lepidurus couesii
  source 1..380: mol_type = unassigned DNA
tagtgcttgagtgatgcctatcctttctttgattaactcttaccatatacttaccagttcttacccgtacttaccctgtatacttacctgtgtgcgtacctgtgtacttgtcctttagccgccttgtgtttttaccattggtacttaccttgtgtggttgcccgatacttaccttgtatttgccttgtaattctgcatgatatttattgtgtaggttcctgatgcttacctgatttgtccccctcatcatctttagtttcgttctatttcactccattatggagttccgtttgttttttggtggaggtacagcaccctttaagctggaattgagtgagtttatgtactttggatggttgtaataaactacccggaggcat

SEQ ID NO: 1357 - DNA, 345 bp, Lepidurus couesii; identical to SEQ ID NO: 1355
  source 1..345: mol_type = unassigned DNA

SEQ ID NO: 1358 - DNA, 324 bp, Nematostella vectensis
  source 1..324: mol_type = unassigned DNA
tgatggtgggttactcgcctctgtgtaacaggcaaatgaaagctgcgcaagcagtcgatgagccaaagccgcacagcccccgactggggtacagggcagccctgggctatgcccgaagtcttttgacaggtccaaacttcacccttgccgccagtagggcaccagggccaggtgcaggtgggcgctttgttctatttggtttcgcttaatttttgttaaatttttcccgtgcgcccaccctttttaacccttttaacaccaattttttttacaaccctctactcaataatccaaatgaataaaagcggcataacaggtgaacac

SEQ ID NO: 1359 - DNA, 533 bp, Schistosoma mansoni
  source 1..533: mol_type = unassigned DNA
tagcccccttcactcttagacattcccccactgttgttgcttatcttcatgtttttgtgttaattgactgctctcttctgggttgatgtctgattgtctctctctctttccatattgcttgctctccccgcttacttccaatagttgtcatattatgtctttgtttacttgccatgtctaacgacaattactttatctaccttagttggtcctcttggtttggttgccttcatgtgttcatggcggaatctgatgtttataatgactattcctactaccaccattacaactattattattatcactattattaacattattattacttctacaattagtattatggctactcctttcagcacaccaataaaatctcaatcaaacatctcacttattaaactctctatttccccttcgttataaacttacaattcagtttaaccgaatatctctcttttacaaatcttaagtatgtaattttgtgccaagcccatttgggtctgtacaatttgatacttaaaaataaatgttat

SEQ ID NO: 1360 - DNA, 314 bp, Triops cancriformis
  source 1..314: mol_type = unassigned DNA
tagatgactgccctacccctttgctgccgaagaactactgaagactattgaactaaccaactgtgttaagtaagaactaatgcctctttttccctgcatgtatcccctgatcagtgacttattttcttttcctgttgcgccctttgtttagttatttcctttaattactagaattatcttttcgttctccgtctaattgctttttcggtgtaggaacggctacctaaagctggaagtgggaagtgttttcaatgtactttgtgattatagaaatatatgacccgaggtgcattgtttggcatttcctcgagaaa

SEQ ID NO: 1361 - DNA, 256 bp, Drosophila ananassae
  source 1..256: mol_type = unassigned DNA
tagccaatgcacgggttccagattaagcttgctgccgaagcataccatcaaaatcggcataaaattcgcttaataaaggaggtggttttagtacgtaggcgtcccgggacttgtctcgggatgaatcgtgcatgcgtataattgggatcgataacaaataccaactaagttattactaatatatcgaaatacataaatatcccgtccttacgtatctttgaagatttccatcctcagcgaacaaaaaaaaaaaaaa

SEQ ID NO: 1362 - DNA, 256 bp, Drosophila melanogaster
  source 1..256: mol_type = unassigned DNA
tagctaaatcgtttggttcaaaacatttgcttgctgtcttggcataacatcaataaaggcataaacatcgcaaaataatggttataattaaatggctatgaggatggttttagtacgtaggcgttgcggaacttcggttcatatagagcaatgaatcgtgcatgctaggaaaactgaccacacacagtgttggcagacctagtatctttcgaagatttccatacctccgcgatcaaaaaaaaaaaaaaaaaaaaaa

SEQ ID NO: 1363 - DNA, 203 bp, Drosophila persimilis
  source 1..203: mol_type = unassigned DNA
tagcctatacactatgttggagagaagacgcttgctacctaggcaaaatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaa

SEQ ID NO: 1364 - DNA, 219 bp, Drosophila pseudoobscura
  source 1..219: mol_type = unassigned DNA
tagcctatacactatgttggagagaagacgcttgctacctaggcataatgtgaaattaggtataaacatcgtggttgtaaaacttgaggtgggtttttagtacgtatgcgtgattacttcgtaatcatgaatcgtgcatgctagtggggtttggcctccactagtatctttgaagattttccttcctcagcgatcaaaaaaaaaaaaaaaaaaaaaaaa

SEQ ID NO: 1365 - DNA, 247 bp, Drosophila sechellia
  source 1..247: mol_type = unassigned DNA
tagctaaaacgtttggttcaaaacatttgcttgctgtcttggcataacatcaataaaggcataaacatcgcaaataatggtaatatataaattggctatgaggatggttttagtacgtaggcgttgcggaacttcggttcagatagagcaatgaatcgtgcatgctaggaaactgaagtgttgacagacctagtatctttcgatagatttccatacctccgcgatcaaaaaaaaaaaaaaaaaaaaa

SEQ ID NO: 1366 - DNA, 258 bp, Drosophila simulans
  source 1..258: mol_type = unassigned DNA
tagctaaaacgtttggttcaaaacatttgcttgctgtcttggcataacatcaataaaggcataaacatcgcaaaataatggttatatataaatggctatgaggatggttttagtacgtaggcgttgcggaacttcggttcagatagagcaatgaatcgtgcatgctaggaaaactgaccacacgcagtgttggcagccctagtatctttcgatagatttccatacctccgcgatcaaaaaaaaaaaaaaaaaaaaaaa

SEQ ID NO: 1367 - DNA, 242 bp, Drosophila sp.
  source 1..242: mol_type = unassigned DNA
tagcttaaaacgtttggttcacatacatctgcctgctgccttggcacaatatcaaaaaggcataaacatcgcacatattggttatttacggctatgaggatggttttagtacgtaggcgttgcggaacttcggttcggatagagcaatgaatcgtgcatgctaggaactgaccaaataacagcagccctagtatctttcgaagatttccatacctttgcgatcaaaaaaaaaaaaaaaaaaa

SEQ ID NO: 1368 - DNA, 221 bp, Kalotermes flavicollis
  source 1..221: mol_type = unassigned DNA
taatgtcccttttggcttgcccccacctgcttaaaggaactggcaggaaagagagtgatccgtgccatagaaatatggttatccggggcaagtcactagcaatatgggacttctccgggtccgtgcggtccttccaacatgagctggacgtagtccactctatgacttgaacgatacgggggcgtatctcccccggaagaggtcgcctaggcgacttagaa

SEQ ID NO: 1369 - DNA, 289 bp, Reticulitermes lucifugus
  source 1..289: mol_type = unassigned DNA
tgagttagatatatatgacgactgattcttccctaactaaaatataatttggaatgtgcattacttatactttattgtatttattgacatccgtagtagtctgtttagtggatttagatcgttaaccattctgtgacgtcgctgatgtctatatgtaccagtggcagaatgctgactaagaacaaaataattttaaacaatagacagcactaagaaattctgcaaactggaacgtggcccacggtaggccaatataccggaaagggaaaatgacacatccccccttaaa

SEQ ID NO: 1370 - DNA, 289 bp, Reticulitermes urbis
  source 1..289: mol_type = unassigned DNA
tgagttagatatatataacgactgattcttccctaactaaaatataatttggaatgtgcattacttatactttattgtatttattgacatccgtagtagtctgtttagtggatttagatcgttaaccattctgtgacgtcgctgatgtctacatgtaccagtggcagaatgctgactaagaacaaaataattttaaacaatagacagcactaagaaattctgcaaactggaacgtggcccacggtaggccaatataccggaaagggaaaatgacaaatccccccttaaa

SEQ ID NO: 1371 - DNA, 312 bp, Rhynchosciara americana
  source 1..312: mol_type = unassigned DNA
tagaaatgtgtgcgataaggtgtgaatagaagggttcaccaagagggagacctagtttggacctcagaaatggggtcataggagtgataggttgtaaagccgttggggaatccggctacacatggtatctcaggagccattcatgcgctgatctcattaaggcgtaataaactgtgaaacagatcctgataatgccgtgctaccaaatgatgtaacgaggcggaaataaaattaatctggggcgttctgcggaatgactactaaatatagcgatgctatatatacaaacgactgatggtaacaccggcctta

SEQ ID NO: 1372 - DNA, 1206 bp, Ciona sp.
  source 1..1206: mol_type = unassigned DNA
  misc_difference 1079: note = a, c, t, g, unknown or other
  misc_difference 1181: note = a, c, t, g, unknown or other
taagatccgcggctgtggcgccgaacgagcacctgcccattcttcttgtagggactttttcaccctcactccccccaatagttttttttcgttttttcgttttttcacccccaccccactcgcctctgggctgcacatcccacacgtagggacctgtttatattatttgccttttatatgtaccactttttaaatatatttttgtaccccacaagatgcttttcgccaaaaaaaaaaaatttttgtatcacatttttatattttgtaaaacacagatttttataaactttgcactatttttatataaacttcgcacttatttaaaatgaatcgcatcttttttatatacaccaacacaaacaggatgtgcagctcaggggaaccaatcctgcgtccctcctagcggcgggaggggcgcccacctacccccacgctcctcttgagcaccaacagggactcccttccggagcccctgcaccctcaacttttcttatttttaaaaaaaaaaaatcatatatattgatcttgacgacgggggctacattcagcccccaaaaacccacccaccatccccaacgagtgccggggcattgaagagctccggcacaattagcacttagcttatttattattttttgtcaacatttttgttttttcaaattttttcacccctcacccccaccctaataggtccctcgggcttgggcccctttttcgtgctcgagaagcgtcacatcgccccactgaccacgaccttccccgacattggagtccttggcgtctcccaggtcgaaacagtcccaagtgatagcacctaatgctcgacttgtttcggcctgggccgccgaggattcccagaacgaccattcttctaaataatatttatatttcagaataaaactatatatatatcgttggcgggacttgtcccgcctcgataccgagtgctgcagagcggcaaaataaagaagaaaccgacgtcgctctgcagccaaggaccacccaaactcaagccagcaccgtcgacaaccaacatcctcaagtcggcggttgctggaacaactcataacatcttcaanataaattatcaccctgtgcagcaggaggccgtgcttttaaaactactctgtagtggctcatgataatatttcgctccttttttgccccgtgtaaacttagtngatgcgaataaaatcagttgaatca

SEQ ID NO: 1373 - DNA, 128 bp, Bombyx mori
  source 1..128: mol_type = unassigned DNA
taaaaactagcataattattaactcataactaatgtatattacttggccaaaagcccgtatatacagttccaccggctctgtcgacagactgaactgagaaaggggaaacatatggaaataataataa

SEQ ID NO: 1374 - DNA, 204 bp, Anopheles gambiae
  source 1..204: mol_type = unassigned DNA
taacatccggtgcaaactcattaacattaagaaaagagagaggagaaatgagaatgagattcattcacctttggcatttgaatagcccggggtaggtgaaaagttcccagcatattgctgagaagtgacaaaattcggataataataataataataataataataataataataataataataataataatatgcataataata

SEQ ID NO: 1375 - DNA, 474 bp, Bursaphelenchus xylophilus
  source 1..474: mol_type = unassigned DNA
taagaaaagcatgaaataataagaaatcagataagaataacaagaatactaataagtatatcatgtaactatgacaaaaagaacgcaccaataagaacatgcttgagtggccagctctgcaggcaaaagtcgaatttggaacagccggtaatggaagacctgcaacaaacgtggggtagcaggcaatatgtaactatgacagaccaaaactccgaaactctggtaatgagcccgtgccccccaagcatgtggtctcgttcgatgtagttaggaacagttctctttaacccgtgatgattacgccctgtcttaaatggcaggtgccaccaaataccgaacactcgttgaggtatggtggtccgaatgtgaagctgggagtacaatttggtacgagagcaccagcgcccccgatctaagtgatgacgcatgcgtcggaacaatgaagacggctggcaaacattcaggagtcgcaaa

SEQ ID NO: 1376 - DNA, 31 bp, Heterodera glycines
  source 1..31: mol_type = unassigned DNA
  misc_difference 11: note = a, c, t, g, unknown or other
tgaggactcanaattgacaatacacctcaga

SEQ ID NO: 1377 - DNA, 106 bp, Parhyale hawaiensis
  source 1..106: mol_type = unassigned DNA
tgagccttaggtcgcgggatgtgacccggcgccagagtgtagagctgaacatcgctcaaccgatccaatttgggtcgtgaaatcccctcgataataataataataa

SEQ ID NO: 1378 - DNA, 651 bp, Bursaphelenchus xylophilus
  source 1..651: mol_type = unassigned DNA
taacaagtgtaataaaaaccacccatgcgtagtaaaccgatcaattatctagcaaaatcgcaggtcagaagaccaaagaaccgacccagaggaataggaccagagctgaaactctcagatacgccaacggtcctaataaaacgtcgttaagtaaagcatcgttaagtacaaaacaaaagcactgtaaacgcgaggccccctctttgccaaactccggtaatcctcgtagtacggtgctttttcccgcttcacgaatcagaacgctgccagatcttgtccgacatgggccgtagggtttgggagtaccagcgtggggcggagagcgtacctgggtacactgcataatcgggtctcagaaaaccacctatggtttattattctgtctcccatctgcagggtagcttttcgttgggccataggagcctaggggcaagagtgcatgtagtcttcaacggccatgccagggaaacttgtgagaggtgagggataactagcatcagataatatcagtcatgaaattagtaacaaccaacgttcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1379 - DNA, 406 bp, Heterodera glycines
  source 1..406: mol_type = unassigned DNA
tagtcgtagcccagatgtcgacagcccctacaccggtagatggaaggaggtatgtatctaagcccacggcaagccaccagtggaaacggtgaccacctctgttcgcggaaatgccccgtagagtatatgaaggtcggagcattgaagcacaagtgagaaccctggaagtatggtggtgagctggtaacctcgaattcctcctatgggtgcttgcgcccgtaggtcatttgtgtatgtagggatggaaggaatctcgatagcgcaaatcgggataccgcactggcgatcatgctgccagtgggccctgctgagttgggcgggttagcaacccgtccagggacgcagatgccaaaagcctggtgacactctaaagggagtctacggcgacgagaacatcccctaagtc

SEQ ID NO: 1380 - DNA, 99 bp, Strongyloides ratti
  source 1..99: mol_type = unassigned DNA
taattagatttatatgtgccactttacctcaaagatatattaatactaacttaattataatttattatgaattataatataataagttttaaaataaaa

SEQ ID NO: 1381 - DNA, 587 bp, Bursaphelenchus xylophilus
  source 1..587: mol_type = unassigned DNA
tgagaccacccatgcgcagagtatccgaatcagtgaaagtccaagtttcaggacagaaacgtcagataagtccaagagaaacgagaaaacaagttcaagtatgcaagagttaatcaataagagagtaccgtaaatgtatgacccccccctttgccaagtcgacaactgtcatgcaggtgtctctcttttcacccgccatatggaccaaacgctatccagcctcgctcagaagagccttagggctggggagtaccacatgtggcggaaactgaatctggatgcgatgcataccgggagcgcagcgaaatcacttaacgctggtgcacctcctgctatcgtagtacttcctagatagatgagtagggtgggctaaaggtagtcgtcttcaatggcaataccgaggggtctcgtgacaggtgagggataactagtatcagataatatcagtcatgaaattagcaacaaccaacgtcaccgtcgttggcaaaacaccgactaacgatgctagttagaaagagtcgggtcttcccaaagttaggtgcttgcaccgaagccgatccgctctacccacagctctgcccagcgtt

SEQ ID NO: 1382 - DNA, 364 bp, Bursaphelenchus xylophilus
  source 1..364: mol_type = unassigned DNA
taattaggcagtgctcctagcggagtgccgtgaagtggtgtcagtacccgtcgtgtggaaagcccaggagggttagtaccgacagtgggaaacccgctgcacgcaacctaaagacatttgcccttcgggggagaggtatgagaccacactagtcatggttgcttgcgcaagcatgactcattcattgtaagttcgtattatgaggcctcgcggaatgcgaaagtccaagagcgccaacttgtctctttgggaggttcctccgggttccttagggttggcgtaccatgcttcgtgtgagacctaggccgcttggacctagagttaagctgttgcatgtttgaggatgccttaggcggacgccatg

SEQ ID NO: 1383 - DNA, 177 bp, Ascaris lumbricoides
  source 1..177: mol_type = unassigned DNA
tagtcgctaaggggtccggaaatggtccggtcctgcgctacccggttctggtagcacgttcaagcgctcaatcgcctgccttgtaggcagtccatctgtggaagtcgcgctcttgatacagatgtggacggatggaagcagatgatagagccggtgacggccctactagccaaacgc

SEQ ID NO: 1384 - DNA, 160 bp, Heliconius melpomene
  source 1..160: mol_type = unassigned DNA
taacttattgtcagaattccttactagtaataataattatcgctgaaaatctccacccaaatattgcttggctatatgctcgcaatttttggttaacgtaccccaatgatttgggagaacaaaaatggtaaaactataataataataattatattaatat

SEQ ID NO: 1385 - DNA, 84 bp, Takifugu rubripes
  source 1..84: mol_type = unassigned DNA
tagaggacccgagtctgaaggaaggaggcaccgcccaggagggcgaggaagagatttttttttatatatatatatatatatata

SEQ ID NO: 1386 - protein, 1365 aa, synthetic construct
  source 1..1365: note = Description of Artificial Sequence: Synthetic polypeptide
VGLCPSPGVDGTHQPNDSFQNFGETNFSVQVARLVTRNLAPRSVRGNGFGSGMATHPVPADESGHESDPFLVGRSCGQPARLTRQSVGTQTSRDDILPSKTTKLTENELDLLVNFSLELYRSDLQGFVQEGIHFSVNREVLEGFPEVYEQPAPQPAVGDDLNTSLPPDNNICVLEKGSSEAVEDGTPEVAHPVPETQGKESPNNIVMVTLPNKNPPCPCCRVRLHSVLALIEHLKGSHGKKRACFRCVKCGRENFNYHSTVCHIAKCKGPKVEKAPVGEWICEVCGRDFTTKIGLGQHKRLAHPLVRNQERIDASQPKETSNRGAHKRCWTKEEEEMLIKLEVQFEGHRNINKLIAEHLTTKTSKQISDKRRLLPRKQLTDLSKGVAGQKVLDPGLSHQPQLGVVDNGLGGGHLPGGPAAEGRTIEPLGHHLDKDNGHREIADQHKAGRLQAHYRKKIRKRLSEGMISNFPEVFEQLLDCQEAQPLINQAAQDCFGCLDSASQIRKALRKQNTQKDQGDQPKRPAQKWMKKRAVKRGHFLRFQKLFHLDRGKLAKIILDDVECLSCDIPPSEIYSVFKARWETPGQFAGLGDFEINRKANNKAFRDLITAKEILKNVREMTKGSAPGPDGIALGDIRKMDPEYTRTAELFNLWLTSGEIPDMVRGCRTVLIPKSSKPERLKDINNWRPITIGSILLRLFSRIITARLTKACPLNPRQRSFISAAGCSENLKLLQTIIRTAKNEHRPLGVVFVDIAKAFDTVSHQHIIHVLQRRRVDPHIIGLVKNMYKDISTVITTKKNTYTDKIQIQVGVKQGDPLSPLLFNLAMDPLLCKLEEHGKGFHRGQSKITAMAFADDLVLLSDSWEDMNANIKILETFCDLTGLKTQGQKCHGFYIKPTKDSYTVNNCAAWTINGTPLNMINPGESEKYLGLQFDPWVGIAKTSLPEKLDFWLERIDRAPLKPFQKLDILKTYTIPRLTYVADHSEMKAGALEALDRTIRSAVKDWLHLPSSTCDAILYTSMKDGGLGVTKLVGLIPSVQARRLHRIAQSPEETMKDFLEKAQMEKMYEKLWVQAGGKRKRMPSIWEALPEVVPSIDTATTSEWEAPNPKSKYPRPCNWRRKEFKKWTKLIAQGWGIRCFKGDKISNNWIRHYRYIPHRKLLTAIQLRASVYPTREFLARGREDNCVKSCRHCEAAEESCAHIIGMCPVVRDARIKRHNRICERLMEEAGKRDWTVFQEPHIRDVTKELYKPDLIFVKEGLALVVDVTIRFESTKTTLEEAAAEKVNKYKHLETEVRNLTNAKDVIFMGFPLGARGQWYNKNFELLDTLGLPRSRQDIIAKTLSTDALISSVDIIHMFASRGRRQHA

SEQ ID NO: 1387 - protein, 1343 aa, synthetic construct
  source 1..1343: note = Description of Artificial Sequence: Synthetic polypeptide
NKFLGKSRVAYCLKPGPPVSDRGKEFGSGLTTHPEPESESGHDPTVPNPGPSLGAGEGAQPLPLLRVSVGTQTCEEDFITSRPTKLPGIESELGPLVKFSLEVYRSDLKGDVQFEGIHFPDNWGVLEGFPEVYEQLAPQPNGGDELNHSLPGDREGDVLEKDSSEKEKEAAPEALPSVQRARSEQLPDNIVKVTVPDKNPPCPCCGVRLNSVLALIEHLKGSHGRRRVCFRCAKCGRENFNHHSTVCHYAKCKGPQIERPPVGEWICEVCGRDFTTKIGLGQHKRHMHAMVRNQERIDASQPKETSNRGAHKRCWTKEEEELLMKLEVQFENHKNINKLIAEQLTTKTAKQISDKRRMLLKKGRGTTGNLETEPGMSHQSQAKVKDNGLGGDHLPGGPVVDKGTIGKPGQHLDTDNSHQITAGKKKGGGLQARYRRRIMKRLAAGTINIFPKVFKELINDQEARPLINQTTEDCFGLLDSACQIRTALREKGKSQEERPRKQYQKWMKKRAIKRGDYLRFQRLFHLDRGKLARIILDNTESLSCDISPSEIYSVFKARWETPGHFNGLGDFEIKGKANNKAFRDFITAKEIEKNVREMSKGSAPGPDGIALGDIKKMDPGYSRTAELFNLWLTAGDIPDMVRGCRTVLIPKSTTPERLKDINNWRPITIGSILLRLFSRIITARMTKACPLNPRQRGFISAPGCSENLKLLQSIIRTAKNEHKPLGVIFVDIAKAFDTVSHQHIIHVLQQRRVDPHIVGLVNNMYKDISTYVTTKKNTHTDKIQIRVGVKQGDPLSPLLFNLAMDPLLCKLEESGKGFHRGQSSITAMAFADDLVLLSDSWENMKENIKILETFCNLTGLKTQGQKCHGFYIKPTKDSYTINNCPAWTINGTPLNMINPGESEKYLGLQIDPWTGVAKYDLSTKLKIWLESIDRAPLKPLQKLDILKTYTIPRLTYLADHSEMKAGALEALDQQIRTAVKDWLHLPSCTCDAILYVSTRDGGLGVTKLAGLIPSVQARRLHRIAQSPDETMKDFLEKAQMEKMYEKLWVQAGGKKKGMPSIWEALPMTVPPTNTGNLSEWEAPNPKSKYPKPCDWRRKELKKWTKLESQGRGVKNFRNDTISNDWIQYYRRIPHRKLLTAIQLRANVYPTREFLARGRGDNYVKFCRHCEADLETCGHIIGFCPVTKDARIKRHNRICDRLCEEAAKREWVVFKEPHLRDATTELFKPDVIFVKEDRALVVDVTVRYESAKTTLEAAAMEKVDKYKHLEAEVKELTNAKDVVFMGFPLGARGKFYKGNFNLLETLGLPKTRQLSVAKTLSTYALMSSVDIVHMFASRSRKPNV

SEQ ID NO: 1388 - protein, 1193 aa, synthetic construct
  source 1..1193: note = Description of Artificial Sequence: Synthetic polypeptide
MESTAKGKSYWMARRPVEGATEGSLGRVPFVTRDPKRKPEAKRTLTHGLGLRECSVVLTRLIEGRRGRDHTPSGWNAQRGMPNDESSVEEPNGPIPSNPIPTGTQALPEPMADGEQGEHPGVVVTLPLRDLNCPLCGGSASTAVKVQRHLAFRHGTVPVRFSCESCGKTSPGCHSVLCHIPKCRGPTGEPPEKVVKCEGCSRTFGTRRACSIHEMHVHSEIRNRKRIAQDRQEKGTSTDGEGRAGVERADAGEGPSGEGIPPKRPRRARTPREPSEPPANPPILSPQPDLPPGGLRDLLREVASGWVRAARDGGTVIDSVLAAWLDGNDRLPELVDAATQRTLQGLPAGRLARRPATFVAPNRRRGRWGRRLKLLAKRRAYHDCQIRFRKDPARLAANILDGKSETSCPINEQAIHEHFRNKWANPSPFGGLGRFGTENRANNAHLLGPISKSEVQTSLRNASNASTPGPDGVGKRDISNWDPECETLTQLFNMWWFTGVIPSRLKKSRTVLLPKSSDPGAEMEIGNWRPITIGSMVLRLFTRVINTRLTEACPLHPRQRGFRRSPGCSENLEVLECLLRHSKEKRSQLAVVFVDFAQAFDTVSHEHMLSVLEQMNVDPHMVNLIREIYTNSCTSVELGRKEGPDIPVRVGVKQGDPLSPLLFNLALDPLIQSLERTGKGCEAEGHKVTALAFADDLALVAGSWEGMAHNLALVDEFCLTTGLTVQPKKCHSFMVRPCRGAFTVNDCPPWVLGGKALQLTNIENSIKYLGVKVNPWAGIEKPDLTVALDRWCKRIGKSLLKPSQKVYILNQFAIPRLFYLADHGGAGDVMLQNLDGTIRKAVKKWLHLPPSTCNGLLYARNCNGGLGICKLTRHIPSMQARRMFRLANSSDPLMKAMMRGSRVEQKFKKAWMRAGGEESALPRVFGANQYQEGEEVANDLVPRCPMPSDWRLEEFQHWMGLPIQGVGIAGFFRNRVANGWLRKPAGFKERHYIAALQLRACVYPTLEFQQRGRSKAGAACRRCSSRLESSSHILGKCPAVQGARIRRHNKICDLLKAEAETRGWEVRREWAFRTPAGELRRLDLVLILGDEALVIDVTVRYEFAPDTLQNAGKDKVSYYGPHKEAIARELGVRRVDIHGFPLGARGLWLASNSKVLELMGLSRERVKVFSRLLSRRVLLYSIDIMRTFYATLQ

SEQ ID NO: 1389 - protein, 1454 aa, synthetic construct
  source 1..1454: note = Description of Artificial Sequence: Synthetic polypeptide
MLRGGVGTPPAGGAGAVGPGMASPGGCSVRFSPGGRRLLGHRTGGLSPSVSWRLKRLSVSLRRWSGPGLLGADGAGGGAAVASPRGTQVLGSGAGRRWLGHGSRGSSPSAARGLRRLTVRLKRLSGGLLSPKACRDAEEGSSSSPGFRNPKGLGGRGLTPLGSRRFCRLTVSLNRWRGSLVKLNASSRASGRRTPVKPACDSRAGRGSEHAEGGGVSAAPMVLRSRRKLTFSVDGDSNSGDRARSGSVSAARPGHLLVDGESASSRSGPAGDARLAGPSTRSRRKGCLPPVDFENPKKRTRLMAKMTNGNPTSHVPCPAPCSNGHEGGGRVAVIEGRLPELSGSRISGIQPALPVETSFVGQSTGRGADGDANANSSPPSPNLGGSVGMVPAVRDGTPPLGRPGEDHSRECAGGNTPLWMLEDSFRCDYCPREFGTRAGRSLHMRRAHLAEYDGAGFCWGERLSEFAATRLWSTEETKKLAVFCERGVPSPSECRAIAASLGAGKTHHQVRSKCRLVFEAIRRRELLEVAAATERLEKSARRKQPAVPPAPVHGVRGVLRGLLGKRVPREGGTTGSTSARIVRRDDCRQGAVASASLNLIRRLGRKATGRSGRRRVLGRPPRMDVRRSVRMRRMRRFLYRLARLGWAKLAMFVLDGQMGASCPVPLVEVSAVFRERWSIVRAFLGLGQFGGFGTADNAGFGKLIDPAEVRAHLQSIKNRSSPGPDGITKVALSKWDPEGIKLAHMYSTWLVSAGIPKVFKKCRTTLIPKTGDVSLHGDVGQWRPITIASLVLRLYSRILTERMTVACPSHPRQRGFIASPGCSENLMLLEGCMSLSKAGNGSLAVVFVDFAKAFDTVSHEHLLSVLVQKGLDQHMVELIKDSYENSVTKVHCQEGCSTDIAMKVGVKQGDSMSPLLFNLALDPLIQQLEREGRGFPVNGKSITAMAFADDLAIVSDSWEGMRANLDILVDFCELTGMRTQPSKCHGFLIEKSGSRSYKVNRCEPWLLNDTALHMVGPKESIKYLGVQVNPWTGIFAEDTVAKLRQWVVAISKTPLRPLDKVSLLCQFAVPRVIFVADHCMLSAKALTEMDRSIRQAVKRWLHLARCTTNGLLYSRKSSGGLGIPKLSMIVPAMQARRLLGLSRSKDETVRWMFLETTDHVAFERAWLRAGGSPDEVPELGPDLVEGSPAEGNADPVSTVRPRKRIVPCDWRQVEFDRWAGQLVQGKGIRTFEADKISNCWLYDYPPNKLKPGDFTAAVQLRANVYPTRELAGRGRTDTIDVCCRHCGEAPETCWHILALCPKVKRCRIQRHHKVCQVLVAEAERHGWEVEREKRWMLPSGECVAPDLICWLDELALIVDVTVRYEFDEESLERARIEKECKYRPLIPVIRASRVQTKKVTVYGFPLGARGKWPAKNELLLADLGLSKARTRSFAKLLSRRVLLHSLDVMRTFMR

SEQ ID NO: 1390 - protein, 1114 aa, synthetic construct
  source 1..1114: note = Description of Artificial Sequence: Synthetic polypeptide
MMASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAVEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPILIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGKQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 1391 - protein, 1160 aa, synthetic construct
  source 1..1160: note = Description of Artificial Sequence: Synthetic polypeptide
MNLLIVTSSIKESDVPSSGKGGVAVNNITAGASGKDTCVIIHPGTDGIWCCTECVEIHNSGKDLKRHLAKRHPSVTISGYKCNLCPFVSERQLSVGTHLRYCRGVKEVVKREFACASCSFSSDTFSGLQVHMQRKHIAEWNDQLKEKTEFAWTDRELRELAEKELTTPSFRYNKIFYAALGTSRTYDAVRKIRYNDRYKSAIAEMRSQIADAAAAAQERDVERGLVSAHSDRGKEMLPVVETKSDIQVNNDIKKDIELTPNSRQKQTNLALARPAVIEVEEDLGRQDVKQYLASLRQDDYTSPAERSIFAYCREETNWSATKRQVLKISRTTRGLRQPKKVRPFEFPEGFKPNRNMRKWRKYRFLQECYREKRAETVSKILDGTFIDEPEEEIRPELEEVQRMYIDRLEKRTQLDTTKIVQTDEVFCLQSYGRITIGEVRDALGASKKDSASGPDGLLLQDVRRLGPLLLCNIFNMWYLHGIPVEENRCRTILLYKSGDRHLASNYRPVTIGNMLNRLYAKIWDKRIRKNVRLHVRQKAFIPVDGCFENVKTIQCVLQSYRKRKLEHNVVFIDLAKAFDTVLHDSIRKALWRKGVPSGVVKVVDSLYAGAVTSISVGKTKTRSICINSGVKQGCPLSPLLFNLILDELAERIEATGCGLDLDGHVLSSMAFADDYVLLAKDSVEMNELIRVCSTFFKEKGLSVNPGKCQSLRVLPVKEKKRSMKVLVRPHRWWRIKDQDVDIPSMTYDSLGKYLGVSIDPTGKIALPIEEWKNWMTKLKECKLKPEQKVKILKEVVCSRVNYVLRMSECGISELRSWTRFVRNWAKNIIHLPTWCSSDWIHSIKGLGIPDVSKGIVIQRMRASEKMSTSEDGIVRVVGARLVQKNRVLWEKAGFEGIELKAARRHCEVERLNNIGNITNGVALKTIAAVSSVNRYWMIEDNLKSGNKILVWKAMAGAIPTKINLSRGVADQTLKKCRRCGLTAETDGHILAGCHTSSDAYSKRHNMLCDKLAKELKLNGGPNRRVWRERTCFTSTGRRYRPDIIVKDDSKITVIDMTCPYEKSEGHLIQCESAKVTKYEPLKLDKYWTRELEGANGIVAEKVELMGLAIGAIGTIMRSTLRKLCELKSGRIVRRLQMIACNNSAQIIKGHLSRATRRNLR

SEQ ID NO: 1392 - protein, 1158 aa, synthetic construct
  source 1..1158: note = Description of Artificial Sequence: Synthetic polypeptide
MSNRITIGDVPSVGKGGLTVNKQTAGADGAEACVVIHPGAKGIWSSPACLRKFTIGKELRAHLAQIHKLAPSAVRYRCNKCPYEGDVQLSVGTHLRYCKGIAGVVEEKKQFACAICNFSSDTFSGLQVHKQRKHVVEWNEQLKEKTEFAWTDRELRELAVKEVTIPFSVVNTETFAVLDITTRTKDAVRKIRYTDRYKSILAEVRAQVNAVAEEAPQASDESQITLLVNTGRGAELQPAVINITDSIELVTDVNEVEMVTSNSTNEEQPINAPVEPAVIEADLGRQDAKLYLASLRQSDCTNASDRWTLAYCRGEVDWCKTKSRLFKVSRHARGLRQPQRVENWEFPEGFRPNRNLRKWRKYSFLQSCYRTKKKETVSKILDGTFKDTPEEEIRPELEEVQRVYVDRLEVRTQLDTTRTVHIDERFDLVSYGRITIREVQDAISASKKDASGGPDGLLLQDVKKASPRQLCIIFNMWYLHGIPVVENRCRTILLHKGGEKHLTSNYRPVTIGNMLNRVYAKIWDRRIRKNLQLHVRQKAFVPLDGCFENVKTIQCILQSYRRSRREHNVVFVDLAKAFDTILHDSIEKALLRKGIPRSVIKVVDSLYAGAVTSITVGKTKTRPICINSGVKQGCPLSPLLFNLVIDELAERLEATGCGLDLEGHVISSMAFADDYVLLAKDSVEMNVLMNVCNTFFEEKGLAVNPAKCQSLRVLPVKGKRSMKVLTRTHRWWKINNQDVEIPSMTYESVGKYLGVMIDPAGKIALPIEEWKLWLTRLRECKLKPDQKVKVLKEVVCARANYVLRMSGCGICELRKWSRFVRGWVKSIIHFPAWCNSEWMHSSKGLGIPDVVSGIVIQRMRAAEKMAKSTDGVVRVVGARIVQTNRVLWKRAGLAGIELDAARKFCEVKRVNKIGNQTNGGALKTIAESSVSRHWLLEKNIRPGNKILVWKAMAGVIPTKINLSRGVADQTLKKCRCCGLTAETDCHILAGCPTSRDAYSKRHNLLCDKLAKELRLNGGPSRRVWRERMCLSGNGRRYKPDIVVKDDGVITVIDMACPYEKSERHLSQCEDAKVAKYEPLRLDRSWTQELEGNNGRSANEISVVGIAVGAIGTITRKTQRILSKLKLAKVGRPLQIIACNESAQIIRRHLSGSRLRNLR

SEQ ID NO: 1393 - protein, 1102 aa, synthetic construct
  source 1..1102: note = Description of Artificial Sequence: Synthetic polypeptide
MNLPIREHAVSVHNINKFNYLCQLCSKSYDTINSVKAHYVACRRQKNASSTTAVPTNVINNNQLAINTNQVISRNPLQCVECLMKQVDFYAKDTKALVTHMRTKHAAAYEESKKVATRRVAWSPDEDQILAELEVKLKKIQKGQLLSRLVVEYNKCADKSKAPSRSKDAIRTRRQQHDYKLLLRSLQSQQPPVGSEDSDSDISSSNNNPLTTTHNVTPTPDSSNVVLLIQKIRESVDSIVKITNLKLNTNMLNAASAFINQNNNMDPLELSMRGIEEDVKAIRDKELQKPTRNVPSSTTSRKPTRNAKRLEKSKKYGYYQHLYYNNKKKLVAEILDGETSGAKPPPMNLVEDYYRNIWSRSTIDDSPVNNIKTVNSDSIFAPISRDEIKLALSNTKKDSAAGPDAVTIKEAKAIIDNLYVAYNIWLGVQGIPEQLKLNKTILIPKGNSDLSLLKNWRPITISSIILRVYNRLLAYRMNKIFKTNDKQVGFKPVNGCGINISWLHSLLKHARLNKNSIYACLVDVSKAFDSVSHQSIVRALTMNGAPSLLVKLIMDQYTNVNTVITCSGSISNKINISSGVKQGDPLSSLLFNLVIDELFDVIKDQYGYTIDNIGTTNARCFADDLTLISSSRMGMNKLLELTTKFFKERGLNVNPSKCMSIGMSKGYKGKKSKIESEPLFSITDAQIPMLGYIDKTTRYLGVNFTSIGAIDAKRIKKDLQDTLDKLEHLKLKAQCKMDLLRTYMIPRFMFQLIHTELYPKLLIKMDILIRKLAKRILHLPISTSSEFFYLPFKEGGLQLTSLKEAVGLAKIKLHKKIMSSNDPMLCYLIESQRSRIVEHFMKDLKLGDSLTLNEMNNIKECFMKEKRISFAQKIHGVGFEVFSSSPLTNQWINGEIKTMTTKTYINSIKLRTNTLETRVTTSRGLNIIKTCRRCHVADESLMHVLQCCSSTKGLRYSRHHKICAKVANKLVMNGYGVFREKSYPDPNNSGSYLRPDIIAVKNGHVIVLDVTVVYEVTGATFINAYQTKINKYNAIMVQIEQMFNCVNGELHGLVIGSRGSIHHSQLHIWHQMGFSSIELKYVAIGCMEDSLRIMSTFSKAIT

SEQ ID NO: 1394 - protein, 1276 aa, synthetic construct
  source 1..1276: note = Description of Artificial Sequence: Synthetic polypeptide
MGTDTVYVGQDYPSGLSKRVPARLVAGPMLRERSCHAHVFRAGHMWNWRTSLPSGRWDQPALEKSRVLTRSVATATDPEITSYPGKSVSTSTQVQEEDWCSRESGWISPGLAPEEPSVVSEITASMVATMRVATEEVVLEPQPEQVVTILPEHGRNVPPGLAEQDTASPIEVSVLLPDLAENCPLCGVPSGGLRLLGKHFAVRHAGVPVTYECRKCAWRSPNSHSISCHVPKCRGRARMPSGDPGIACDLCEARFATEVGVAQHKRHVHPVEWNKVRLERRGARGGGIKATKLWSVAEVETLIRLIREHGDSGATYQLIADELGRGKTAEQVRSKKRLLRIDTASNSPDDAEVEEERLESLAVRSSSRSPPSLVATRVREAVARGESEGGEEIRAIAALIRDVDQNPCLIETSASDIISKLGRRVDGPKRPRPVVREQTQEKGWVRRLARRKREYREAQYLYSRDQARLAAQILDGAASQECALPVDQVYGAFREKWETVGQFHGLGEFRTGARADNWEFYSPILAAEVKENLMRMANGTAPGPDRISKKALLDWDPRGEQLARLYTTWLIGGVIPRVFKECRTKLLPKSSDPVELQDIGGWRPVTIGSMVTRLFSRILTMRLTRACPINPRQRGFLASSSGCAENLLIFDEIVRRSRRDGGPLAVVFVDFARAFDSISHEHILCVLEEGGLDRHVIGLIRNSYVDCVTRVGCVEGMTPPIQMKVGVKQGDPMSPLLFNLAMDPLIHKLETAGTGLKWGDLSIATLAFADDLVLVSDSEEGMGRSLGILEKFCQLTGLRVQPRKCHGFFMDKGVVNGCGTWEICGSPIHMIPPGESVRYLGVQVGPGRGVMEPDLIPTVHTWIERISEAPLKPSQRMRVLNSFALPRIIYQADLGKVTVTKLAQIDGIVRKAVKKWLHLSPSTCNGLLYSRNRDGGLGLLKLERLIPSVRTKRIYRMSRSPDIWTRRMTSHSVSKSDWEMLWVQAGGERGSAPVMGAVEAAPTDVERSPDYPDWRREENLAWSALRVQGVGADQFRGDRTSSSWIAEPASVGFAQRHWLAALALRAGVYPTREFLARGKEKSGAACRRCPARLESCSHILGQCPFVQANRIARHNKVCVLLATEAERFGWTVIREFRLEDAAGGLKIPDLVCKKADTVLIVDVTVRYEMDGETLKRAASEKVKHYLPVGQQITDKVGGRCFKVMGFPVGARGKWPASNNTVLAELGVPAGRMRTFARLVSRRTLLYSLDILRDFMREPAGRGTRVALIPAATGAAN

SEQ ID NO: 1395 - protein, 1168 aa, synthetic construct
  source 1..1168: note = Description of Artificial Sequence: Synthetic polypeptide
GIDGYMFGYARASGSTSVSIQSSSMTEGETNERATPRASDSSSVSIQSSCVTEGECLPPTDNCNPSVENQLPCVTEGRFERVGSLVTVRLPFRKVACDLCSKEFLTYSKFAVHQANFHNSETQACCTYCGKSDGNHHSIACHVPKCPWRRTVTFAANLSNFLCDLCNDSFKTKSGLSQHKRHKHPCSRNAERILSLGVRTPSARPRQVVWSEEETRTLREVEVVYSGQKNINVLCAGHLPGKTSKQVSDKRRDLHRIRSSNVHGTPTTQSRGDPVEQVEEYEELDWEGMHPFPDPDSKFCSYLDQLRDQKGLTEPVWQEIEIVAQEWVENLAHVQSSWNHERTTKQVPENNTPARRPFKRRLHRVERYKRFQRMYDLQRKRLAEEILDGREAVTCNLKKEEIKDHYDQVYGVSNDRVSLDDCPRPPGANNTDLLKPFTPTEVMDSLQGMKNGAPGPDKITLPFLQKRLKNGIHVSLANVFNLWQFSGRIPECMKSNRSVLIPKGKSNLRDVRNWRPITISSIVLRLYTRILARRLERAVQINPRQRGFVPQAGCRDNIFLLQSAMRRAKRKGTLALGLLDLSKAFDTVGHKHLLTSLERFAVHPHFVRIVEDMYSGCSTSFRVGSQSTRPIVLMRGVKQGDPMSPILFNIALDPLLRQLEEESRGFMFREGQAPVSSLAYADDMALLAKDHASLQSMLGTVDKFCSGNGLGLNIAKSAGLLIRGANKTFTVNDCPSWLVNGETLPMIGPEQTYRYLGASICPWTGINSGPVKPTLEKWIANITESPLKPHQRVDILCKYALPRLFYQLELGTLNFKELKELDSMVKQAVKRWCHLPACTADGLLYSRHRDGGLAVVKLESLVPCLKIKTNLRLVHSTDPVISSLAESDGLVGAIEGIAQKAGLPIPTPDQRSGTYHSNWRDMERRSWERLALHGQGVELFKGSRSANHWLPRPVGMKPHHWVKCLAMRANVYPTKRGLSRGNLSKNKDSAKCRGCTSMRETLCHLSGQCPKLKSMRIRRHNKICEHLIAEASFKGWKVLQEPTLVTDNGERRRPDLIFHRDDKAVVVDVTVRYEISKDTLREAYASKVRRYGCLTEQIKDLTGATSVVFHGFPMGARGAWFPESSDVMADLNIRSKYFEEFLCRRTILYTLDLLWKSNNEQYLERLAP

SEQ ID NO: 1396 - protein, 1687 aa, synthetic construct
  source 1..1687: note = Description of Artificial Sequence: Synthetic polypeptide
MLRRKGRHRMVMVNSVKWQPSAHAEAIGTGKSWAPQRSQASEHGWQSNAMFDPPNRILFARDSWSLNQSTHLQNQRSGSGLGIRPGQVRNNMVGGGPHRAGDPKRRVELVSIQGSEVTVRTIYPSDEIFSCYSKSCDIKTKAGYGPEDLKHLTRHIKNEHGLKARWAYQCGLCNEKSDPSVSEGHKWMEAHMVAVHQSSAEKRIKSYQKCTGARVAEQLQAAAPSLTVPGKHKSGSRDAAKDSMTPTKDDDPKTRIYQTRSVVKKSTQKTAEPTDEGSRGPKYASIFQKSVKARKSLALLCELSSPKPMNPLPTNELTLKEGNSRELAKEEAPSEGIDDIVIIDLDESEESPPRRKRFNTWCLDHESSREAWLDDTAIFWYISYLCRGSTKYSALDPCLWSMYKVKGSRYILDRLESSITYFFPICEEDHWTLLVLKDNSYYYANSLHQEPRGPVRDFINDSKRARKEFKVQVPLQRDSFNCGVHICLMTNSIMAGGKWHSEEDVRNFRKRLKKTLQEEGYELYSVNSLGIPFQAPTTEQMDYKETRCKRSYASVLTQISPPAKRPDCKPDNNIFVPTKDCAAEGNPQEKGRNESPEEINTEHIVVAGKPANNISPRCRSTSEMLFEMVKATTSSGRSSLGTMTQDEFIRTSTIAEAVPLMSIKLPPMELPRKILPPIPPRKPTQTNGGQKGKQQRVPTGKPDTLNAKVRNWFNNQLESYAMEGRSFQRLEWLTEVLTASIQKAAAGDEGIVDIICKRNPPLEVAKGEMCTQTENKRKTTNNAARIADPIQSSKGAGDVKASYWKERARTYNRIIGSKEELCKIPIDQLEDFFKKSTSRTNVQESIMKEKSSKIPALKIGNWMEKKFIGKEVAFALRKTKDTAQGADGLRYHHLQWFDPSGELLAKVYNECQRHRKIPKHWKEAETILLFKNGDQSKPENWRPISLMPVIYKLYSSLWNRRIRAVPNVLSKCQRGFQEREGCNESLAILRTAIDVAKGKRRNLAVAWLDLTNAFGSIPHELIEYALTAYGFPQMVVDVVKDMYQGASMRVKNATEKSDRIPIMSGVKQGDPISPTLFNICLETVIRRHLESANGHQCLKTRIKVLAFADDMAILTDSPDQLQRELSKLDNDCTPLNLIFKPAKCASLVIQKGVVRSASIKLKGNAIRCLDENTTYKYLGVQTGSAARISAMDLLEKVTKELECVVKSDLTPPQKLDCLKTFTLSKLTYMYGNSIPLITEIKMFANIVIRGVKVMHRIPVRGSPLEYIHLPVKDGGLGVACPKTTCMITFLVSTLKKLWSDDEYIKTLFTSLAEEVVKKESKKSTVTMDDIADYLNVEERINRSEFGYNSITRLRDVMRNLAITGDSPLYRLKMVVKNGKIALLVQATSESMERIYTEEDAKKLQRSLKDQVNKALKHRFNTTKVVKSKVVRVVQQHPASNRFVTKGGNLSLACHRFVHKARLNLLACNYNNYDKSKSKVCRRCGKDLETQWHILQNCPFGFSKKITERHDAVLHKVKTLIESGGKKNWTMKIDEELPGFSRLRPDICLKSPDEKQIILADVACPYEHGVEAMERSWQAKIDKYETGFAHLRKSGTKLTVLPIIIGSLGSWWKPTGDSLKELGIKGSVINSAIPELCATVLEHSKNTYWNHIFGEAYIPNPMRNGHAKPAGNGWKKERLQKAPVRPTN

SEQ ID NO: 1397 - protein, 1059 aa, synthetic construct
  source 1..1059: note = Description of Artificial Sequence: Synthetic polypeptide
MSLQRAKNARGDPGRCNLCSADYRDLKDHLNKQHSTHFFVPSDLRGSSLVACPRCGTPCSAGTGLSRHQSRYCGLTAPRIRRNRVGNSTNTSRCPPSNTAASPIVPSPSPERPSPPQPAEVVASLEPLSEAEEVLEVAQVDAETVDTLEGTRRAPESVPRSAEEGSTRVRELNMTAPEEEHRGEEESSHTNPTAPAGLENAVSSTLGPSPGTLPSLLPSQECANERFLYLAHLPVRSKPLPNNLVTDFMDAAERCALAYIAQPSDSTLLAFLALPKVGLTQALAPEQPLRPSTFLKQFPHIPWPEQPPARRPPSNIRPDTTKQVIKLVENGRLGAAERVLEEDASVAELDQGVIDQLITKHPKGPSCPFGNAVGPTPGKAPDIDTIQKALDSFKPDTAPGVSGWSVPLLKTAAKREPVKQFLQLLCAAIANNTAPGRSMLRTSRLIPLKKDDGSIRPIAVGELIYRLCAKALIISHFQPDFLLPFQLGVKSIGGVEPIVRLTERVLEGSAGAEFSFLASLDASNAFNRVDRAEMAAAVKTHAPTLWRTCKWAYGDSSDLVCGDKILQSSQGVRQGDPFGPLFFSITLRPTLNALSQSLGPSTQALAYLDDIYLFSNDSQVLSKTTQFLADKQHIIKLNEKKCKLISFDEIRQEGFKMLGTMVGGKEKRAEFLEGRIRKEMAKVGKLKDLPHQHALLLLRFCIQQNLRHLQRSLRSDDLVDLWERLDTMLWEEVKRMRMRQREDTAEEEALGRSLTKLPARLGGLGLLSFKDVAPLAYRSAAEASDTLLDNLGLLSSPEEPPTPIPQRTRCAELWESQQEAILHNLGDTERKRLTENASRLGRSWLSVIPYLQPLRLSNVEIASGLHDRTLVGSSIPVCRFCGSDSPLGHDELCRARNPWTQRRHNAINRVIYQHLKQIQGATVEIEPHTLSGQRRNDLRVRGSSALAFTDYDLKVYSLGDRDARSTVTPCAPNGKLADFCLDRCVNWLDKVGQVVSKNAPKVTGGVFKPIILSTGGLMSRSTADEWKDWRDAMPVGGFEKMEKRIGVELVKARARTLVL

SEQ ID NO: 1398 - protein, 1024 aa, synthetic construct
  source 1..1024: note = Description of Artificial Sequence: Synthetic polypeptide
MSQPNISSAETPLSQLPTPVPTPPSPSNPSLSLPTVRDLLLCPIRSSHVYSSIPSSCLHSFTMLLIKTVRAASATMTPTESHRAFIHLHILPIAVLRRSFRGETGWRSRTGQHHALRQRIRRASSGRHWAALWHEALAAHQVDLDYRTRHSRRYQASATSRHRIGRAMRLAADAQYGRAMSALKAKPLPDLHAAATRDTLTALHPPPASPVQPLSPTDLPPVPEITEGQVLRAARALNPTSAAGPDHLSPRILQLLARTTISPEAGVTGLSALTNLVRRLARGDIPDRTAPLLAAATLIPLQPRPHKIRPIAVGQALRRLVTKVLLPPAIQDTRDHLLPEQLANSVASGMDAIVHDTRMLMHRHGRNPDYIMVSVDARNAFNTFSRQSLLDRLPLQTPSLARFLNLIYGRTVPDLVLPSSPRFLMKSQEGTQQGDPASMLLFSLAIQPLLRRLTRECRLDLNRWYADDGTLVGPISEVIKALRILRDDGPQSGFHVNINKCRAYWPTVMPEKLSELLRIFPLHVECGEGGVALLGAPLGTDAFVRRHLMNKVQSCHASLSLLDEIPDARTRFHLHRVTGSVCKVEHVFRLTPPHLSLPAATKFDEQQIAAYSRLNDVAVSTSMATQIGLPFRLGGHGFTPLSPFIHASYAASLIEAAPVRVKGPHNPSESFYRRMARRHIVHVLGALNPEVRTRGILGTHSPLGPFEPEALLSRPERVHHTLIQAMQGATSRLYWEHTAWDLDPLPRNHSAASVRRRARYNSLRAPGAASFLCSHPSLTSRVPSAVWSCMLRRHLDTPVYCDSIRPLICSHCCKPMDARGDHAAICRHGFGVVHRHNTVRNLLARHAFRAAGLCCDLEVPSLLPNTANRPADILVQPAPPPSGALPDRPTAYDVTVRSPYCRSTMSLAAKGLAGAAEAADLDKLRVHSRTVRDAFHLQPDSPLPLLDWHFVPLAFDTLGATSSRTMAVLEYLAHRIANRTYSSYGTAKIRLLQRISFAVWSSLASATLSRMPYHGAALSSPAQV

SEQ ID NO: 1399 - protein, 1353 aa, synthetic construct
  source 1..1353: note = Description of Artificial Sequence: Synthetic polypeptide
  VARIANT 3: note = Any amino acid
  VARIANT 4: note = Any amino acid
  VARIANT 6: note = Any amino acid
  VARIANT 31: note = Any amino acid
  VARIANT 32: note = Any amino acid
  VARIANT 33: note = Any amino acid
  VARIANT 34: note = Any amino acid
  VARIANT 46: note = Any amino acid
  VARIANT 52: note = Any amino acid
  VARIANT 59: note = Any amino acid
  VARIANT 79: note = Any amino acid
  VARIANT 85: note = Any amino acid
  VARIANT 92: note = Any amino acid
  VARIANT 96: note = Any amino acid
  VARIANT 98: note = Any amino acid
  VARIANT 100: note = Any amino acid
  VARIANT 103: note = Any amino acid
  VARIANT 122: note = Any amino acid
  VARIANT 140: note = Any amino acid
  VARIANT 163: note = Any amino acid
  VARIANT 170: note = Any amino acid
  VARIANT 188: note = Any amino acid
  VARIANT 193: note = Any amino acid
  VARIANT 199: note = Any amino acid
  VARIANT 207: note = Any amino acid
  VARIANT 209: note = Any amino acid
  VARIANT 220: note = Any amino acid
  VARIANT 257: note = Any amino acid
  VARIANT 274: note = Any amino acid
  VARIANT 276: note = Any amino acid
  VARIANT 292: note = Any amino acid
  VARIANT 298: note = Any amino acid
  VARIANT 303: note = Any amino acid
  VARIANT 306: note = Any amino acid
  VARIANT 307: note = Any amino acid
  VARIANT 309: note = Any amino acid
  VARIANT 333: note = Any amino acid
  VARIANT 344: note = Any amino acid
  VARIANT 353: note = Any amino acid
  VARIANT 368: note = Any amino acid
  VARIANT 382: note = Any amino acid
  VARIANT 383: note = Any amino acid
  VARIANT 391: note = Any amino acid
  VARIANT 476: note = Any amino acid
  VARIANT 480: note = Any amino acid
  VARIANT 573: note = Any amino acid
  VARIANT 591: note = Any amino acid
  VARIANT 620: note = Any amino acid
  VARIANT 669: note = Any amino acid
  VARIANT 678: note = Any amino acid
  VARIANT 707: note = Any amino acid
  VARIANT 709: note = Any amino acid
  VARIANT 728: note = Any amino acid
  VARIANT 759: note = Any amino acid
  VARIANT 780: note = Any amino acid
  VARIANT 791: note = Any amino acid
  VARIANT 799: note = Any amino acid
  VARIANT 845: note = Any amino acid
  VARIANT 857: note = Any amino acid
  VARIANT 860: note = Any amino acid
  VARIANT 878: note = Any amino acid
  VARIANT 880: note = Any amino acid
  VARIANT 882: note = Any amino acid
  VARIANT 896: note = Any amino acid
  VARIANT 939: note = Any amino acid
  VARIANT 959: note = Any amino acid
  VARIANT 1030: note = Any amino acid
  VARIANT 1038: note = Any amino acid
  VARIANT 1066: note = Any amino acid
  VARIANT 1139: note = Any amino acid
  VARIANT 1153: note = Any amino acid
  VARIANT 1155: note = Any amino acid
  VARIANT 1217: note = Any amino acid
  VARIANT 1253: note = Any amino acid
  VARIANT 1262: note = Any amino acid
  VARIANT 1271: note = Any amino acid
MAXXPXISPPGAPPAPLRYRMLQCPPPLPKXXXXPVPHPMSSPIRXRLPHRXMRGPPSXTPPRDMHRPHGTPGPHSHRXCGRPPXHCTHASXQPRXAXHXLQXPKLRSPPPHPHVSPLILCXGPLPTPMTQPRMKRALSXSAKAPPTKRPSASQGPAASSHDXPRTPPPXPPRPPPYRFPPPTLDQHXFALSXAYPHPXPRRPPSPXRXLRHSFPPRFGXQTFSSIPGPRLHSTVLLLIRLVRAATAANTPETTTLXSCTFTCSRLPFFERPSXAXLAGGPRAVNFMLSACXYGERVXDESGXSYXXKXHCITSHPPRPRRYSRQHSRNHHTXFLHLHLLPTAXLREAFRGEXGWRSSRGQLHALRLXIRRACTGREWGLLXXEALDAHSXRTEWQHTHARRPSPPVSPSARAARAMRLASQAQYGRAMRTFTNPPLADLNDPATMERLQALHPTPTVPVVPLPPSAQPRPPEVTXEAVXRAVRRLNPNSAAGPDRMSPKLLHLLAHTPISPEAGVTGLSALTNLVSRLARGSLPPCTIPLASAATLLPLQPRPGKIRPIAIGQALRRLVTKXLLPAAIDDCRDHLAPEQXANGIPNGIDAIVHDARMLVRRHGNDPHYXMVSIDASNAFNNFSRQQVLDQLPTRAPSLSRYLDMVYARAPSPLVLPSXPPTILHSRXGSQQGDPASMLLFSLALQPLTRLISRECXLXMNRWYADDGTIIGRIDEVXKALDIITKEGPRFQFFLNPSKTRVFWPSRQXDLLSPLMTVGPLRVIDEGGVXLLGAPIGSPSXMAQYIREXLNTCKTALAHLDHIPEARMRFHLHRVSASACRLQHLFRLVPPDFAXPFAQQFDRDQLXAYXRFNSVTMSPRIVPKYGCXFXTXATASPHWHLPYTPXTLLASSIPLQHGYKVPTFPPSLSISVLHEARCGSFFEIYLHSXNPHTSRCDYVAKNRAQIRLXFSHGGHGLTSLASTIHASYAASLIDTAPARLQGPHFPAVSQYQRFARGPLRVVLRNLPSFVQPAHFSMTEXDLGCLEPXALLARPERIHTFLLQAQYSAAASSYWQXPLWESFPNPGDHSAASLRKRVRYNSLLAPGATSFLTAHPAATSRVHNATWSTMLRRHLDAPVTNDSISPLRCXHCSKPMDARGDHAXIXSHGFGTLHRHNTVRNVLARQLFRVAGLAYSLEVPFLIPNTAARPADILVQPPPPAPGLPPDXPTAYDVTICSPFRRGMLYHAARHRGGAADAASVRKXKALERTIRXALLIEDDNXPPPLDWHFQPLSFDALGAPSQSTVHVIEDHAKLMALRNSCTIATAKSRIQQRLSFAIWSSAAAAILSRLPTHAADISYPIEV

SEQ ID NO: 1400 - protein, 1473 aa, synthetic construct
  source 1..1473: note = Description of Artificial Sequence: Synthetic polypeptide
  VARIANT 144: note = Any amino acid
  VARIANT 216: note = Any amino acid
MATTTISRSPSSSSSSSSARSRASASTSASVASIPRLFRDGRFHCPLAHCQTRTSTWQDLSAHLTRMHDGDVPRDVAAACGIVQCLHEGCRKWFRGAAGLASHRGKARHAPPPAPRAALAVAAVPRADSRGRTPAPTPSVAPPXAGPPPRAAPRAAPSPLPCPPALPHPPPSASPPTSSVTSPCSPPTTPPSQPSPDLFSGFANAPTTPSPPSTPXSSPAGSPIPAARRFVLPVATPYPAPAPRANRPKLSPVARPFVPKARAGAIPEASSPVTPQDRAVSRREDAAAAPSSAPGLGLADEHEDDDTYGGDTIALTAPHAPRETRAPFEFEACFLEEEAPATAGDLPPYARAFLACPSARLQEIPRRLKSAWQAAAKTIAEAALDCHTAGDTQGYNAHLRLFIELPARGLAVPTNCRGAARTKLQRERLLDIAAGRIPAIPDPPCDAPGADDALRGFPVSGTTAGDVSNDDDSGGVHDRPAATASARQAKRLVEQGLSSRALRALERGEPAVASADTLGRLEALHPPNPTDRGLWPGAPKAAIPRVTAKHLAQVAKELPRGSAPGPSGWTFELVQAAIDRQPTGTVAAFLIDMAQRALRGTLHWRGLLTASRLVALKKPDGGVRPIAVGEALYRVIGRLVLKADRVMSSADATQYVGRHQYGVAYPGGVEAPVHAVRELHDSGQLRAVVSLDWRNAFNSLDRVHTALLIADRAPALARLYEWSYREDSVLVLPRAFEKAGLPASLLSQAGVRQGDVLGPLFFAIGAAPVLDEIDAIPYVTPRAYLDDIFVTIPHGVTDAATKAAVAATFATAEREGAAAGLRLNRCKSAVWAADAEALLPPHAAGAREDVESCAPVREGLKILGAPVGSPAFVAKSLDGIIKRAIGTLDLVADAELPLQHKLVLLRQCVAQIPTFWARAVPDAGPALAVWDTALLRRTGALVGLDVRDGSLQADIARLPVRLGGLGLRSMKDTAPRAFVASILFAAALANTRRSELTCSASTARRLRAALPELARTDACNDEAAWRRSIARGVFPDVDKLGTTQLQRVLQGMADSKSAHRTRRQVPFLFAAVFEDAATPGSGAWLAAIPSDPTLVLPDAELAEAVRIKLLTTTANAAGVCPACHKTGIDPSHAYTCVSLSHLRTARHDVVVRRVELACKTEKPVREHVLAIPPVAPTDNNNNGDEDGSPVTTADDNADGHAVATKRRPETRASARAAAAAATAAAAAAIINDNSLLSDDDDDDDHDDNCHGEERGEGERNVTCPGHYTATPFAADDTLDNSDEDNEDNAHEDDDEDGKDDNDDDVYNNCNSSSSDGDEGGDDLDYEYSDQSVTRSVDAATGESPNPERPTTPTRALLRADLWLPATSTAVDVMVAAACRRSRAKAFDRAVSRKAAKYGPAVADGSIAKVVPFVVSPFGVLSRPAKAFLKRAMGDTTAAKQAKARLRLAVAAVRGTARLSYAWGACAALIVGGN

SEQ ID NO: 1401 - protein, 1220 aa, synthetic construct
  source 1..1220: note = Description of Artificial Sequence: Synthetic polypeptide
MAPLPWNAATSSPPSPVPLTNDKKKDSTLPTATSKNLSKNNNNKNNNTNRINNIKNNDNTNDGSNKINLKLPPAAVKITNPYKNKKKNKKKNNAGKSNPKTNQNPNSSPLSDNDDDDTDSSNITINRRLKFGTDDLAPPNPPSNTNTIGTATAATAATATTTATAATATTATNTTTTTTTTNNTTGDNLASNINNNNNNNNSGSNNSNTNNINNTDGNGSNNRPPPRVYTVDPRSDLPGAEISAANKMLDEVYGDHVHDNPGSHLSGLISSSQDQLWQGYFRRLIPHNQSLYDCPKGKLGKDITNEYSNLFEAIMNGKCNMEKLLVFPVVVLQRRHGVTKNADVKRRLLSRLTAWKEGKFKYLVEDTHRDLIAKQSKARGDTTPAHRAKVYSSKLMRGHLQSAVNYITDREGGGILYPYDVDEKSGHTVSRVLQDKHPSMRDPGPTAMPAYESVPELPTLEITADTVEIVAGKLSGGAGLSGVDSIQLKHLLLHHGQASQRLRNVCAKFGRWLANEHPPWASYRAMLANRLIALDKMPGIRPVGIGDTWRRFFAKLVLAVSMSYATDCCGSDQLCAGLRAGVDGAIHGLSAMWREMESEENTGFVLIDADNAFNEVSRINMLWTIRHEWPAGARFAFNCYRHHSLLVVRNPGGKPFTFFSKEGVTQGDPFAMIAYGVALLPLIRKLKELNVLLVQSWYADDASAAGKFDEILRLFQDLLRMGPDFGYFPNASKSILITHPDNVVAAHHFFNETHGLGFKISTGSRFLGGFIGDTTSRDEYVSTKIADWIHGTKELAAVARLKYPHAAYTGITKCLQHKWSFTQRVIPGIDDLFQPLEDELTNNLLPALFGDPPSTMDDKLRLLTALPVKHAGLALPNPVTSSATNYKNSTLMSSHLLLAVQGKINFSLQDHRDTCQSSLSASRELRQTENDSSLTNLLAALPPAAAGQPSTTRAIKRAGETGLWLTTIPNHINGNILGCDEFIDAIRLRYQKVPHNLPAKCDGCGSAFDVGHALQCKSGGLIIRRHDELNLELASLAKMALRESAIRAEPEINPSASIMDSPTTITAIDTNGDRGDLLIKGFWDNGMDAIIDVRITDTDAKSYRTRDPKKVLQSQEKEKKKKYLDQCLLQRRAFTPFVVSVDGLIGYEASNVLKQLSKRLADKWNKPYSVTCGIVRSRISIACARASNQCLRGSRIPFKTMSRQIQWEDGAGAGLYRIVR

SEQ ID NO: 1402 - protein, 1027 aa, synthetic construct
  source 1..1027: note = Description of Artificial Sequence: Synthetic polypeptide
MNMVSICKRCDRSFTTLKGLNIHKGQCKIFVSNTNKQINNVVNNELTTPNKNKVEINTILNCDEISVEHYSTNTPYLPKINICESIIDPNDYLWGHMPFSFLLNHVNTIYDEIVFYHKNLFKVPSGKGGKMFIEELTFWLKQFNNRTKLNGIAMKCFMIVPSLMLQKPSIRSKAKEHAECLVRRITLWRNGNFSELMREIRYIQSKINTSKKKRTFEDISRIFAKLMMEGKVAAALKVLDRESSGILQCSESVLKELKSKHPDETPVQDNCLLYGPLQNTPECLFDSIDEISIFNSALQTKGSAGPSGMDADLYRRVLCSKCFGPSCKTLREEIATFTKNIATKSYQPDIVQPYIACRLIPLDKNPGIRPIGIGEVLRRIVGKTISHHCQKEIKEAAGPLQTCAGHGAGAEAAIHAMQKIFHQEDTDGVLLIDARNAFNCLNRSVALHNIQITCPILAMYLVNTYRKPAKLFIYGGETIFSKEGTTQGDPLAMPWYSLSTVTIINTLKLVIPDVKQVWLADDATAAGKLQSLKKWYKCLEDVGGLYGYYVNQSKCWLIVKSDNQAEEAKLIFGNSINITTQGKRHLGAALGSEAYKKVYCEDLVSKWSKELNNLCEIATTQPQAAYSAFIKGYRSKFTYFLRTIEAFENFVTPVEKILSEKLLPVLFGTDCSIIKENRDLLALNPSEGGLGICNLITEAKEQHTASKKITNLHIKSILDQSDVMKEKDDFGKTFSEIKTKTNMDKSKKKKEEVKKIHAGLPENLKLLVEQACDKGASSWLNTLPIKEQHLDLNKEEFKDALRLRYNVPLANLPSYCACGEKFDELHAMSCKKGGFVCNRHDNIRDLLTVCLNKVCTDVQAEPHLIPLTNEKFNFKTANTNDEARLDIKAKGFWRKGETAFFDVRVTHVNSKSSKKQPTKHIFRRHEDAKKREYLERVLEVEHGTFTPLIFGTNGGFGDECKRFTALLAQKLSLKMGERYGAVINWLRTRLSMEITRASLLCLRGSRTPFRHYNTDDVGLENVQCGLI

SEQ ID NO: 1403 - protein, 1068 aa, synthetic construct
  source 1..1068: note = Description of Artificial Sequence: Synthetic polypeptide
  VARIANT 33: note = Any amino acid
  VARIANT 100: note = Any amino acid
  VARIANT 350: note = Any amino acid
MASSSTSSSDICLCPFRSFHCCPNGEVGSKGIXRMISHIKRHHLLTEDRKCVLREALSSDVGLFMAVEETLKAFGQWMCGKCMTLHALSRYCHHPDGRVXFVTGADGSSRYIVGILKPSTKESVTNALGGLVFDVGLLDRVFKEPITTVKSIPHSCRLAFSQALKTALYKVIAQPGSVDAWICLLLLPRCTLQVFRPKNRQECRSGNRKSLQQSSILKSLDTWGKEDGIRKLVQNMLDNPEVGAMGQGGGILQKESTSSNTNIRQCLRKVADGHFTAAVKVLCSSGVAPYNGDTIKALEDKHPFRPPPSMPSPIISEPPLVADFDCVFGCIKSFPKGTSCGRDGLRAQHXLDALCGEGSAIATDLIRAITSVVNLWLAGRCPTILAEFVASAPLTPLIKPDNGIRPIAVGTIWRRLVSKVAMKGVGKEMAKYLNDFQFGVGVSGGAEVVLHSANRVLSEHHADGSLAMLTVDFSNAFNLVDRSALLHEVKRMCPSISLWVNFLYGQAARLYIGDQHIWSATGVQQGDPLGPLLFALVLHPLVHKIRDNCKLLLHAWYLDDGTVIGDSEEVARVLNIIRVNGPGLGLELNIKKTEIFWPSCDGRKLRADLFPTDIGRPSLGVKLLGGAVSRDAGFISGLAMKRAVNAVDLMGLLPQLCDPQSELLLLRSCMGIAKLFFGLRTCQPVHIEEAALFFDKGLRRSIEDMVVCGGPFFGDIQWRLASLPIRFGGLGLYSAYEVSSYAFVASRAQSWALQDHILRDSGICGMDSDYLCAMTRLRDTIPGFDCSGFTNKDTPPKSQKALACALFSKIVKDMEVDFDMTVRQKAVFECLRAPHAQDFLLTIPIDGLGQHMSPVEYRTILRYRLMIPLFPIDEICPVCRKACLDTFGEHAVHCRELPGFKYRHDVVRDVLFDACRRAGISAKKEAPVNFLTDPQDGRSTLRPADILVFGWVGGKHACVDLTGVSPLVGLRSGGFTAGHAALKAAACKVAKHENACIENQHVFVPFAFDTFGFLAPEAVELLNRVQRVMHSNVISPRSTDVVFKRISFAIQKGLAAQLVARLPSIDMY

SEQ ID NO: 1404 - protein, 1461 aa, synthetic construct
  source 1..1461: note = Description of Artificial Sequence: Synthetic polypeptide
MATESGGEDSWTQVRGAKRPSAESPPSNTTTSPSQTHRSAKHTKHGSARHDRNHVFPDPMTTPLRPHARHSVPTARASSHVPSTSPAAGATESSARAVVPAAEPVTRTSNGGGEQHPIIGNTSNASPRTPRTPSSPRSFAQVAAAMPAAATATSSAPMTEDLSASVPSEPNGSGEQQPSPESTGQTHHSIPNTPSDFLTMSSDESDSPPRSTALRAPTPIAPPAHDGDGDTNGSATPEPLVQSPTPAQMVLPYPSGTQQTHSDPSPPSASPPATTILPAAISHPVEHSEHANSAPLGEVSESETHNTAGEHSESEQDVLLSDPAPPIAANVLDAQRKVLLKTSGHRQLLACPFGLCKCKGPRLDRKAWVNHVLREHPYDEQATDLVKQVMEAKLVAQCNKCHLFFEAAGISQHRSRCGANLKRATEALFHAAGHDLLEIMRGAWPQQCVGSRISVCELLKLARHPLMQRSRYPSNATETKLMAATLSQLYWSAVHSDYTAEEREMCWALILALPSMLLSAPSTALSTIDLRNMFHDRLRWLVTGQLGRVVDAMRKAVARKQSRRGQLNAGAGAHPNDAVDQSLRSLVRDPDLADEAWANHVTNRLNRGQIAKAFDADKARAVIGNSEVQAVRDLLVPPGLTPYIASTPASTSTLAPATAVSSPTVSFTKGELPKALAATKGVTDPYGWSGELLASIYRIKEHFSQVLGPRQGSTSDPTAPSDGDAPQGPTTATGGPQVALNKIFHHIANNTVPESIRHALCSINYTILEKANGKFRPVGTDSIFNKVVNRALLEQQQPHIAHLLQASPELAVGVKDGISAAVGMAFGELQACESTPGWTMLSLDFKSAFNYTDRARLHEIVADKVPGLLRAFERHYARPTTHCIVDKFFKVIDIDVGQGIVQGNELSPFFFALYSCEVLGLLDATTDYRCKVIKYLDDIVLMGPAEDVAADVEIVKARAESAGLHLQPSKSRFYMPRHHSASITAIKSVLPDAVRETANTGMTVLGTPIGRREWMKKQLNDKAKHIAGKLNDMLTTGVSLQALLTAMQYVPSLINHLYTLPPSLTSGLSELLNRACKDTFVKAFFAKVNLSAPAGAEGHDVTLEQLLEARLFTRANTGGFGLHDLVERGPVAYVCNMAKLATRYPRVYDRLLEDASRAADFEAHVQRAGFQMATVKDAATQRPAEIIALRSKAALDDLMAKCALDLQQAYLASREWGVSTVLTMRGRDKLRRLSDTTFAIAVVSMMGFGLHELINVKPTDKCPLCSSKTPQPRLTREHLLTCRPIKRHNALRDEMGRLLRYATLSHVWVEKSGYNANGQSCRIDLHCRNPFPGGALGPALPDLGIDVTVRTAQPPTTSQACIKVGAALRRAEKEKRDYYTGFNHGKTLIVPAAMTTTGGFASSFVDLLGQLARCAEARGVYQPGLDEAFVPRWKGRFAALVHQMNADHIQRHFGGVCLRSS

SEQ ID NO: 1405 - protein, 1095 aa, synthetic construct
  source 1..1095: note = Description of Artificial Sequence: Synthetic polypeptide
  VARIANT 276: note = Any amino acid
MSSCKVTIPHVCPYCKVELKTICGINRHILKCKKNPLQIPSLQKTNTSLTLEPNTKVIPSITKQNDIIIASTSSNNLAFNQKKDYTLTPTYSRKTTPVSILSSMKMTPISITSHIVRRKLPELPSQTTNHLFNENFINVPFLPEIMNHLPVPNNNVMWGVYSYQQFKLFVDSTYDEIVNYRRNIFNIPSGKAGKEFIEELTFWLRKFNSTSSLNSIALKVTMILPNLLLQKPSAKSKSKEHTLCLTRRIDLWKKGDTSLLLKEVRNIQKKFVNSKXKRSMDDISRIFAKLIMEGKITAALKFLEKEASSGILPLSDNTLKDLKSKHPEPSRVEDYSLLFGPIDLIPKCFFDCIDEQLVMKAAFATKGSAGPSGMDADIYRRILCSKNFIKEGKELRKEIAKMTQNLLTETYEPTFLEAFTACRLIPLDKNPGIRPIGVGEVLRRIIGKVISWSFNSEIKEAAGPLQTCAGHGAGAEAAVHAMKEIFDNVQTDAILLIDAKNAFNCMNRQVALHNIQIICPLISIYLINTYRNPSRLFVAGGKEISSQEGTTQGDPLAMPWYSCNTTIIIEHLLVNYPQVKQVWLADDAAASGSIANLHSWYQHLIDEGCKHGYYVNQSKCWLIVKSPSLAENAGIVFGKSVNITTEGQRHLGSVIGSQNFKNKYCTEKVAKWLTELKQLCKVAETQPQAAFIAFTKGFRSKFTYFLRTIPKFEQYLAPVDEILSHLLLPTLFGKDTPFEDHIRKLFTLTPRDGGLGIPILVEEAPHQFLSSVKLTKNLVQQIIDQDKILKTKNSSGNVLEDLEKILTTDRLKHRKEKIIAVDSMQPDSMLRNIQQTRSECASTWLNALPLENQGFVLNKEEFRDALCLRYNFDLKNIPRICECGEPFNVTHALSCKKGGFISSRHDNIRNLFTTLLKRVCINVQSEPHLIPLDNENFYFHTANKSNQARLDIKANGFWRNGQTAFFDVRVTHVNSMSNKNLDIAAIFRKHEKEKKREYGERVREVEHGSLTPLVFGTNGGMGKECHRFVRRLAEKLAEKQNEKYSVVMTWLRTKLSFEILRSTILCLRGSRTPWTKKNDFEIGVDFKMDALEARI

SEQ ID NO: 1406 - protein, 1070 aa, synthetic construct
  source 1..1070: note = Description of Artificial Sequence: Synthetic polypeptide
MVCPTCNGVYADYNDHIRKKHPDERYTALQLQPLGLTPCPICKTACKNDLGVKTHLSKIHKISGASKISTQPRIRTENTDNTNSVPTSSFNPVLPEIQTLTPGLNNSRWADNPRKRRADTPSPTRGRNTRPRRFSYTDIDLTNDEPADNPRANNPRVNNPRVNNEPPSSPNSLPSISEFHTPGTLPLTNSNISLKDQHDKITGPILQKPLIQKLIEYSKIPIPEHHLHARQAKIFADAANRIAKNFIQSPTEKTLFNLLILPRIFGIGLINGKVTKIMQNFPSQIPPIPKIDFPSEKTDSDPVLNAKKLLEKGYIGRAAKAIIDPTPVAPETPESLNILREKHPIGQNNPFNTKSQPISGRQITEKAILLAISSIGREKAPGLSGWTRSLLDAAIKIPTQNDVIPALRLLTDMIRQGTAPGRELLCASRLIGLSKPDGGVRPIAVGDLLYKIAFKAILNTLWSPNCLLPYQLGVNSIGGVEPAIFTLEEAIMGPNINGIKSITSLDLKNAFNSVSRAAIASSVAKYAPTFYRSTCWAYNQPSILITENGSVLASAQGIRQGDPLGPLLFSLAFRPTLETIQKSLPYTYIAAYLDDVYILSKTPVKDKIAKIIEKSPFTLNSAKTTETDIDTLKTNGLKTLGSFIGPTELRKEFLQNKIQNFESSINALKKLPKQYGLLILRKSTQLLLRHLLRTLNSQDLWELWEKTDKLIADFVINLTVTKRKKRPITDFVTPLITLPIKDGGFGLLRHNGIAQDIYFAAKDLTTEIRHKIQRISNDFPQNQSPTATEILHLLHNGVLADCKNGLTNAQLNALTENASYLGRKWLNILPIQKSNRLTDWEMAEAVRLRLLAPVKPLTHPCNHCGNRTNINHEDVCKGAVRKYTARHDQINRSFVNSLKSRPEIDVEIEPDLNNENNVNNANTTTENPTPSPNGQNDTGCLFTTPIRSGTRNGQNGLRADFAVINGVSKYYYDVQIVAINKDSGNTNPLNTLADAANNKRRKYQFLDPFFHPIIISAGGLMEKDTAQAYKQIQKLIGPVAAHWLDTSISLILLRSRTTAAISIAKNRPRA

SEQ ID NO: 1407 - protein, 1101 aa, synthetic construct
  source 1..1101: note = Description of Artificial Sequence: Synthetic polypeptide
MNAVCVCGKVCKNQRGLRIHQTKMACLRRVQAEHRSGAVATTVEPVLSASAPGQTEEDQGPEAPHSARNLRATPAPPQGRKSDHHRVKWPAANSKEWSQFDEDVDMILESVSRGSTDQKLQSMCTVIMSMGAERFGTIGQRKPTDTMKPNRREVKIRQLRQELKSLRRSFKASTSGEERAALAELTHHLREKLRTLRRAEWHKKKGKERARKRSAFITNPFGFTKRLLGQKRSGNLTCPVEEINLHLSNTFSDASRDVDLGPCPLLVTSPEPEVHFDISEPTLKEVRETVKAARSSSAPGPSGVVYKVYKHCPRLVVRLWRILKVVWRRGKVAADWRQAEGVWIPKEEESSKVDQFRLISLLSVEGKIFFKIVAQRLIKYLLDNQYIDTSVQKGGVPGVPGCLEHTGVVTQLIREAKENRGDLAVLWLDLANAYGSIPHKLVETALTRHHVPESIQNLILDYYSNFWLRAGSSTATSAWQRLEKGIITGCTISVPLFALAMNMIVKGAEAGCRGPVSRSGTRQPPIRAFMDDLTVMTATVPVCRWLLQGLERLITWARMSFKPAKSRSLVLKKGKVAERFRFTLGGTQIPTVSEKPVKSLGKVFNSSLKDTASVQQTRSDLTTWLEGIDKTGLPGSFKAWMFQHGVLPRVLWPLLVYEVPMTMVEQLERTISRFLRKWLGLPRSLSNIALYGRSTKLQLPLSGLTEEFKVTRAREVLMYRDSSDSKVSSAGIHVRTGRKWKAQEAVDQAEARLRHSVLVGSVAVGRAGLGSCPKPRYDKVSGKEKRLLIQDEIRAGEEEDRRCRMVGMRKQGAWTRWEHADSRKVTWPELCRAEPSRIKFLISSVYDVLPSPANLHVWGLAETPSCQLCQRRGTLEHILSCCPKALGEGRYRWRHDQVLRVLADTVSNAIQSSRSQQPPKKSIVFVRAGEKTRQQPTSAGGLLSTARDWQLLVDLGRQLKFPEHIVATSLRPDMVLVSESTRQVVLLELTVPWEERISEANERKRAKYAELVVQSQSNGWRARCVPVEVGCRGFAGQSLAYVLKLLGVRGFRLRKSIRDILEAAEKASRWLWFRRGEPWKPHGHRSGNDQPRLGRPGEGVW

SEQ ID NO: 1408 - protein, 1087 aa, synthetic construct
  source 1..1087: note = Description of Artificial Sequence: Synthetic polypeptide
MTHANEQTTNKIYVTCICGKLCKNHWGLKIHQARMKCLEQESKVQRTGPEPGETQEEPGPEATHRAKSLHVPEPQTPSEVVQQRIKWPPASKGSEWLQFDEDVSNIIQAIAKGDADSRLKTMTTIIFSYALERFGCIEKGKTKPTTPYTMNRRATQIHHLRQELRSLKKLYKKATDEEKQPLAELKNILRKKLMILRRAEWHRRRGRERARKRAAFITNPFGFTKQLLGDKRSGRLECSIEEVNRFIEETVSDPLREQELEPNKALISPTPPAREFSLRGPSLKEVKEIIKASRSASTPGPSGIPYLVYKRCPGLLLHLWKILKVIWQRGRVAEQWRCAEGVWIPKEENSKNINQFRIISLLSVEGKVFFSIVSRRLTEFLLENNYIDPSVQKGGIPGAPGCLEHTGVVTQLIREAHENRGDLVVLWLDLANAYGSIPHKLVELALHRHHVPSKIKDLILDYYNNFKMRVTSGSETSSWHRIGKGIITGCTISVILFALAMNMVVKSAEVECRGPLTKSGVRQPPIRAYMDDLTITTTTVPGSRWILQGLERLIAWARMSFKPSKSRSMVLKKGKVVDKFHFSISGSVIPTITEQPVKSLGKLFDSSLKDSAAIQKSKKELGAWLAKVDKSGLPGRFKAWIYQHSILPRVLWPLLIYAVPMSTVESLERKISGFLRKWLGLPRSLTSAALYGTSNTLQLPFSGLTEEFMVVRTREALQYRDSRDGKVSSACIEVRTGRKWNAGKAVEVAESRLQQKALVGTVATGRAGLGYFPKTLVSQVKGKERHHLLQGEVRASVEEERVSRVVGLRQQGAWTRWNTLQRRITWANILQADFQRVRFLVQAVYDVLPSPSNLHVWGKNETPSCLLCSGRGSLEHLLSSCPKALADGRYRWRHDQVLKAIAASLASAINTSKNHRAPRKAVHFIKAGEKPRALPQLTTGLLHKASDWQLEVDLGKQLRFPHHIAATRLRPDIIAISEASRQLIILELTVPWEERIEEANERKRAKYQELVEECRERGWRTYYEPIEIGCRGFAGRSLCKVLSRLGITGVAKKRAIRSASEAAEKATRWLWIKRADPWTAVGTQVGT

SEQ ID NO: 1409 - protein, 1001 aa, synthetic construct
  source 1..1001: note = Description of Artificial Sequence: Synthetic polypeptide
MALPAVRSGPASTWTLLITLVIVAAKGTDGFMSFKLPLLSTDTWSGYNNDVKTLLGPLHHELATNEMSPKLAGEGFSDIMCDFMASKPEFSHTTEESHSEGYISHEPQSLAQVKRLKNKLRKKAFRADATPEDRKAFRDAIKTYSFMKRQQKRKETTKSAAHQEKEYHKNFWKFAGKCAKGQLDIPPVKPAFSVYYANEYYKNKYSHPTRVDFNKLLWFPHLPVEEQLPANSFDMSPVRPKDIKAVLSKRCATSAPGPDGIMYGHLKHLPACHLFLSTLFSKLLESGDPPTSWSSGNVSLIHKDGSPEAAENFRMICLTSCVSKIFHQILSERWAKYMTCNDLIDPETQKAFLTGINGCVEHVQVMREILAHAKKNRRTVHITWFDLADAFGSVEHELIYYQMERNGFPPIITTYIKNLYSRLKGKVKGPGWESDPFPFGRGVFQGDNLSPIIFLTVFQPILQHLKGVEQQHGYNLNDKHYVTLPFADDFCLITTNKRQHQKLITQISSNTKSMNLKLKPRKCKSMSIVSGKPSDISFTIDGDPVKTTKDAPEKFLGGYITFLSKTKETYDILAKTIETTVENINKSAIRNEYKLRVYMEYAFPSWRYMLMVHDLTDTQLQKLDSIHTKAIKTWLRMQPSATNAILYNTRGLNFKSISDLYLEAHALAYSRSVLKADEKVKHALQAKLDRESQWTRKMQKWGIGKCHTIHQQAIHVAKDSEWTSVRKHVKQQVTDMRHDVWTKHQENLLQQGQMLQLLEEEKCDLTWRSAMYNLPRGILSFAVRASIDALPTLCNLTTWGKRNTDKCKLCGNRETLHHVLNHCGVALQQGRYTFRHNSVLKHITDTIIESIDTSRINATIYADIQGYTTNGGTIPVHTIPTTQKPDLIIYLPEQKTLHIHELTVPFEKNIKTSHDRKVNKYSTLAADLETAGISATLTCFEVGSRGLVTPENKTRLRTLFKIVKAKPPKTLFTDISRIAMLSSYAIWNSRHEPYWESETLL

SEQ ID NO: 1410 - protein, 1074 aa, synthetic construct
  source 1..1074: note = Description of Artificial Sequence: Synthetic polypeptide
MTTHRAEVTTSGKTQEEPGPEATHSAQSLLVSPTPAAGRSPATQSCPQVTAAHNSPQSPQSQQVAVTRSDCVPLAQPRIQWPQSSKKAEWLQFDKDVNQILEVTGKGGVDQRLSTMTTLIVNIAAERFGTVTPKPTPSTYTPSHRVKEIKRLRKELKLLKRQYKAAGEVERAGLEDLRGILRKQLVNLCRAEYHRKRRRERARKRAAFLANPFKLTKQLLGQKRTGKLTCSKEAINNHLKATYSDPNREQPLGPCGALLTPPEPTSEFNMKEPCRSEVEEVVRRARSSSAPGPSGVPYKVYKNCPKLLHRLWKALKVIWRRGKIAQPWRYAEGVYIPKEEKSENIDQFRVISLLSVESKIFFSIVAKRLSNFLLSNKYIDTSMQKGGIPGVPGCLEHTGVVTQLIREAREGRGDLAVLWLDLTNAYGSIPHKLVEVALEKHHVPQKVKDLIIDYYSKFSLRVSSGQLTSDWHQLEVGIITGCTISVTLFALAMNMMVKAAETECRGPLSKSGVRQPPIRAFMDDLTVTTTSVPGARWILQGLERLVAWARMSFKPAKSRSLVLRKGKVRDEFRFRLGQHQIPSVTERPVKSLGKAFNCSLNDRDSIRETSTAMEAWLKAVDKSGLPGRFKAWVYQHGILPRLLWPLLIYEVPMTVVEGFEQKVSSYLRRWLGLPRSLSNIALYGNTNKLKLPFGSVREEFIVARTREHLQYSGSRDAKVSGAGIVIRTGRKWRAAEAVEQAETRLKHKAILGAVAQGRAGLGSLAATRYDSASGRERQRLVQEEVRASVEEERTSRAVAMRQQGAWMKWEQAMERNVTWKDIWTWNPLRIRFLIQGVYDVLPSPSNLYIWGRVETPACPLCSKPGTLEHILSSCSKALGEGRYRWRHDQVLKSIAEAISKGIKDSRYRQATAKVIQFIKEGQRPERTAKNCSAGLLSTARDWVMTVDLERQLKIPPHITQSTLRPDIILVSEATKQLILLELTVPWEERMEEAQERKRGKYQELVEQCRANGWRTRCMPVEVGSRGFASYTLSKAYGTLGITGTNRRRALSNNVEAAEKASRWLWLKRGEQWGQ

SEQ ID NO: 1411 - protein, 1085 aa, synthetic construct
  source 1..1085: note = Description of Artificial Sequence: Synthetic polypeptide
  VARIANT 172: note = Any amino acid
  VARIANT 744: note = Any amino acid
  VARIANT 910: note = Any amino acid
  VARIANT 944: note = Any amino acid
  VARIANT 1056: note = Any amino acid
  VARIANT 1068: note = Any amino acid
MTPAMEMTTTVTCICSKLCKNQRGLKIHQARMKCLEREVEVQRTGPGPGETQEEPGQEATHRSQSLHVPEPPNPNRVVQQQRIKWPPANRRSEWLQFDEDVSNIIQATAKGDVDSRLQAISTIIVSYGSERFGRIEKGNTETTSYTMNRRSFKIHQLRKELRTLKKQFKRAXDGDKQALKELYNILRKKLKTLRRAEWHRRRGRERARKRAAFIANPFRFSKQLLGDKRSGRLECSREEVNRFLQNTMSDPLRGQDLGPNRALISPAPPSAEFKLAEPSLKEVEEVIKAARSASSPGPSGVPYLVYKRCPEILRHLWKALKVIWRRGRVADQWRCAEGLWIPKEEDSKNINQFRTISLLSVEGKVFFSIVSRRLTEFLLKNNYIDTSVQKGGIPGVPGCLEHNGVVTQLIREAHESKGELAVLWLDLTNAYGSIPHKLVELALHLHHVPSKIKDLILDYYNNFRLRVTSGSVTSDWHRLEKGIITGCTISVVLFVLAMNMVVKAAEVECRGPLSRSGVRQPPIRAYMDDLTVTTTSVPGCRWILQGLERLILWARMSFKPTKSRSMVLKKGKVVDKFRFSISGTVIPSITEQPVKSLGKLFDSSLKDTAAIQKSTEELGGWLTKVDKSGLPGRFKAWIYQYSILPRVLWPLLVYAVPVTTVESFERKISSFLRRWLGLPRSLNSAALYGTSNTLQLPFSGLTEEFKVARTREALQYRDSRDCKVSSAGIEVKTGRKWKAEKAVXVAESRLRQKALVGAVATGRTGLGYFPKTQVSHARGKERNHLLQEEVRAGVEEERVGRAVGLRQQGAWTRWESALQRKVTWSNIMQADFHRVRFLVAAVYDALPSPANLHAWGKSETPTCSLCSGRGSLEHLLSSCPKSLADGRYRWRHDQVLKAVAESIALAISTXKHHHAPKKAISFIKAGERPRAGPQITTGLLHTAXDWQLHVDLGKQLIFPQHIATTSLRPDMIIISEASKHLIMLELTVPWEERIEEANERKRAKYQELVEECRGRGWRTFYEPIEVGCRGFAGRSLCKAFGRLGVTGTAKKRAIKXASEAAERATRWXWLKRADPWVATGTQAGS

SEQ ID NO: 1412 - protein, 1112 aa, synthetic construct
  source 1..1112: note = Description of Artificial Sequence: Synthetic polypeptide
MATTQASVKPTAVATCVCGKICKNPRGLKIHQTKMGCLASVQPEQRARFSLSESREVPARAEPYGPQQPHSPEALGETQEERGQESPHSAQNLRAQVAQAPDNPQHHRRVKWPPASKVSEWQQLDEDLEGILESTAKGGVDRKLQTMTTLVISFATERYGTMEKRAAPEKYTKNRRAEKISQLRQELRVLKKQFKGASEDQKPGLAELRCTLRKKLLTLRRAEWHRRRAKERAKKRAAFLANPFGFTKQLLGQKRSAHLECAKEEVDSYLHDTFSDAERENSLGECRVLISPPEPACSFNTKAPTWKEIQTVVRAARNNSAPGPNGVPYLVYKRCPKLLARLWKILRVIWRRGKVAHQWRWAEGVWVPKEEKSTLIEQFRTISLLNVEGKIFFSILSHRLSDFLLKNQYIDSSVQKGGIPGVPGCLEHCGVVTQLIREAREGRGSLAVLWLDLANAYGSIPHKLVEMALARHHVPGPIKTLIMDYYDSFHLRVTSGSVTSEWHRLEKGIITGCTISVIIFALAMNMLAKSAEPECRGPITKSGIRQPPIRAFMDDLTVTTTSVPGCRWILQGLERLMTWARMRFKPGKSRSLVLKAGKVTDRFRFYLGGTQIPSVSEKPVKSLGKMFDGSLKDAASIRETNDQLGHWLTLVDKSGLPGKFKAWVYQHGILPRILWPLLVYEFPISTVEGLERRVSSCLRRWLGLPRSLSSNALYGNNNKLTLPFSSLAEEFMVTRAREVLQYRESKDPKVALAGIEVRTGRRWRAQEAVDQAESRLHHKELVGAVATGRAGLGTTPTTHLSRLKGKERRDQVQLEVRASIEEQRASQWVGLRQQGAWTRWEEAMARKISWPELWRAEPLRIRFLIQSVYDVLPSPSNLFLWGKVESPSCPLCQGRGTLEHILSSCPKALGEGRYRWRHDQVLKAIAESISSAMEYSKRLPLPGRGVRFVRAGEQPPPQPRAQPGLLATARDWQLRVDLGKQLKFPENIVETNLRPDIVLHSQSSKQVILLELTVPWEERMEEAYERKAGKYAELVEDCRRAGWRSRCLPIEVGGRGFAGKSLCKAFSLLGITGMRRRKAICAASEAAERASRWLWIQRDKPWTSASWTQAGN

SEQ ID NO: 1413 - protein, 1522 aa, synthetic construct
  source 1..1522: note = Description of Artificial Sequence: Synthetic polypeptide
MMDSRQLNTPKIRKYQNPKMTNDIMKSYNYAVLSDVTPQETTQTTTHLNVDIDNETTQPKQPLTKSGKPKSKPIAVSYKFKDATFIWDTTPQTNPPRDCTKLIDKTRPRKTIFKKSAFQSYLKKELSNETFVEVKTFLMATHKYRFKDENSRLLAYRIINRYVMETANEFKETEFDMARFAKFFTIPENWLKHLKPYSTATETSPADRIKVQKLVDLTCRYPFKTQEEQTSVANFLHFFTQRSIIGISRDYKFQKFIPFMARKNTRPETTSTMVTTSPTEQNRLPMVIITPLEEPKSEHRRPEKRGASNDTIVLSDEEFPLLKRRTLPTRKSKNPTGAGNVPTETECTDEVKFILNNEYQIECKECGKVWENVRNGLNHLRQKHDFPNRTDVMVSCVRCEVPIKGAECVNHIKNHKKDDKEESEAGSLVANTQDIPNESSLSQAAIEVYLRNILKMKENQERNIQYLEPSTANFLINRNLRAFYQNVKIEKLIGWEQVIWLIHWNKCHWIVYLANCDSKTSVILDSDNQMTLQQRCNIKAKFDKFLEGTFEEKTVLGTLERKVPQQPNNFDCGIYVIQYISDFLKDPQRIDYHTPDSKRIRKEIGELILEEMKNPASKIKNPNKEIQSLLQKFRLLQINVNDVFHWFAAEYQKSLPKIRTKRDGKLNKLSCSYQIQRLFGLAPKRAVKEIYFQETSTADLETRVLNEHFKKDESTMKECKIKNGNHYQDWITKAQIDNKEILEALKNSTDSAPGEDNIPLRQWIIWNNDGVLFDMFNYIKRTHDIPDMWKNYTTTLLIKPGKSQESNIPANWRPISILPTSYRIFMKVLNKRVLEWANRGELISKWQKAVDKANGCDEHSYVIQALIEKANRSYYKNEQCHLAFLDLADAFGSIPFQVIWHTLKNMGMDEETINLLKEIYKDCSTKYKCGKNESEKIKITKGVRQGCPLSMTLFSLCIQYLIQGIAEKKKGATIAGQEVCILAYADDLVIVANTAKDMQMLLTTIENLAKQADLIFKPAKCGYYRDPRDKKSMMKIYGKEISIVDEKNVYTYLGVRIGDTKKKDLNVRFEEVKKKTTAIFKSKLRSDQKLEAYNIFCQSKFVYILQGEDIAKTKIETYDEEIKKMIKEDILKLQDKSPFTDFVIYSPREKGGLGITKIIDEQTIQTINRTAKLLNSSHRAIRAIIYEELIQVANLRGEKEINTIEEALKWLEGTNKYKKNSNAKTTWITRVREAFQTLEKKHKIKVRFVPKENCIGYKIKCDTQEKIVELDNSKELSKSLHWMIKEAYYKEWKALKCQGYIISLKTSEFMEWKMPRGLPDPDWRFLTKVKANMLDVNMKQANQGGRLGSTKCRKCEDKESASHVINHCASGNWSRVEKHNQVQNELAKELTKRNISFEKDSIPKETKESLRPDLVIRLKDKIMIVDIKCPFDEESAIESARNKNIDKYRELAKEIQAKTGLQTTVSTFVVCSLGTWDKRNNELLRQMGIRYEESKEMRINMIQKAIHGSRKTYDHHRNFNNG

SEQ ID NO: 1414 - protein, 1870 aa, synthetic construct
  source 1..1870: note = Description of Artificial Sequence: Synthetic polypeptide
  VARIANT 4: note = Any amino acid
  VARIANT 151: note = Any amino acid
  VARIANT 153: note = Any amino acid
  VARIANT 154: note = Any amino acid
  VARIANT 187: note = Any amino acid
  VARIANT 202: note = Any amino acid
  VARIANT 245: note = Any amino acid
  VARIANT 250: note = Any amino acid
  VARIANT 1545: note = Any amino acid
  VARIANT 1547: note = Any amino acid
  VARIANT 1679: note = Any amino acid
  VARIANT 1774: note = Any amino acid
  VARIANT 1809: note = Any amino acid
MPLXISDCVHLVSAEGDTMNGRSTCGPLSRSSSVVSRSRSSPSPSVPPHPSPSIGPDTGLSAGIIGTSRGCSLWLPEVDNALSQWLRKGLERDHEVLVCGFEAAKPLSLSKARLLRKTPRNTGVVRHILEFDGRLVHTNCNETECVLSTLXSXXAVEVVRISLKCEPREPCEPKCVLSILCSDKIVXISFECETREPFPFFXDRKFREPIPFVFERMYDPRDPIPSFICWMYDLRQRMTPGTLPXNPLSXENKDSWGRPAVIKNEIRSMRSYLEENVKENRLNLLRRLRGGGEGKKMIRKLVAEKKSDTEAVCRILYPLDDRYECFVDGCETTSTMGYGSSDLKYMTTHIKKEHGVKVQWTYECSLCNKQAPFMGGAASKWVTAHMATKHTETVKLKLKPSISTTAKVAAKLDEIAVSLPKPRQVRVLRDPDEVKEKVAKPTLASTREEVKRNALRNMAPLVELSSQNQLTGAERPEETSEAMRLEECRTPEKIAELEGKIQTRTVTKKLSALKESMEKRTREEKVGKPSLAPIHEEVKKTARRSLAPLVEPSTFTHLTGASRLQAVRDAFSKANKDAAAKRRSSLAKPARLSEIMNTTFTKETVNETKEPVNDTDESIATIQPQVRVYRFNTWCLDHETTREAWLTGEVVDWFMGKVTEKKDQYRVFDSLVWSMYKFHGVGYVLDLMRDPLTYFLPICEHDHWVLLVIDEKGIWYGDSKGAEPCREIAKFIEETKRERRMFPVPVPLQRDGVNCGVHICLMVKSIVNGEPWYTEEEVKVFRRNVKRGLKEFGFELYSERIVYVGDDSIKVNDEHDDDVVFLSEETNNTTFTIEQAEDPAEEDAQHLESPVKPVKLMELKIPKIEIKKKEIRRKPKQQIEKKRKVPTGKPDELLVRVRLWLEREVQSYFDSGKRFQRLEWILDVLTAAIHKATAGDEQAIERIEKRSPPLEVEEGEMSTQTEPKKRERKEKESGCEMKASHKEMYFKNRSKAFNVIIGKDSKQCEIPIETLQKFFEGTTAETNVPAEVLKEMGSRLPKLEALDWMEANFIESEVSDAMKKTKDTAPGVDGLRYHHLKWFDPEYKMLTLLYNECKNHRKIPSHWKEAETILLYKGGDETRPDNWRPISLMPTIYKLYSSLWNRRIRSVGGVMSKCQRGFQEREGCNESIGILRTAIDVAKGKRRNLSVAWLDLTNAFGSVPHELIKSTLESYGFPEMVTEIVMDMYRGASIRIKSKNEKSEQIVIKSGVKQGDPISPTLFNMCLENVIRRHLDSASGHRCIKTKVKVLAFADDMAILAENRDQLQTELNKLDKECESLNLIFKPVKCASLIIERGMVNKNAEVVLRGKPIRNLDENGSYKYLGVHTGIATRVSTMQLLESVTKEMDLVNQSGMAPFQKLDCLKTFVLPKLTYMYANAIPKLTELKVFANLTMRMVKEIHEIPIKGSPLEYVQLPPSQGGLGVACPKITALITFLVNVMKKLWSSDSYIRKLYRDYLDEVAETETGMEEMTKEDIAKYLSGDVPIDKKAFGYNTFTRVRDVCNSLTXIXGAPLHKLKIVERDGDFAILVQATKEGMEKIFTCAQEKKLQQLLKAEVNTALAHRFFTEKPVKSAVMSVMRQYPQSNAFVKNGKNVSIAVHSWIHKARLNALHCNFNTYGENKSKVCRRCGKDVETQLHILQXCEYGLPKLINERHDAVLHVVRNLIRKGSKKDWKLKIDETVSSCNQLRPDIYMCSPDGKEVIMADVTCPYESGMQAMQESWNRKVTKYEGGFSHFXKMGKKFTVLPIVVGSLGTWWKPTTNSLVQLGIEKXTIRRVIPELCSMTMEYSKDVYWNHIFGDTFRKPPMRFGVEKPKGNSWKKEGSEPKGAASSD

SEQ ID NO: 1415 - protein, 2030 aa, synthetic construct
  source 1..2030: note = Description of Artificial Sequence: Synthetic polypeptide
  VARIANT 53: note = Any amino acid
  VARIANT 67: note = Any amino acid
  VARIANT 169: note = Any amino acid
  VARIANT 222: note = Any amino acid
  VARIANT 274: note = Any amino acid
  VARIANT 342: note = Any amino acid
  VARIANT 351: note = Any amino acid
  VARIANT 626: note = Any amino acid
  VARIANT 1031: note = Any amino acid
  VARIANT 1077: note = Any amino acid
  VARIANT 1239: note = Any amino acid
  VARIANT 1424: note = Any amino acid
  VARIANT 1437: note = Any amino acid
  VARIANT 1550: note = Any amino acid
  VARIANT 1726: note = Any amino acid
  VARIANT 1745: note = Any amino acid
WRRPAPKQTKNSSLHHLGHEVKRIARLKPGIFEFHAKPKNSSLHHLGHGVKRXARLKPGIFEFHAKXKNSSLHHLGHEVKRIARLKPGIFEFHAKPKNSSLHHLGHEVRRNSRLKPGIFGFYQKSKNSSLHHLGHEVRRIARLKPGILEFHAKNRIKSGLKVTFLSDLXAHAGALACSRFLASTLKTEHCRQKSFKPVGFLLHFLKNSSINEVASLRNVKKXFLEFFSGKPIGGMASFSRTKITFFKLCLKNFVLSAENPPIIRQKTNQNKASXVQIARGGHLSDCLPSQKMAGVLGRLFLSVQSTLSHRPFDTLLRSDDDKRGRKTIKLQFFIKENLVTPXVARDVKILXKQTKNNSGNSDSNSETKNFSKNKVSRQNGPLIGGGNHKKIGENQITRTLEIESKSDDNKVLVLRILYPTNDWYKCYSQWCQHKSLVGYGAHDLKYLTDHIKSTHSKKVEWSYQCSICDAKAEGTGTKAARWITAHMPKVHGIEATHRIKQNSEKTTNVKTANSLQEMALSLQKPKNGPKKVVMATSTTPEKKISELESKIQTREVAKQLSALKESAQKNQQGNKTKNVKSSLKTIAENTNETKKISARKSLINYLKPEDVLNHIPKEPKPASAKXGLQELTGAQRLQETRRRFMAGNRRDSIARRESLSLGKISNSFKIELKNAPEKTTLKKPAVTQKQNTSQNVSSSTVVKENKTGNDVITIDDTETVKRKINTWCLDHESTENAWMADDIIFWYIQKQIEISLDNKKFKVIDPLIWTTYRIYGVECVQDELVGFEKYFFPICENGHWVLLIIDDKRVWYSDSLADKPIEVIEDLINKLNRTQGKFNQTVPKQKDGFNCGVHVCLVAKSVITENFWYTEKDVNDFRKTVKLWLFSEGFELYSEPYKQIQNKNISVNSEKNQISDNEKNWGDKTQTVNESTLKERDEDIFLLRPHISVGVALKTEDEKNQKAENLKAPQKLKAIRRLKILKTCLKKLTAVKGKPEETERAAIPNLMAIKLKTPPKVEPVRRNPEKGENYXKSQPNKKRQIPTGKPDELVKKVREWFEIQFQAYFEDGKSFQRLEWXTGLLTAAIHKASAGDEQAVGKIIKRCPPLEIEEGEMATQTETKQKPKNQKSTKGANSSSSIREAYAENRARTFNKIIGKDDKCEIPIEKIEKFFENTTSNTNVPTETLARITSDLPKLEIGSWIEEEFREKEVAEALKKTKDTAPGVDGLRYHHLSWFDPKXKLLTKLYNECREHKKIPGHWKEAETVLLYKGGDETQAENWRPISLMPTICKLYSSLWNKRIKSVTGVLSKCQRGFQEREGCNESIAILRTAIEAAKGTKKSLSIAWLDLTNAFGSVPHESIEATLIAYGFPGMVTEVIKDMYNGASIRVKTKNEKSKQILIKSGVKQGDPISPTLFNICLESVIXRHLKSADGHKCIXSNIKLLAFADDMAILSDSKTKLQQELQKMDDDCTPLNLIFKPAKCASLIIEWGKVQKDQKIKLKGQFIRSLAEQDTYKYLGVQTGIETRVSAMQLMKKTVSELDKINCSALAXWQKLDAVKTFVLPKMTYMYANTVPKLSELKEFANITMRAIKVMQNIPVKGSPLEYVQLPIGKGGLGVACPKTTALITYLVSTMKKLWSTDDYIRKLHTDYLKMVAIKETKTKEVTLEDLASYLSDDKTVCKKAVGYNSFTRVREICKTLSKNKGALLSQLKIIAKDGKLAILVQAXKDGKTKIFTHDHVKTLQKXLKKEINEALLHRFTTEKRVKSEVVRVVQEYPQCNSFVRDGGKVSIGAHRFVHKARLNLLACNYNTWQDAATKQCRRCGYEKETQWHILSSCPKSMGGKITERHDSVLKTVKEMIQTGSLKNWKLKLDHELPGSTRLRPDIYLRSPNGSEIILGDVTIPYEHGIEAMQTAWQKKIEKYEEGFKYLRSTGKKLTIVPIVVGALGSWWKPTTDSLVSLGIDKNTVKRAIPEICSTVLEYSKNIYWNHIFGDSYQKVPMFFGGEKPKGQSWKKVKPPEGKTASNHEPPG

SEQ ID NO: 1416 - protein, 1719 aa, synthetic construct
  source 1..1719: note = Description of Artificial Sequence: Synthetic polypeptide
  VARIANT 138: note = Any amino acid
  VARIANT 766: note = Any amino acid
  VARIANT 797: note = Any amino acid
  VARIANT 966: note = Any amino acid
MTVFIDRGIGERGQMAVCSLHRYFSFSPFSPIPPYVNNGSFGENGCGTDKSLLPVIEVVVREVKINWSENILVVECLIMVKSGERVVVKRQNLEKVIQNLARINSTLFSNLGNQIFCVVPRIKDSTNKEQGYRKEKQXKFHVSFRSIKSQVPPYLRGGGDVMEDTEIRGIRKLEPEAQLDSSKPLICRVLYPTQGYMYKCFYPKCKGHSNGSTDLRSLKKHMVDKHFTNIEFAYKCATCMFLTTGKSATALKSIKAHMASHHKVTMEPGKKSLVQKLNARLEEAAPSLPMPRNRSKVIQLTPEKSISELEKKKQTRSVAKQLSTLKESAQKKEEEVKIAEVKKREPRLSIIPESNVRRSLAAGLEQCINPEQSVAQRIREKREEYAKASREAAAKRRSSLAMKPARLPDKENEITLQETKKIDDPIVIDLEKECILTTVLQVPRNQFNSWCLEHETTIDAWLTDEVIHMYMCTITENRKYFMAIDPVLWPVYVRNGAEDLLRRTSCPGTFFFPICESNHWVLLVIEHDVYWYLDPKGEEPKGNVEILLESMKRKRQYYEFPPPSQRDNVNCGVHVCLMAKSIVDECGYNWYSEEDVRSFRTNMKDILKSKGYELCPEPYNRQNLLKTEKQKEVILEEMIDSFVVEDDMTFTVHRDSDHGDDEVEHLKTIEQEPENEISEIENVEGSVDSVIPKLMEMRVQTPPVINEKRGKKRVSAKEKPRKQKEKEQKVPTGKPDELVKRVRVWFEKEFKSYVEDGKSFQRLEWXTDVLTAAIQKASAGDEKAVELIEKRCPPLEXEEGEMCTQTEKKKKPKSGKGNGGQESMKSLMASYSENRAKTYNRIIGKHSKQCEIPIAKVQKFFEGTTAETNVPKETLKEMCSRLPKVEVGTWIEGEFSESEVTEALKKTKDTAPGVDGLRYHHLKWFDPELKMLSQIYNECREHRKIPKHWKEAETILLYKGGDESKXDNWRPISLMPTIYKLYSSLWNRRIRAVKGVMSKCQRGFQEREGCNESIGILRTAIDVAKGKKRNIAVAWLDLTNAFGSVPHELIKETLESYGFPEIVVDVVEDMYRDASIRVTTRTEKSDQIMIKSGVKQGDPISPTLFNMCLESVIRRHLDRSVGHRCLKTKIKVLAFADDMAVLAESSEQLQKELTAMDADCSALNLLFKPAKCASLILEKGIVNRLNEVVLRGKPIRNLMENETYKYLGVQTGTETRVSIMDHITEVSREIDLVNMSQLAMHQKLDILKAFILPKMTYMYQNTTPKLSELKVFANLVMRSVKEFHNIPLKGSPLEYVQLPVGKGGLGVACPKNTALLTFLVTIMKKLWSSDSYIRKLYTDYLEEVAKVEIGKFEVNLNDLAEFLSDERAVDSKLFGFNAFTRVREVVRSLCKNKDSPLHSLKIIEREGKLAISVQATEESIEKIFTEDQEKKLMYLLKGELNTALQHRFFTQKVFKSEVMRVVQQHPQSNSFVRNGGKMSFSAQRFVHPGRLNQLPCNYNTWAKGRTKLCRRCAKNENETQSHILQVCDYSIGNIIKERHDAVLYKFRELIKRGSKGHWLERTDRTVPNTGSQLKPDLYLESPDGKHVILADVTVPYERGIEGMQKAWNEKINKYTDGYKEIFRRQGKSLVVLPLVVGSLGTWWKPTEESLIKLGVEKTTVRRIIPETCGMVAEYSKNCYWRHIYGEKYVQTPMINGGKKPEGNDWKKCEKGIEVPKVTN

SEQ ID NO: 1417 - protein, 1888 aa, synthetic construct
  source 1..1888: note = Description of Artificial Sequence: Synthetic polypeptide
MIPVLGTGGPEKLPLQSYVYCGNTAITDSFTPTAKTILKPEEQNLDIVLKNIAALNPENYSDLIRSLSKMEFRLDYPKEIENYWISEKLFSQSIASLPISLLVASMFSPEDRDLSTEPFHCNADGCNFHCDNCERMVEHIREHHNTDPMINTFETTEDTFRRITAIKIDKTGIEELNPLKYRCSYCDELFTEAEDHAIHMISHLTEKLSPDISFFFNDILRLYKTIDKPTVQNLFPETQVAIFDTLEETNRFRLIVGREAIETIEEAFPPSPPGTDRKPSIIITDTCQLRFVPCMDEPPKGDLGILTLLLRDFSAHNIPIKSLNNKELIADKDIDYSPDFVEGALANAEEHDTTNSQNNNGRYINSAEKLTEFLIQCEDYLTNIKTLEDLERFYTTIKDYRVNKEVIAEDTPIFVYFLVEEGKLPKPGLRCPLESYEGHEDKAFESLRKLCDHFKGEIAKTSFDPKVHTIDIWVEFLAQAYGTGTFVYKDENGNIDLDTHVFKCPYADCSYTNNDRSKLMDHMKTKKHAKNVYIERYGFFWGIVIEGVNRPKGIVYPTLKDIKEHACRKCPEAGCNTYVTELSDIKEHLKKKHKSTTAGVDGEIAHTDATYCWITKEELDALHAERARERAEQVDNTPVQQIINADNNEENNENQEDNGNNEEADALDPPNNTTETEDEAVHAVIINPPATEEEEVAIIAEARRNIPELQQAEERGCVTPKMTSLVRLKLLKGGGELFNKKLTPLATRYAATGNTEADKIKVDYLTLKCNAALREMIYTNNHSESKFMTAENGEDTAPPPRISEDTRDRIQKAANEIKGTLIKVVKHISHARCLKDSTRDDEHNKFVEMIAKIKNDLRDNKFEQYNIEEIFQGPISDQSILNIVNTEDNNEFIKKMDYINRILGTPQDASPYARKKLQACFADNPTKTLRNIILADKVPQQSLKPSEYLDYYGPQWANEAEGYENFLHHDYALPERYGQVFANDFLDFMTNESKIIEVIRNKNHLSAHGLDGIPNSVYMLFPVSAAKFLSILFRSIIISGHIPDCWKLSKTVMLFKKDDPSLAKNWRPIGITSCTYRIFMTLVNKALQMIPMFHAMQKGFVRGATLSEHIAVANEVLCQSTRTQSEMFQTAIDFTNAFGTVPHQLIFDSLEAKKVPDSIINLLKDLYKGARTAIYTRHAHSEIVPVRRGVIQGCPLSPILFNCCLDPLLYAVQRRHFEDGYRFQDKAGQYSIAIQAYADDVLVISPTHEGMQRILNTVDEFQKIAKLKVAPQKCVTLAKTSTAIQPFRIGPDEIPIKTSMDNITYLGIPISGTKTSRFAAATGILEKVKAQIRVVFASHLALSQKIIALRVFILPQLDFYMFHNVFRVNDLKATDQMIRGLIDKEAPTSNIPVSFFYMPKNKGGFGLVKLELRQPQLVLTKFARLWLSQQAETKAFFHTMAQEEKSFRKVVEDQENGFLGIKMENGKIVQKNERSKRTNCFITQAAKAADKLEVRFKEWDKGGIQVRGVGENATDWYRSKHIGQISPLIGRVIQQRQYEEFKKDETHSHTFCEPAALAESHDIMKRPQAVPNNLYSAAIALRTNTAPTPANMHFHNPEVLANCPLCGCQSCTLFHTLNMCRNRFSLYKWRHNIICDDIYQFIHDHYPGVTIKCSARITSDGYQTTGPELDDTVKDLLPDLVVYDEANKMIKIIEVTCPYGTDNNVGNSLDAAYDKKVNKYKSLAEQTERLFNWTTTLSIIVVSSLGVIPLRTKLDALRISPADHIQLLKRLSMHAIAASACIVFEKVPEFFGMRCRPLPGRVTAPNAAIPPNNNENNNDTDHGQENQQATSEEQPTNNGNAQEDNGQGEQINNSTEQTISVDQIIEEDAENNAIEQALDQPDEDEFLN

SEQ ID NO: 1418 - protein, 1734 aa, synthetic construct
  source 1..1734: note = Description of Artificial Sequence: Synthetic polypeptide
  VARIANT 5: note = Any amino acid
  VARIANT 8: note = Any amino acid
  VARIANT 11: note = Any amino acid
  VARIANT 17: note = Any amino acid
  VARIANT 22: note = Any amino acid
  VARIANT 51: note = Any amino acid
  VARIANT 59: note = Any amino acid
  VARIANT 62: note = Any amino acid
  VARIANT 73: note = Any amino acid
MRYHXSNXPAXRTSDNXWRSIXKDVRRPDPSTIEEKSRYNRSIGIPDSLKXRSSAVRSXSSXPPSGPQDVRLXNSPSLDDRRRLVDCETTLGSYREWTDKPMMGKMTYAAVTKRAPPRPQTGGARLSTNLLADEMEIKYRDTNDIRLVIDLPNPHLIKCPLCKSCISARGRGANALKYMKRHIADAHHLNADFVYKCSRCQEHEPENVCGAKWIVNHLKRVHGYTLEDAVSTAKPSTRQQIANAFNDSAPFIDARKTSDVPEKKSREAGLEKFLAPTKSEDTREKTPPSTRKSSESSEASIQSTIQETLSESSDTLTVQEIINISSEDEMDEEPPKRRVNVWALIHENGKDAWIDSDLMVIFLESRARGYESCSIIDPLNFICTDMSYLTTIVRRRMEEGYKKIIFPLCANDHWTLVTITGSTATFYDPMGNEPTETVKKMIDELDLEMQLAPSNSPRQRDSWNCGVFVMKMAEAYIKDTQWDLTDVDTDVKTFRRSLLTELKAKFNIFAEDIQTYRPPSRKALTRNSQSPVVVCHKCSRPATPIQDVSRMEVEEAPVLVPTPEEPPQEWTFVGKNRKRGVTSRTPNTSPEAKRPAFPPVPLKPSANRWHFPEEETEKMEVSSADEVKNSTPPKPPKIPNLLAMKIASPVPLKRGNPSKKHGKGHMMNTARKGPTKKEMPKGEPANLIVKIRSWFDEQLKMYKDEGSNLQRLTWLSDSLTAAIGKAFNGNKYIVDQIIKRNPPPLVEKGAMSTQTSRKRDEFKPRERMAQEPNEPLRIQYAKNRQKTFFKIIGKQSEQCTINIETVEQHFRKTLKAPVVSENAIKTVCGSIKKVLMPKTIEDPISSVEVKSILTKVKDTSPGTDGVKYSNLRWFDPEGERLAKLFEECRKHREIPSHWKEAETILLPKDCSDEEKKKPENWRPIALMATIYKLYSAVWSRRISGVQGVISPCQRGFQSLDGCNESIGILRMCIDTASVLNRNLSCSWLDLTNAFGSVPHELIRRSLESFGYPQSVIQIVTDMYKGATMKVKTADQKTQSIKIEAGVKQGDPISPTLFNICLEGIIRMHQMREKGYDCVGHKVRCLAFADDLAILTNNKDEMQEVIDKLDADCRSVSLIFKPRKCASLTIVRGAVDKYAKIRINGDAIRTMADRDTYRYLGVKTGVGGRASETEALIQVVKELQKVHETDLAPHQKLDILKTFLLPRLQHLYRNATPKLSELREFENVVMKSVKRYHNIPIKGSPVEYVQIPVKKGGLGVLSPRLTCLITFLTSTLCKLWSDDPFISSIHKDALSRITVKAMGLTTQSATIKETCEYLNTRKAVTKGGYSLFCRMNESLRTLSVIQGAPLKSMEFIPVNNEIGIAVQATKDSEIKVFTKADSLKLMSKLKDLVRSAMLKRFLEEKSVKSRVTQVLQHHPQSNRFVRDGRNCSIAAQRFVHPARLNLLSCNANTYDVNHPKGCRRCQADFESQQHILQNCHYSLAGGITQRHDRVMNRILQEIGNGRKAHYKIMVDMETGATRERPDIIMEERDGPEVLLADVTVPYENGVQAVERAWDKKIEKYKHFLDYYRKIGKKATILPLVVGSLGTYWPDTSHSLKMLGLSDGQIRNVIPEICQIALESSKNIYWKHILGDSYKTVEGLFCQRNNKEVRFEGKGEKHHVSQRFQPLKCEKVRTMKSTKEEGRSRSNAKKGPNWRRSKSESDGRSVSKGRYWRDPSNKPPHSKMTQSALAKR

SEQ ID NO: 1419 - protein, 1723 aa, synthetic construct
  source 1..1723: note = Description of Artificial Sequence: Synthetic polypeptide
  VARIANT 255: note = Any amino acid
  VARIANT 658: note = Any amino acid
  VARIANT 1425: note = Any amino acid
  VARIANT 1494: note = Any amino acid
MTNVYLKPVNDNQTNKTGDNSRNTMSNSQCEMTWKPVARTYAQAASTNPADDKTVTVLGCKYNLLKLGNTPQTSKRSPPKPSRGGARISSVYTLTDELEITHREEGKITFAIDLPNKNNILCPLCRECTQTRGRGSSFTKHMKLHVKEKHQLDATFIYKCSMCNEYEPEKKCGTKWIQTHLQKVHNYKYDESAIVVPVPPNTRQQIANELNNAAPFVDIRKPKAAAVEEKKTENGALLKFLTKSNKDDQVKSPSXDIPDAESPEKETQALTIDPKGNNSPSKSSIRSSQSSASSVCQEIQEIITLSEDEDPKGARPKPGINVWSLINETGKDAYIDTDIMMAFLKMRVENCDSVNIIDPLNYQFPARVDLVPLIQRNLEDGKKRVVFPICADEHWTLLTISNGIAAFYDPTGSRMSSYIEELVNELGLIIPKEQDEQPRQRDSYNCGVFVMKMAEAFIQDTEWEMEEVEEDVKNFRRNLLEELKPNYEIFAEKIKYYNSPGKSFAQSRPTSRSSQCAVCPTCSRSATPMMDVGNMEVDPVPQQQETPKSREPEQDEGWKVVGKARKRGVVTERSPNISPEAKRQFTGPEIKVVSPGKFHPLVGETEEMEVTCDSPPTKEPTTEPKVTPSLPAMKIASPEVTKKQTSKKKGKYGKKKQXTKKAQPPKGEPTKKAQPKGEPAKLIEQVRTWFDKQMKSYQEQGSNIQTLTWIADSLTAAIFKANSGNKYLVDKITARCPPPLLNEGEMATQTSRRTEAVKPKDRFVKESNEPLRIQYAKNRAKTFNVIIGKHSARCEIDINVVENHFRQTLKAQPVTEEALNTVCSGIKKAKVDPSIEGPISSGEVKAILAKIKDTSPGTDGVKYSDLKWFDPEGERLALLFDECRQHGKIPSHWKEAETVLLPKDCTEEERKKPENWRPISLMATVYKLYSSVWNRRISSVKGVISDCQRGFQAIDGCNESIGILRMCIDTATVLNRNLSCSWLDLTNAFGSVPHELIRRSLAAFGYPESVINIISDMYNGSSMRVKTAEQKTQNIMIEAGVKQGDPISPTLFNICLEGIIRRHQTRKTGYNCVGNDVRCLAFADDLAILTNNQDEMQDVLNQLDKDCRSVALIFKPKKCASLTIKKGSVDQYARIKIHGMPIRTMSDGDTYKYLGVQTGNGGRASESESLTQIAAELQMVHDTDLAPNQKLDVLKAFILPRLQHMYRNATPKLTELKEFENTVMKSVKMYHNIPIKGSPLEYVQIPVKNGGLGVMSPRFTCLITFLASTLFKLWSDDEYISSIHKKALSRITAKVMGLKTQKATLQEQCEYLNTKKAITKGGYSLFSRMNEAIRTLSVNLGAPLKSMQFIPENGEIALEVQASENSQIKVFSKADSMKLVTKLKDLVKSAMLKNFLENKKVKSKVVQVLQHHPQSNKFVNDGKNXSISSQKFVHPARLSQLVCNGNSYSKDLPKNCRWCGYECESQAHILQHCTYSLSSGITQRHDRVLNRILXEVIKGRKNNDYYDIMVDTEPGPTRERPDIIMIQKDGPEVLLADVTVPYENGVVAIEAAWDWKMEKYSHFIDYFARLGKRAVILPLVVGSLGTYWPDTSNSLRMLGLSDGQIRNLIPDISMIALESSKQIYWRHIFGDSYRIVSDLYCRKDQQEIRFGDEPMENVQVSDRFQPFKTREREKKSEEEKKRRSKSKKGKTWRGSKKQTDSRQSGKSNQNQGFQRSVGQGVSR

SEQ ID NO: 1420 - protein, 2017 aa, synthetic construct
  source 1..2017: note = Description of Artificial Sequence: Synthetic polypeptide
MTKTEWSWRHRSRSRSVGIVVKIDTSDYANVRVHVAADLSNEDGHTSHNNGIILPIPMKPSVDRFCQIQYPPRGYYVPHPQSQKGHDAKPSRHWNEEAQPPYYHNNNHGRRGRSAKPSGRRPPRKPILQEESLAAHPQIPGDTASAVPLYSDVVNNENKSQGKPPQGSHRRSGRPGTKPSVPVGEAEQETNSRPIAPEPIVKFKHDKHGWTTVQGSHSSGRPVPKPSVPVVSEANRFQLLQEGDFPPLTTSESSQEEIKVPNYQRIVSPIPLPSEEDSKLPTKSNYRAPKGRKSRNYKKPQQQNPKKYQQRLPYQPKVNNAPTDRMAPEQLKGGGGKTAHNDIEEMEIEEDTDEKIIQVKRIKIVNKLTPHHFVCMMTYPTDNIYRCFVKGCTATSQGGWGAEDLKYLTVHIRQEHKIKVEWTYECGICGDLSGGAGKHISKWIKPHMRKKHNRDAPTNFKMGSRSSGKPKITELLEESAPSCSNPRRKTLNQKKTAIITQVTPEKLKTGYQTRSVTKALSVLKESRQKELEVLREEEKANAKQKSKLHPFFTKAPHIDGVKPTVRRELSKMITPGGEHKGTKIPMVHTKRGLIQKINRKAKKAKPMHLDESTIIEASQLDVITIDDDDEDDNMTPMRRRFNTWCLDHETTQEAWLTDDVINWYLKDLCFGNEQYMLVDPLVWLIYKMGGMAGVEQRFKSKKTCLFPICEADHWILLVFDETNLCYANSLGSQPNGQVKNFIQQLNRKLCSFEKEVPLQKDSVNCGVHVCLIAKSIVNGQFWYDDSDVRTFRTNAKAALKAQGYELFSEAPKQIENPDSSHREDIKENSMEMCSESLMIVATPQRSEAPMELVDTEPSDLESPKSDRVVYEDCITALSDVSEPRMTPEKSETPEVPVVEERDLDWPKLESPKSDRVVYEDCITDLSDVSEQRMTPEKCETPEAPLVVECVELERLPKDLPVTDRSTVVAIPEAVKLEEKSEVVIPRLMELSYTVPPEPSPVVEYTQPYTHTHTKPKVKATCQMGKKRKVPTGKPDELIQIVRQWFEKEFNDYVTEGRNFQRLEWLTNLLTAAIQKASAGDEETIEKIRKRCPPPEVRENEMSTQTSQRQKPTTTNQKKRSRNTTQSDTQANTYWRNRAKTYNQIIGQDFKQCDIPIAILEEFYKKTTSVTNVPQETLVKVTSRLPRLDIGKWIEDPFTEQEVFGALKKTKDTAPGTDGLRYYHLQWFDPDCKMLSSIYNECQHHLKIPAQWKEAETILLFKSGDESKPDNWRPISLMPTIYKLYSSLWNRRIRTVKGIMSKCQRGFQEREGCNESIGILRSAIDVAKGKRSHLSVAWLDLTNAFGSVPHELIESTLSAYGFPEMVVHIVKDMYKDASIRVKNRTEKSEQIMIKSGVKQGDPISPTLFNMCLETVIRRHLKESSGHKCIDTRIKLLAFADDMAVLAESKEQLQKELTEMDEDCTPLNLIFKPAKCASLIIEFGKVRTHEQIMLKREPIRNLNDDGTYKYLGVHTGADARTSEEELIISVTKEVDLVNRSALTPPQKLDCLKTFTLPKMTYMYANAIPKLTELSAFANMVMRGVKIIHYIPVRGSPLEYIQIPTGKGGLGVPCPRITALITFLVSTMKKLWSDDEYIRKLYNSYLKKVVEAETGIVEVSTKDLAEYLSNKVPSRKHEFGYNCYSRIREVCNGLALNQAAPLYKLEFIEQDNELAVVVQPTEESKERIFTKDHVKKLQSLLKASVNDALLHRFLTTKPVKSEVVQVLQQHPQSNSFVRMGGKVSISVHVWIHRSRLNQLTCNYNIFDPKQPKNCRRCGYKNETQWHILQDCTYGWAKLIRERHDAVHHKVVTMICAGAKKNWGRKIDQELPGFTSLRPDICLTSPDGKEVIFADVCVPYSRTRNIEFAWKEKIRKYTEGYSHLVAQGIKVTVLPIAIGSLGTWWTPTNESLYQLGISKSDIRSAIPLLCSTVMEYSKNAYWNHIYGNSYTSVPLRYGHQKPDGDDWKKELSCEPVLALQQ

SEQ ID NO: 1421 - protein, 1560 aa, synthetic construct
  source 1..1560: note = Description of Artificial Sequence: Synthetic polypeptide
  VARIANT 326: note = Any amino acid
  VARIANT 367: note = Any amino acid
  VARIANT 588: note = Any amino acid
  VARIANT 755: note = Any amino acid
  VARIANT 909: note = Any amino acid
  VARIANT 1171: note = Any amino acid
  VARIANT 1315: note = Any amino acid
  VARIANT 1389: note = Any amino acid
MNVDLDATIKSIGMNTKETTYPNSQLRVETTPCTSTTIMHASCNTTSTISYSPLPSAVSLPESPASSITITTTDDNCDIIETPYPLPQTNGDLSEILKDIEANKDTTMSNKVLDCDSDSGDDRDMIIENDRESDMDLFSQSLLNTNQSDERREKNLTENAPTEITTEKSYFDIISKASDNTTSKKLLNVKNELTAGLPPMPPVTNTAKFIRNVRPEDIADPTLYRLDSRGKLGCRTQYKKPGCGDIAVYDYEAIVEHAAFIHTIPFNEQNNVDCQPCHPKKGKDVHTIVLIKYADIFNHIEAHSHVVQTAITDNMKTYLRLTKENXFYCSYRNNKKKNKCKKAFNLESNMMDITEHMKTHTGYSFDXNLNILCYCGIWKPFTELIAHIKTEHLQEYINSIPNKENIHNTTTIVSPLNFAGILASGETQNIPDEEIIKPRDLPENLAFNRNIENELSWSQHLVKAYIFSYAVKTSTIFINPYTCNALIQCNYKTFFETFPFKDFAKWNEIVLPIHNNTSSWSFFFLNKKKRVAMIIDPTADDSHTLHFELATDILRTILNVQNIFEDLNFPLTEVEYPVCHEANLSAFXVCHFLKCLMSDLPIDIPDIDHMKETMRPIIRKYNCAKFPESDVRNYRVLIEDLIYQLNLDTITCEEILCEIERINGRLNPKRYFKESKPKTDIIHLQKKKSAELLCVKRLKFQISQKTEIGKIWENDDVDHRPPMARFLKTFASQDCPVSNTSSINLPYYMDTDTDXCTDCENLSHIMKNLDSSAPGMDLITGGDWKKISPKHELITAICNCILRNKVCPEKWKLFRTVLILKPGKMSESFRANSWRPLAIMDTAYRIFTTLLNNRLLQWIRNGNLISPNQKAIGIPDGCAEHNATLHFAIDRAKRCKTELHIVWLDIADXFGSLPHDLIWYTLANMGLKNETLTLIKELYKDVKTIFDCQGTLSEPVPITKGVKQGCPLSMTLFCLSIDYILKSILTNYPFLLHDLNISILAYADDLVLLSDSYLEIKKSLESTVELAAFANLKFKPSKSGYLSINNVNSDILKLHLYNEEIPTISENNKYRYLGVDFSYKRNQDVDGRLGSALALTRSLFKSYLHPAQKLNAYKTFIHSKLIFSLRNCVIGHRILDCDRNRVTQGREKQLGFDQEIKALLKTMIGDKFQAXNNYFPYTHCKLGGLGITSAIDEYLIQSITGITRLFHSSNLSFRKMLITELAHSRGGKNFEAGLKWLNCEVNKAFPNTSFFVKFQKSALALKRKFCICVNLKFVEDNFSLEMTYKKRTSYVNHQNLSTLSKELHDFVGLYYAEQXCQMRVQGHIATAIGDSITAKYLIASDILNDAQYYFLVRARNNLLNLNYNAYRLKYNIGTKCRLCHLDEETQAHXFNHCRAKPNARRVKHENVLVSIVAFLEKIGFEIDVEKSPKYISIPTKLKPDMVIRSKRNKDIHVLDLKVPYDSGEGFEKAREDNYVKYKDLAIEIGKAFNQKATISAVVIGCLGTWDKKNNAALSKIGLTKTEIISLARIACPNAVIACYHIYREHVSFTKSAMALPFSLA

SEQ ID NO: 1422 - protein, 1171 aa, synthetic construct
  source 1..1171: note = Description of Artificial Sequence: Synthetic polypeptide
TTGRNLGQWSCYSRSIQQSNYSFKLSSTEVGELVEQSPAPLQSPQFSNNYNNLNINNNLYYSLNTFNQSNNLCCLVNIEFFPTQHLLGDIVNSGCINYMNNYNNFDNINLYINSNVLSYNNYNHSFLASPYTTNITEHADINMHVQEVNMQQDNNTQHAITQQVSLQATSLQHTLDEMIVQFNTAVRLKKKHKVAKIFRGHNHRKDLPTLPAREQYKTKPKLAIREVLHRKTTATSSPSENAIKAFFSSYSRPAELFTGQELLESSWFPVHPEDDFEFRIPGRDQIAKYIKFASKSAAGLDWITYEDIKLGDPSGEILQPIFEYIVQNNICPSEGKASRTIMIPKPGKSDYSDPSSWRPITITSAVYRLLMKYLTWELYNWILLNQMLSRSQKSLGKFEGCHDHNAMLNMLIQDVRRQTNPSNPINKNKRLYIVFLDFTNAFGSVPLDTLMYVPQRFGLGTSALTLIKNLYLDNYTNVTCGESKIENVKLNKGVKQGCPLSMLLFNIFINIIIRAIEAMPDVHGYPLGDMDIRILAYADDIALISDSHKDLQEMVYKAEYIGRILGLLFNPSKCALMDIPHDKKRTPPILVNGEMIKCVGKADPYKYLGTFRSWFRKLDIKELLQMMMDETKLITESNLHPHQKIHAYETFIHSQLPFHLRHSRIPFSDFITNRKTNKTTNNSNDSEKSIQKAYDPESGQLFLNTFALPSGCAKDFFYITKDAGGPQLTSGLDEYLIQSIMYIFRLLGSEDPTLNSAIKHDLISHLNLKGFVNINFSQAISIFNSNFTDRTDHFSHLSRTEWARLQLARKKLKSTLAIQTNVCLINGHLVLTLSLENNVLLIDSKEKGDVKKIHASLMGFLRLAHLIRLQKHGWSKLLFSATTHHEILNKRILNGHVPYKIWYFIHRARLGLLPTKLFSVSNLCRKCGGKKETMSHALVNCPMMQTLINERHDALEISLVQILSSKFQGTVIRQKTYVNELRPDITMESDTQYYLVEVKCPFDTKMSFELRTQQTTDKYNIIIEILEDVHPGKEVRLVTFIVGTLGSWGPQNSDFLRDLGFSKDEIDQVKTRLMLQNINSSCEQWKRFVQYAPTITPGPIPDAESEDDQGTSDNGPTAATVQGPVIGDEEEELQIYDSGLDESSDDEPDPDDAELLFTIDIEQYLNSVITD

SEQ ID NO: 1423 - protein, 1591 aa, synthetic construct
  source 1..1591: note = Description of Artificial Sequence: Synthetic polypeptide
  VARIANT 6: note = Any amino acid
  VARIANT 16: note = Any amino acid
  VARIANT 23: note = Any amino acid
  VARIANT 25: note = Any amino acid
  VARIANT 26: note = Any amino acid
  VARIANT 34: note = Any amino acid
  VARIANT 35: note = Any amino acid
  VARIANT 37: note = Any amino acid
  VARIANT 38: note = Any amino acid
  VARIANT 40: note = Any amino acid
  VARIANT 41: note = Any amino acid
  VARIANT 54: note = Any amino acid
  VARIANT 59: note = Any amino acid
  VARIANT 68: note = Any amino acid
  VARIANT 72: note = Any amino acid
  VARIANT 76: note = Any amino acid
  VARIANT 78: note = Any amino acid
  VARIANT 79: note = Any amino acid
  VARIANT 81: note = Any amino acid
  VARIANT 90: note = Any amino acid
  VARIANT 93: note = Any amino acid
  VARIANT 108: note = Any amino acid
  VARIANT 111: note = Any amino acid
  VARIANT 112: note = Any amino acid
  VARIANT 125: note = Any amino acid
  VARIANT 178: note = Any amino acid
  VARIANT 241: note = Any amino acid
  VARIANT 243: note = Any amino acid
  VARIANT 279: note = Any amino acid
  VARIANT 311: note = Any amino acid
  VARIANT 324: note = Any amino acid
  VARIANT 364: note = Any amino acid
  VARIANT 366: note = Any amino acid
  VARIANT 408: note = Any amino acid
  VARIANT 478: note = Any amino acid
MESPAXIFEKIDAALXIYSAAAXLXXNSLSLSPXXAXXSXXAAPASSTPQKTQXKPIPXTTLGASRKXRTTXKDEXIXXWXKKAPVDTSXGRXSTRRTALRDLTSRSXNIXXALQEEDPRRTPPXSRDQDAERRPAAPEKAATRGAPPTIQDQDADRCPAGRDATGGAPRRPRTRMLXAAPLGRMPPEEPPPTTRDQDADRRPAAPERDAPEGTTSSTPDPETTYHPPVRRRAAPRGTHSXAXDLDAARCPSGQRDIVASESSTPPGATSPPQASLPDXEESPAESAGTTEVRPTEGEAGEDDCIYLQYPXPTGLLLCPFCLPXHGVQTLGALSKHVRKAHNKRIAFRCSRCDAPFETQKKCKXHXATCKGPLTTAKVNPTDTLRVPTPTPTDGPASAPQPASPEPQXVRGDQPPTEGSATPASRTDDATKRTSPASRIPTLDPAVRGITATSQVSDLTRCLSDLIKTIRHNTDTRRXSAPPQVTSCRPAVGATSTAPQAARRDPANGGASRSPQIPRPDPAPGRPNTSSKVTQRDSDRQKPHAPPRTPQPDTTRRRTRTIPSASKHDRAPTKPNTGVSRTPLPPGRSSAASETPRAAPPPPHQDPRLKTHLNTAPQSEGQQGHRLSPQHLNPRRQRSRRNDGREQRVATPWQSAWMEELAKAEDFETFDTLMDRLTAELSAEITARRREPQEASRATRRFPAPTRNNTAREGRRGDVGRRYDPAAASRIQKLYRTNRTKAMREILDGTSSYCAIQPERLYSYFKDVFDHEAQTNLQRPECLLPLPRINLTEDLERDFSPQEVQARLMRTKNTAPGKDGIRYHLLKKRDPGCLVLAAIFTKCKQFHRVPRSWKKSMTVLIHKKGERDDPGNWRPISLCSTIYKLYASCLAARITDWSVCGGAVSSVQKGFMSCEGCYEHNFLLQTAIQEARRSKRQCAVAWLDLTNAFGSIPHHHIFATLGEFGMPETFIQILRDLYKDCTTTIRATDGETDAIPIRRGVKQGCPLSPIIFNLAMEPLIRAISSGPTGFDLHGKKISILAYADDLALVADSSESLQQMLDVTSQAAEWMGLRFNPKKCASLHVDGGARALVRPSRFLIQGEPMASLEEGEVYQHLGTPTGVRVRQTPEDTIAEILRDAAQIDSSLLAPWQKINALNTFLIPRISFVLRGSAVAKVPLNKADSTIRQLVKKWLYLPQRASTDIIYISHRQGGANVPRMGDLCDVAVMTHAFRLLTCPDPTVRSIAQEAVRDVVRKRIARAPSEQDIATYLSGSLEAEFGREGGDLSSLWSRARNASRRLGKRIGCCWKWCEERRELGILVPRIKTPDHTIVTPTARAMLERTLKDAIRCHYAENLKRKPDQGKVFEVSSKWDASNHFLPGGSFTRFADWRFVHRARLNCVPLNGAIRHGNRDKRCRKCGYANETLPHVLCGCKQHSGAWRHRHNAIQNRLVKAIPPSLGKITLDSAIPGTDSRLRPDIVVTDAEKKKVLMVDVTVPFENRSPAFHEARARKALKYTPLAETLRAQGYEVQIHALIVGALGSWDPHNEPVLRACGVGRRYARLMRQLMVSDTIRWSRDIYTEHITGHRQYHTE

SEQ ID NO: 1424 - protein, 1352 aa, synthetic construct
  source 1..1352: note = Description of Artificial Sequence: Synthetic polypeptide
MAAKSVACPHDGCANKYASEASLRRHIKNKHATDEEGDETSHSCPHCHRPFSTARGLSVHIGKSHRQAPPEPTRPPPAPAPADPGLDPDPGPTVTPPSRDDEDREEPDDDPVEIADLSCPHCAQALPSAHGLANHLRACKDHRVPAPGAPRSGPPSSRYWTAVEHHRYVEAMARFADHPDLLARAAAHIGTRTYKQVDSHRTKVIAAEREGRPVRTLDPTMDWRMRPYCASTTARWLAEQGRSPVAPRSPCPEPHAPPPAAALLYIPATPPAPTPRAPVAPPKLAPPAESTVPATPDGNPEAPAPPFSAPGPPTPKALPPPPPSRRNLRPHLVPKDAWQGVADAVAPAASRLLRTPLAHLSTEQWATFEAALAGLEATLHHAARSAEAVPTRCASRAREDAERQLREARKTREIFGKAAALYAAGKDPTATIERIPPEVRLHLPTPGSAEWPARAAAARRVIRRAVARADRLRKRMGILDSDRDLQRLFNANQKKAVRQILAPSTKAPRCQLDPAAVEEAYIQTLAKPPPIDPSPPWKNSVQWPRPPTAADDGGSPFSVAEVRAQLRRLPNGSAPGIDGIPYEAYKRTKLDATLAHVFEVVRLNARLPARWDVARTVLLYKKGDPNDTGNWRPISLQVTIYKIFTAALSKRLISWAGKHNTFSASQKGFLPAEGCHEHAFVLRSVLDDARRHKQNVYLAWYDLRNAFGSVSHDLIAWCAAMLGLPRYLRDAIGAIYRHSALFVQVGDQETTGVIPMRCGVKQGCPLSPLLFNLCVEPALRCLRRTTGYKFYGTSITVEGQAYADDLLTAAPSAYHAARQVATIEEWANWAGVSFVVQALSLDAPAGKCAALAINFEGGLMHSIDPALKVQGAAIPAMSRNNVYRYLGVHVGLTDALGQANELLEKASRDARTICASGLEPWQKVVAIKTFILSRLPFFFHNGKIQRGRCQQFDRELRENLRAALRLPVCTTNAFFHSRVASGGLGILPIAEEQQVYLAAHVFKLLTSPDLSIRAIARHQLAEVTHARHTTPVQDGEASPFFGWLMRGQEVASTTPSGDVSSIWFAAAGAYSRMGWSVRDALHPTLTVGPGVQFEGRFQRANVIPALRASAFSRHAVEWSALRTQGRAAAYQHAVHPATHHWVHNSAGLTTKEYRFAIKCRLGLLPTRAAPHHRNGPTACRACSYARETANHVLGHCPATKAEVIARHNRICRALAQAAEASWTSVLEDVPIPGVDSPLRPDIYCSRPGQCAIIEVAVSYEDAFNASMEGRAKQKTDKYAGLAATVEEQLRLQTRHAAFVVGFSGVVLPASVTATATSLDLPPKTWNVLLKRCVAASIKGSYTAWRRFRRSTP

SEQ ID NO: 1425 - protein, 2004 aa, synthetic construct
  source 1..2004: note = Description of Artificial Sequence: Synthetic polypeptide
  VARIANT 148: note = Any amino acid
  VARIANT 324: note = Any amino acid
  VARIANT 759: note = Any amino acid
  VARIANT 912: note = Any amino acid
  VARIANT 1400: note = Any amino acid
VCSVRGCRREDSRRFYKFKFPLNFVKVPKTIVIGSAFQKSSVSARSQNHSRSTRVPKTRQPRTSNTIGRYTAASANNYLTVIITGNYTVFAQWICYRECTWLLSKFVNFFLTIIGYFFQLRLVVIYEGPVILDTFSNCGSSLFMRGQXSKALLVRLNRSALAMADPQVHYIDYPLPPRVKCVKCFGAEGAGKVKGEYSDPPHLAKHLKKCHPGDTLNYKCSICDLRGTGKYPLRDVKAHYAECHVSPAVDAAGPSTRGSLGECSGAGQPTASRAAKATTRLAETVGGTDKRRAATSGSRQLTLPFAATPSPSTAAGEARAPRSXSTTPTSRSPSYAAVTAGPPSMRSTTTSTTARSKTVAKGAAPNTTTTTTARRSGEAAATRKPPTTATVSKPRVLSVETVRLPVDDIQRAGVQNAAKPARAPSRPPQRTSPEAGGPRTTGAKEKCGEGAYKKLPANSGNPISTRTRRATSVPVEKSEGTARRERVSPHPPPKGIDIILSSTSEEEGTPYQPGGVGRLRLRRKKVTGPPPKMTPREGVVTRARRSTSAPVEKSALDARLTALDRTSSRATGNPTSQIAGGLYTSRGQPERTPPARLPSLSPTTRGSPSGSLGEIRTPISPATSLPATLTTCTVTTTTCGSPITSTGFTGGVGRLITPPSLPQTNILPTIGEEGTSPCVAVVTTHPRPTGEDAPCEAPQPVSDHQRQSIGEPRRDTDTHLACDVATGNAHHLHGDDDHLWKPHNIHGLHRWRGEADNTXEPPPNEHPPDHRGGRNVTVRGGRHHPSLGGRSTSPLILPRPTTPEPERGQEERRLEGAAQPPTTPVVEGDNQWDGQWTVSVRRRARRQQLNDTSPSNSESPPTAGPSRSPRIAPLSALIAASTSRHETSLNLNCTNGNICMDRTPPRNILPVXAERRRETSPQDRVEGDIGYGAGKVSAEHPSAPVNVRGVMSRGRATASSIVPPRANRGEGGRQHHSRRRPDAPVGQPSRDHPAPATVARQRRRERVAARDALLDRAKDVATIADLEAFAASVAAFFGEDASATGAAARARDRSVRSREAGARRGVKGGERPEREGAGRPGSAPADPGASGEARGDWVREAKRLQALYRANRRKAVREVLQGPADQCQVPKRQVQEYFERLYSGGEDLAGAGVEAERPDPSSPREVSAVLGPLAEREVDRRLRRMNNSAPGPDGVSYRDLRGADRGARLLTALYNICLRLEAVPASWKTSNTVLIHKKGDRGMLENWRPLALGDTVPKLFAALLADRLTDWAVTRGKLCSAQKGFLRDEGCYEHNFVLQEVLTHAKRSKRQAVVAWLDLSNAFGSIPHATIRRALIRSAVPRGLIAIWDSMYDGCTTRVRTAEGHTAPIPIRSGVRQGCPLSPIIFNLAIDSVVRVAAEXNDGYSLHGNTWSALAYADDIALLAQTPEGMERMLASVEAEAASVGLRFNPAKCATLHVGAGNGGRVLPTSFQIQGETINPLAQGESYTHLGVPTGFSVDQTPYAAVGDIVSDLRAVDRSLLAPWQKIEMLGTFILSRLDFLLRGARVFKGPLTAVDLNIRRHVKSWLNLPQRASAEGVYMPPRWGGCGLLPLSDLADVLTVAHAYRMLTVRDGAVRELAWESLRGVVGRRIGHAPSCEDIASFLSGSLDGRMRGGGEASLWSSARNAALRQSERLSLRWRWVEATEEMTLECRGPRGAAIKIPPEARGQVVNRLRSAVAEHYASRLLSKPDQGKVFEVSSRSRVSNHFIRGGSFTRFADWRFIHKARLDVLPLNGARRWEANDKRCRRCGEVSETLPHVLCHCGIHSAAIQLRHDAVLHRLWKATRLPGVVRVNQRVEGVSDELGALRPDLVVRHEPSKSVVICDVTVPFENRWTAFEDARARKIAKYSPLAEELQRRGYRVVVTAFVVGALGSWDPRNEAVLRLLRVGNQYAAMMRRLIVSDTIRWSRDIYVEHVSGTRQYLAPSRPSGDLATPPRAVRRRWLAEERSAQDAARRGSDSVSVA

SEQ ID NO: 1426 - protein, 1019 aa, synthetic construct
  source 1..1019: note = Description of Artificial Sequence: Synthetic polypeptide
  VARIANT 52: note = Any amino acid
  VARIANT 652: note = Any amino acid
CHHAGLRPGTPNRTRRPDQTAPLPDPRGHPMPPNRRGSRSRPEEPSRREPPXPRACQGLRVWSPPQQRMPTPWQTLWLEELSRATTFKAFEASVARLTEELSAAARPGQPRGGNNRPATRRDHRLQPQRRPRRQRYDPAAASRIQKLYRANRPKAVREILEGPSAFCQVPRETLFNYFSRVFNPPAEAAAPRPATVEALTPVPPAEGFEDAFTPQEVEARLKRTRDTAPGRDGIRYSLLKKRDPGCLVLSVLFNRCREFRRTPTTWKRAMTVLIHKKGDPTDPGNWRPIALCSTVAKLYASCLAARITDWAVTGGAVSRSQKGFMSTEGCYEHNFTLQMALDNARRTRKQCAVAWLDISNAFGSVPHRHIFGTLRELGLPDGVIDLVRELYHGCTTTVRATDGETAEIPIRSGVRQGCPLSPIIFNLAMEPLLRAVAGGPGGLDLYGQKLSVLAYADDLVLLAPDATQLQQMLDVTSEAARWMGLRFNVAKCASLHIDGRQKSRVLDSTLTIQGQAMRHLRDGEAYCHLGTPTGHRAKQTPEETINGIVQDAHKLDSSLLAPWQKIDAVNTFLIPRVAFVLRGSAVPKTPLKKADAEIRRLLKKWLHLPLRASNEVLHIPYRQGGANVPRMGDLCDIAVVTHAFRLLTCPDXTVSIIAASALEETARKRIGRQPTRRDLATFLSGSLEGEFSRDGGDFASLWSRARNATRRLGKRIGCAWTWTEERRELGVSLQPAPHADRVTVTPRTRTFLERFLKDAVRNKYAGDLRAKPDQGKVFDVTSKWDSSNHFMPSGSFTRFADWRFLHRARLNCLPLNGAVRFGHRDKRCRRCGYVAETLPHVLCSCKPHARAWQLCHNAVQDRLVRAIPAAAGEISVNRTVPGCESQMRPDIVITNEEAKKVVIVDVTIPFENRRQAFTDARARKREKYAPLADILRGRGYDVTVDALIVGTLGAWDPSNESVLHACRVSRRYAKLMRCLMVSDTIRWSRDIYVEHITGHRQYTDPTRRTAAGPDPEGTA

SEQ ID NO: 1427 - protein, 1584 aa, synthetic construct
  source 1..1584: note = Description of Artificial Sequence: Synthetic polypeptide
  VARIANT 117: note = Any amino acid
  VARIANT 118: note = Any amino acid
  VARIANT 121: note = Any amino acid
  VARIANT 139: note = Any amino acid
  VARIANT 141: note = Any amino acid
  VARIANT 278: note = Any amino acid
  VARIANT 328: note = Any amino acid
  VARIANT 409: note = Any amino acid
  VARIANT 490: note = Any amino acid
  VARIANT 529: note = Any amino acid
  VARIANT 688: note = Any amino acid
MTTKKVLGASTTLQTSSTKGKNSGCSKDPLRDAVPGRSWILRPACRDITTRRNIPPAPQQQQPPMESPPTLQLQDALRRPSPTPAAAQVADAGGALAALHTIKRGISVDWTSISPKXXQRXTSASPDACPASETTQRDXRXLLDARPAGPLDPTRPHQDEPASDTADAAGTPLLQGNEDTIYLQYPLAADMLICPICSPPQSFHLLGVVTRHLKRCHSKRVAFSCALCSLPFETQKQCKMHQVACRKCLKGTTQSPAPAPSPPAARRPAAPEPQRRKXTSQAAVKKPAPVARPAERDAAIEKVPAASGNITQVLASRRPVSPSHVAKXISMLRRLSAASPPVQHVPVPRRISAPPRIAARDPVAGRASAAPQTALRTPAAGGASTTPQTALRTPTAGGASAMPQTTLPXPRRPDWRNQPRSHSKAPGLHRQTDQHGPQVHSAGHCLREISRSSSNRLGSSHSAAATHRRTGGVPATPEPDRVSPTTSNAXIPPEIPPQHPTEGNPDPRDRRQADHTAGSEPAPDEVEDXEGQRPMVRAATPWQTAWTEELQAAASFDDFDLLVDRLTRELSAEIAPRRSSNQENAPPAHRTPAPNHNTTTRGARSRDASRRYDPAAASRIQKLYRANRSKAMREILDGPSPYCTIPSERLYSYFKDVFDRIARNDAQRPECLRPLPRVDEAGVLETDXTPKEVMARLSKTKNTAPGKDGIPYSLLKKRDPGCLVLATLFNQCKRFCRTPSSWKKAMTVLVYKKGERDDPSNWRPISLCSTMYKLYASCLASRITEWSVSGGAISSIQKGFMSCEGCYEHNFVLQTTIETARRARRQCAVAWLDLANAFGSMPHHHIFATLQEFGMPENFLRVIREVYEGCSTTIRSVEGETAEIPIRSGVKQGCPLSPIIFNLAMEPLLRAISNGTDGFNLHGERVSVLAYADDLVLTADDPESLQGMLDATSRAADWMGLRFNAKKCATLHIDGSKRDSVQTTGFQIQGEPVIPLAEGQAYQHLGTPTGFRVRQTPEDTIQEILQDAAKIDASLLAPWQKINALNTFLIPRISFVLRGSAVAKVPLNKADKIVRQLVKKWLFLPQRASNELVYIAHRHGGANVPRMGDLCDIAVITHAFRLLTCPDAMVRNIAANALHDATKKRIGRAPSNQDIATFLSGSLDGEFGRDGRDIASLWSRARNATRRLGKRIGCRWEWCEERQELGVLVPQIRSNDNTIVTPSARGMLERTLKAAIHSLYVETLKRKPDQGKAFELTSKWDASQPLPRRGRLHPFRRLAVHPPCPAQLRPAQRSRPPREPRQALQEVRLLQRDPAPRPVQLQAPLQSLAAAPQCHPEPPGESHRTAPGGGRRELRHPRYPASGTPANHFLAGGGFTRFADWRFIHRARLNCVPLNGAVRHGNRDKRCRKCGYSNETLPHVLCSCKPHSRAWQLRHNAIQNRLVKAIAPRLGEVAVNCAIPGTDSQLRPDVVVTDEAQKKIILVDVTVSFENRTPAFREARARKLEKYAPLADTLRAKGYEVQMDALIVGALGAWDPCNERVLRTCGIGRRYARLMRRLMVSDTIRWSRDIYIEHITGHRQYQEV

SEQ ID NO: 1428 - protein, 1420 aa, synthetic construct
  source 1..1420: note = Description of Artificial Sequence: Synthetic polypeptide
  VARIANT 694: note = Any amino acid
MTQDQDADCCPAGKDATRGAPPMTQDQDADRCPAAPERDAPEGTTSSTPDPKTTYHPAVRRRAARRGMHLRAQDLDAARCPSGQRDNVASESSAPPRATSPPQASLPDPEESPGESAGTTEIRPTEGEAGEEDRIYLQYPLPTGLLLCPFCLPVHGVQTLAALSKHVRKTYNKRIAFRCSRCDLPFETQKKCKFHQATCRGPPTTAKVNPTDILRVPTLTPTDDLASAPQPASPESQQIRGDQPPTEGSVTPASRTDDATKRTSPVSRIPTLDPAVRGTTATSQVNNLTRRLSDLIKTIRHNTDTRRCSAPPQVTSCRPAVGATSIVPQAARRDPANGGASRSPQIPQPDPAPGRPNTSSKVTQRASDRQKPHAPPRTHQPDAARRRTRTIPSASKHDRAPTKPSTGASRTPLPPGRSSAASETPRAALPTTPGPPPQDPPEHRSTVRGTTRPQTVPAAPEPAETTQQEERRPRARVATPWQSAWMEELAKAEDFENFDTLMDRLTAELSAEITARRREPQEAARATRRFPAPSRNNTAREGRRGDVGRRYDPAAASRIQKLYRMNRTKAMREILDGTSSYCAIQPERLYSYFKDVFDHEAQTNLRRPECLSPLPRIDLTEDLERDFSPQEVQARLSRTKNTAPGKDGIRYPLLKKRDPGCLVLAAIFNKCKQFHRVPRSWKKSMTVLIHKKGXRDDPGNWRPISLCSTIYKLYASCLAARITDWSVCGGAVSSVQKGFMSCEGCYEHNFLLQTAIQEARRSKRQCAVAWLDLTNAFGSIPHHHIFATLGEFGMPETFIQILRDLYKDCTTTIRATDGETDAIPIRRGVKQGCPLSPIIFNLAMEPLIRAISSGPTGFDLHGKKLSILAYADDLVLTADDPESLQGMLDATSRATDWMGLRFNAKKCATLHIDGSKRDSVQTTGFQIQGEPVIPLAEGQAYQHLGTPTGFRVRQTPEDTIQEILQDAAKIDASLLAPWQKINALNTFLIPRISFTLRGSAVAKVPLNKADKIIRKLVKKWLFLPQRASNELVYIAHRHGGANVPRMGDLCDVAVITHAFRLLTCPDATVRNIAANALRDATEKRIGRAPSNQDIATFLSGSLDGEFGRDGRDIASLWSRTRNATRRLGKRIGCRWEWCEERQELGIRVPQIRSDDNTIVTPTARGLLERTLKAAIRSLYVETLKRKPDQGKAFELTSKWDASNHFLDGGGFTRFADWRFIHRARLNCVPLNGAVRHGNRDKRCRKCGYPNETLPHVLCSCKPHSRAWQLRHNAIQNRLVKAIAPRLGEISVNCTIAGTDSQLRPDVVVTDEAQKKIILVDVTVSFENRTPAFREARARKLEKYAPLADTLRAKGYEVQMDALIVGALGAWDPCNERVLRTCGIGRRYARLMRRLMVSDAIRWSRDIYIEHITGHRQYQEA

SEQ ID NO: 1429 - protein, 1081 aa, synthetic construct
  source 1..1081: note = Description of Artificial Sequence: Synthetic polypeptide
YAPGYEAAQSPCGREPPRDHHRRPRDACGSSHSPEPCLTTPRLLPETVSAEPCDDESQRTRYASPHKQARTLHDAEPRDASREHAPSCAEPRCHRCQWTHWKDCCPHSTNTTDGPEGTDRCADTITSPATAACPQRSPCPLGSSNGCDETAPEKRQPAADLVHTAPFAVLVRAGPFADLVRAGPFADHHQDDDPLPHRSGSLGPLCSKQKDPRKTHQHRHSGQAGNQTHTDIPRAAPSRRAAICLMANAAATREDLLRAATSLSEMAAANQPTRSPTGGGEPTSQGRRGPQALADAAKRIQQIYRTNIPRAMRKVLRTLLTAVFSACLRTGHVPDLCKKSRTVLIHKKGDRTDLSNWRPLSMGDTIPKLFAAVMADRLTAFLTNGGRLSEEQKGFLQHEGCHEHNFVLGQVLEESRRQGKDLVMGWLDLSNAFGSIPHATIMDAVAGMGIPSRIRTIIHQLATGAATTAKTIDGMSEEIPIEAGVRQGCPASPILFNIAIERVLRKIKTVNAGYLLYGSRISPLAYADDLVLIASSPEEMRSLLRAADDAAIEAGLHFNPKKCATLHLTGKKSSRRAVQTGFLVRGTPIPAMTEGDAYEYLGIPLGLKKNQTPRAAMEAIVGDIAKIDDSLLAPWQKIDAARTFVAPKLDFVLRSGATLRAPLRHLDTVIKKHIKKWLYLPQRASAEVVYTPLKKGGAGILPSSILADVLTIAQAHRMVSCPGEVVSRIASEGLREAVKRKINREPSGDEMAHFLSGSTLSGETASFGDAGFWSRVRMATKRQAVHLGVRWAWRGGELLVESRGQRNRPVATDSNSRSQLIQRLRCAAQDEFLTILINKPDQGKVAKLSTLTPVSNAFIRDGSFTRFADWRFIHRARLGVLPLNGAIRWGSGDKRCRVCGYQLESVPHVLCHCMHHSNAMQQRHNAVMDRLAKAGSRLGTPRVNCRVEGVAEDMAALRPDLVWRDERSRKIVIVDVTVPFENGAEAFDNARGEKEEKYRPLAEALRAMGYQVKLEAFIVGALGSWDPKNERVLKTLGVSRFYAGLMRRLMVADTIRWSRDIYVEHVSGIRQFTLPSGAPSN

SEQ ID NO: 1430 - protein, 1258 aa, synthetic construct
  source 1..1258: note = Description of Artificial Sequence: Synthetic polypeptide
MSGPRQAAADPRPSTDPRRQRDSQSPEPRLTRAASRRRTPDPEDAPRTTAEHPERRRTPPDPRGPSATTAGPERRRPPDPGGPEDDPPEGLPTLVEEPRTPPTPDPPDGRPRRGCRRGSAHVPPLPPPCEAAVPDLPPAKAVQVAQRHEQTPTALPPAAPSVLLLPLRHRVRGPEAPEEPPQGMPGPRGREETRHAGEVRRPTTRAAARRPARPAAPPATPPDQTSGDRPTERPAPATPPRRSAPRDPRPDVTPRPDGPPPGPPGPPDAPDPPRIPEPPGEPEPPGALQLPSVPGSPGAETSAQQRMPTPRQALWLEELSRATAFEAFEASVARLTEELSAAARPGQPRRGADNGPTTRRDHRPQPQRRPRRQRYDPAAASRIQKLYRANRPKAAREILEGPSAFCQVPRETLFNYFSRVFNPPAEAAAPRPATVEALTPVPPAEGFEEAFTPREVEARLKRTRDTAPGRDGIRYGLLKKRDPGCLVLSVLFNRCREFRRTPAAWKRAMTVLIHKKGDPTDPGNWRPIALCSTVAKLYASCLAARITDWAVTGGAVSRSQKGFMSTEGCYEHNFTLQMALDNARRTRKQCAVAWLDISNAFGSVPHRRIFGTLRELGLPDGVIDLVRELYHGCTTTVRATDGETAEIPIRSGVRQGCPLSPIIFNLAMEPLLRAVAGGPGGLDLYGQKLSVLAYADDLVLLAPDATQLQQMLDVTSEAARWMGLRFNVAKCASLHIDGRQKSRVLDSTLTIQGQAMRHLRDGEAYCHLGTPTGHRAKQTPEETINGIVQDAHKLDSSLLAPWQKIDAANTFLIPRVAFVLRGSAVPKTPLKKADAEIRRLLKKWLHLPLRASNEVLHIPYRQGGANVPRMGDLCDIAVVTHAFRLLTCPDATVSIIAASALEETARKRIARQPTGRDLATFLSGSLEGEFGRDGGDFASLWSRARNATRRLGKRIGCAWTWTEECRELGVSLQPAPHADRVTVTPRTRTFLERFLKDAVRNKYAGDLRAKPDQGKVFDVTSKWDASNHFMPSGSFTRFADWRFLHRARLNCLPLNGAVRFGHRDKRCRRCGYAAETLPHVLCSCKPHARAWQLRHNAVQDRLVRAIPAAAGEISVNRTVPGCESQMRPDIVITNEEAKKVVIVDVTIPFENRRQAFTDARARKREKYAPLADTLRGRGYDVTVDALIVGTLGAWDPSNESVLRACRVSRRYAKLMRCLMVSDTIRWSRDIYVEHITGHRQYSDPTRRAAAGPDPEGTA

SEQ ID NO: 1431 - protein, 1241 aa, synthetic construct
  source 1..1241: note = Description of Artificial Sequence: Synthetic polypeptide
MSCPREGSDHLGPDPETPALHQGSDIRVTSSRLRGSRGKSSRQPSSRHQVPASEASATAQQTAANECQVCGSSFATSSGLRRHMARLHRAASADPEGAAPASITEIFDYPLPSRWKCSACSENFFNQQTLKRHQTRHHPATTFAYAFRCSSCRSEFDSARRAANHWQVHKKERSQLSGTEPQASSQARVSMAHSPPPLPNTSWAELASNPAEIPSFVWESPPKNRPSVEEFGSSLPTDVTMMSQSPPPQVQSSPVPALTPLSPAATASSSPPGAARQLTPPTQTNTPVTQRARLQPEADVVPELPPSVTEHPVSDAQHWVDAVSSASDWSEFEAVCDQFVIHAVAVSRPNLARPQQQDRQRSGDHPPRQQRGQHRPTFDVREASRIQKLYRTSKKRAIRHILKEKSPSFSGSESDVLDFFREVYSAKEVDEEAVGKLASSLFDVPQGDDSATSLSLPTSAKEIGARLSRMTNSAPGKDRLEYRHIRRADGSFSISEAIFNKCLAEGRIPAPWKTASTILLHKAGPTDDPANFRPIALQSCLYKLFMAVLADRLTKWACENQYLSPEQKSARPCEGCFEHSFLLSAALKDCRRNQKTICIGWLDLRNAFGSIPHPVIKIVLSSLGVPDSLVTLLMDAYNGASTSFTLTGGQTDTVPIRSGVKQGCPMSPILFNLAIELIIRAVKKNASDNHLGVTVQGKNLSILAYADDLVLLSRDTEGLQSLLQVAGSSASTLQMQFKPQKCATLTLDCKRGTNVRQSAHHIQGAAIPSLTEEERYRYLGVPIGLPRLTSLQESSRKLSSDIETISSSLLAPWQKLDAIKTFVIPILQYTLRATEYLKSDLKPLRAAIIKHVKKICHLPVRSSNAFVFASRPSGGLAFVDPGVDADILVVTQAVRTLASDDDTVRAVALGQLTSVVHRTVHSAPSDDCIDKFLSGSSEGPLANSGNSGQASSLWSRTRAASRRLKIRIVGASSGDIKVESGGRAIPSKKVTAGLRSDHHNEMSEKLRSLPDQGKVARALSLDSFANATSWLTSGSFIRFCDWRFIHRARLNCLPTNAAVRRWKQNANTKCRRCDHQLETLPHIINNCRPNMVPIRRRHNSIQERLVKAIHYGDIYQDQHVPGDPNPRERPDITVVEGNKVTIVDITIPFDNGPDALSTAANAKVMKYDTLRQELASRGMDVEVHAFVIGSLGSWHGDNERVLGRLGISRRYRTLMRRLCCIDAIKGSRDIYIEHVTGHRQY

SEQ ID NO: 1432 - protein, 1203 aa, synthetic construct
  source 1..1203: note = Description of Artificial Sequence: Synthetic polypeptide
  VARIANT 3: note = Any amino acid
  VARIANT 213: note = Any amino acid
  VARIANT 235: note = Any amino acid
  VARIANT 271: note = Any amino acid
  VARIANT 328: note = Any amino acid
  VARIANT 347: note = Any amino acid
  VARIANT 372: note = Any amino acid
  VARIANT 451: note = Any amino acid
  VARIANT 463: note = Any amino acid
  VARIANT 770: note = Any amino acid
SGXTGREVKCITVNVLMEQQPHTKAIREGDFIVILLPQSDDETLCCPLCVGRGRYSGKTRVECLNRHVKEVHPDLTTTFRCWGCGFAAPGDKKYPRKIVTQHCATCVPEVSSAPSGRVDGERRVNTRRRLGIAAATEASPVRRTRRNGLASPPVEQNISQSAAPPEPARVPQHPEIVALGESADDEVFRSPVNSPPRDWRAAAPQQAASSSPXAVPGITAATPSNTTRTGNGSAXSILAEHPIPAPPPTNTTEANGRADIPRSGRAPPPGXQAARRRAPTTEQRRIVGLLEAATGREQLEEATTQAMLFLARLTGRRPEPRNAIRPGXRQRHPAQGDVQAQAPDRIXEAKKLQRLYRTSKKRAVQKILAGPXMNCQIDKNTITAHFVELAARRDGGEDWPDVFDREEPTAASGEALCTPITREEVFRRLKGRNNTSPGPDGITYRDLAKAXPGAHVLAALYNXIWRIEATPALWGVSNTTLIYKKGDAMDISNWRPISLGDTVPKLFAAILADRIKRWAVANGRYSASQKGFLEFEGCYEHNFVLQEAIREAKGGRKELVVAWLDLASAFTSVPHSSILQALEGHGLPSKARNIISSLYTGMTTRFHTAEGPTDPILIQSGVRQGCPLSPDVFNLTLEVVLREIQRTGEGYTIEGRRISHLAYADDVAILADSPAGMRRLLFAAERGARAVGLTFNPAKCATLHIAGRGEEAVRPTEFSVQGTPVRALASGEAYEHLGIPTGYQVRQTPINTLRDLLADIGSIDRSLLAXWQKLDAVGTFLLPRLDFTMQGAHIDKGFLTEADKIIKKAAKSWLSLPQRASAELVFLPPSQGGGGLLTVAHSYKMLYSSDVTVSTIAGSTLRRTVSERLKKRASNIDIARFLSGDLDLPRSTSPSTFWTKVRSAALRIKTKLGLRWSWCQGGEVLLMACGDPRAPGTRVSPQTKHLVTTSLRRCLNRHYAESLLAKKDQGKVFEVTRRSGQSNHFLRSGSFTRFCDWRFIHRARLDVLPLNAAKRWQRGMDKRCRRCGSDLETLPHVLSHCGPHSAARQKRHNNIQDRLVKAASRCPGTISVNQTVVGVRGPDAALRPDIVVRDDVNRRVTIVDVAVPFENRLEAFDGVREAKIAKYTPLARQLTDSGYTVTVEAFVVGALGAWDPRNERVLSLLSISRYYAILMRRLMVSDTIRWSRDIYVEHVSGIRQYRE

SEQ ID NO: 1433 - protein, 1458 aa, synthetic construct
  source 1..1458: note = Description of Artificial Sequence: Synthetic polypeptide
MVVSRITARLEATPAPRWDPPLPRRVIASRIADRLVPATAPCRSALNAAFPSPSRDTVTESFTQEDRQLEPLTRHVDEETKDSELPGRAPTVLDEESKDNDATAGEWLLRFDGACRANPGPGGAGAVLFNPSGAASWTCSHFMPGATETNNTAEYTAFLLGARAAADHGATLLRVQGDSQLVLRQVKGIYGAKSTRLRRLRDAVRAELARVGQFSLHHIDRQDNAHADRLANRALDMKSTLVECATHPGRNACTTTLTTSAAAESPASPPPVGARDTPMADAGEERLADVDDGEVYAAMRLGPGEVPERRPRLRLRQLSDEELEAASEMVERLGAALSAKITDAEDWASAEGYITALPYMLYDKLQSYSQAPRGPQQPVLTRSPRGDDRPASSEPNASSTTGGVASEHQPRRRRRRGRRKGRRQRRNPRRSGREGATGGHQQHKKHKPRPPRETQHHREHRLDEALDELHALERTDPHNRPAIAKARRRVGRIRSAINQQLLRHKFDTDEKACVDGILSTARAERAARAATPSPPASGAPTTTVSAPGAIVTNDDGTCPIPSDKLWRHFDAVNTPRLDFDAEAPGSAAFRAAMDHLPAATRLLDLLKEAPSTDEIETQLQHVKASSSPGLDGVGYDVYKRFTIQLLPVLRAAFRCCWLYKKVPQSWKLGVVRLLHKKGPREDPANWRPICLQQAIYKLYTGILARRLTRWMDANDRHAPGQKGFRAVNGCGEHNFLAATLIDNARRKHRPLYEVWYDFRNAFGSVPFALLWDSLQRLGVPPDYVDMCKGLYNQASFVVGNAVDGSTAPVEQRVGVFQGCPLSPQLFNAAISPLLYALRRLPDTGVQLSSVDRPGASAYADDLKIFSGTKAGITQQHELVATFLRWTGMQANPAKCRSMGVRRNTNGAVEADNVHLELDDTPIPSMTHMQSYTYLGIGDGFDHVRRRVELAPKLKTLKHDVTALVESGLAPWQVVKAVKVYLYPRVEYALRHLRPDDQHLESFDLHLRRGLRHLLRLPKNATNEFFYAPVSRGGLGLLPLVELHAALQIAHGWQTLHSPDPAIRRVAREQLYQIADARHRLDKDHWPHRREELCELLLNGELGTSAHAPPKRRNGDIGSLWVDVRKNLKTFGLKVATAPANQETGVPAQPLQLRVPHHAEWLDHGNVLRHVKLHIKNLHWQTWCALSDQGKTARVHGGVGSAFLTRPRGMWESDYRFAVAARLNVVDTVNTLSRRRLRAHDRCRYPACRWKETLAHVLNHCPGTMDAVRGRHDDALKEIEHTLRASSGDRRELRVNQTVPGLPGPPLRPDIQVYNHDKRTVAVVDLAVAFDEQPSEDPESSGLAKAVQIKKAKYAGIKEHLENQGWKVHLSAIVYGSLGSVAASNHKVYTEHLGLLKRDAKRLDRQLSSACIQSSRRIWNFHCAKHRARQHEHQAPPSQATRGRRVTETGGNPSRTDRR

SEQ ID NO: 1434 - protein, 1704 aa, synthetic construct
  source 1..1704: note = Description of Artificial Sequence: Synthetic polypeptide
MLADPAALAAGLARAPPPPSAPQDPSPAFPAGPAGQNPRAAAPARVEVHTVVAPPGRAGGMLPDPGLVEEPIQATYAHDAAQFECALCPYVAESMAVLVQHRRSAHRGTRFKDIFTSGCQCSLVFYARIVAASHAVACARRNQRAVPPAPTPVAPTRPEATPQPTGYLAAAMTAAAAAASSDTVVAAATNMQSAVPAAAKTTGLQLVPPELEPALPQRASCHAGKRRRLNADEAVTPCTPTARVSPQTEVAMAPHDAPQDDTVLQREAAEPQPDPAATPGAQVQRVEDTTAAQDDTVQQDHDADTAQVSPPRRTPTRWGPRPSSTQEPSPMTGEPAATLAARRPLTPAATGTRATRWGPCHRAIGAAAIARLVTGLSTEPAQPQRRQPPPPQEPPSQPEPLAAAATAAADIAATVAADIAAAAANAAMDVDGGPAADETWLLRFDGACRRNPGPGGAGAALFAPSGAVVWTCSHYMPSRSETNNTAEYTALLLGVQSAVHHGASHLEVEGDSSLVIAQVKGTFACRNARLRQLRNRVRHALRSVDTHKLRHIDRQANAHADRLANRALDQRRTSSECGTHGSCMDSCLAVPTALAAQETPPAAPPSTSATPAEGNAMDDIAAEIAARDEGETFPVLPIGPGSAPERQPRLRLRQLSDEERDAAADALQELADTMASKIEDADSWTSGEGYISSIPERIREVLQPYATAPPQPGRSRRQQRRRPPRVTRNQREHRLDEALDDMAATQQATPRDQRAVRRARRRVGRVRASMAQQELRHEFAKDESKCVAKILKTASTETAAEDEHPETCPIDAATLHAHFTGVNAPRTDFDYDATSGREFRAAMSDLPPATVEIDAFDAELTIDEVEDQLTRAAKTSSPGHDGIDYGIYSRFAAQLVPLLHAVFQFCWRHRRVPRLWKVGIVRLIHKKGDPRQPTNWRPICLQPTIYKLYSGLLAHRLSRWLEGNDRLPMAQKGFRAFNGCHEHNFMATTLLDQTRRQHRKLYQVWYDLRNAFGSLPQQLMWRVLRHLGVDSGFIDRCRDIYRDSAFVVANAADGATDPVRQEVGVYQGCPLSPLLFVAALVPLVRRLEKLDGVGVPLADGVRPCTTAYADDLKVFSDSAAGIRKCHDTVAGFLAWTGLRANPGKCASLAVTTNARGNPTRDSSMRLEVHDAAITTLSLHESYRYLGVGDGYDHVRHRLQLEPKLKQLKREAVALLTSGLAPWQVVRALKVYVYPKVEYALRHLRPLQSQLQAFDRVVSKGLRHLLSLPRSATSEVLYAPTSSGGLGLQPLVELHRALQLAHAWQMLHSKDPAIQAVARAQACQVVRKRYRLQEDHWRGRDDELVRSFLNSELAASPHAEVLRRNGDIASLWSDVQRWLRIYHLRFEHCDETEAHGPLSFRVPHHNKWLTHKTVLRHVKLHLKIRHQTRWKGMVDQGKTVRVHGGVGAKFMTTGAGLSDDDYRFGVKGRLNQVDTNSVLKRKRLRAHTTCRDPTCSSAETLAHVLNHCESNMDAIRQRHDDALEQIGSKIRGALDRAKSPTELRLNQTVPEYTGAALRPDIVLRNVAAKTMVIADLAVTFEDQAARARHSSLQLSHDHKTLKYQPIVAELQHKGWRVQTAAIVYGTLGSVQPSNFKAYTEKFKLHKREARQLDLQLSSHCIRASHRIWGWHCRQHRDRQRSGTASRASRGSGGAPRRTSQAPARR

SEQ ID NO: 1435 - protein, 1432 aa, synthetic construct
  source 1..1432: note = Description of Artificial Sequence: Synthetic polypeptide
MCLKSFSSTSGLRRHMARLHRQPSPDASTPSTMTEVFPYPLPKVWPCVVCRENFYHNQTLKRHQKNFHPNVDLTTVYQCSVCGQEFVTGRKASFHFKVHRRMSASAIPTPSAMPSSPMDLIRGLVGEPLPPSPARTPPPLARYISPAPRSSFSPPWNPSPPPRSPTPLPRPLTPPPRSPSPPPRSPTPPPPVTLTTAPVTEPAVPVALTTAQVTEPSAPAVHTAAPVTLSNAPVTEPATPATDPATPVTRLHSPVTHISCSISFTASHAPYSCAAPTSPSVYACSPRRRQCSSTIAAVCNSEASSGNPCLLALPVHRHHLPDTSPQRPGLLFHHPGIPPHRPGRPPHCHGHSLHRHDHRARRPGRQHHLPRSPSPPPRSPSPPSRSPSPPPRSPSPPPRPSTPPPRSPSPTPRSPSPPPRPPILPPRSPDSTHRSLTSHARSPSRPATPPIPVQPRHLRPSTPAHPGVDNAVPPSQQSAIDVWLAELSRSADFESFEDVCDRFVEFAAAEGRNNGRPARPAHQPPRDRGNQGPRPQRPPRPHRPGLGPEFDAQEASRLQKLYRTSKKRAIRTILTGSDVRYSGYRGPHPALMSDTAATEVLTSGFLSLEVFSAREVDTDTIATDTSLLFPNSAQARESGQDLLRPVTQREVSLRLGRMSNSAPGKDRLEYRHIRQVDGAFRVTLEIFNRCLRESRVPSSWKTATTVLIHKKGDATDPANFRPIALQSCLYKLLMAILSDRVTTWALDNDLISSSQKSARPGEGCYEHTFLLSTVVKDARRNQKNMYAAWLDLQNAFGSIPHDAMFTVLTSIGAPEGLVSLVRDVYTDASTDFVTPTGRTAAVPIHSGVKQGCPISPVLFNLTLELIIRAVNASATRDRSAPVVHGQAVPILAYADDLVILSRSSDGLQSLLTTASIMATKIQLKFKPAKCASLSLECRRGTKVRPLEFNVQDKIIPALTEEQHYRYLGVPIGLYRTDDSLETLVAKMTDDIQRIDSSLLAPWQKLDAIRTFVQPCLAYTLRAGDCAKKHLKRLRGQLVKTARKVCNLPTRATTNYIFADRRAGGLGFIDPNVDADIQIITQAVRMLSSPDDITRAIATGQLSSVVHRTIHRAPTQEETDEFLSASMEGDFANSGNSGQASSLWSRARAAARRLKVTISGSLSGSVITKSTENREMAAKSITTALRAQSRAHYTHRLLSLPDQGKVGQSLNQDQYMNSSSWMSSGSYILFCDWRFIHRARLNTLPTNATAQRWKPNTSPACRRCQHPQETLPHILNHCPPNMVPIRRRHNLVQQRIVSAVRHGRVFVDQHVPEDPNPRERPDITVVEGDKVTIIDVCCPFDNGRDALMTAAAAKETKYADLKQALVAAGKDVEVFGFAVGSLGSWLPSNERALRRLGIAKRFRTLMRKLLRIDAIKGSRDVYIEHMCGHRQYT

SEQ ID NO: 1436 - protein, 1216 aa, synthetic construct
  source 1..1216: note = Description of Artificial Sequence: Synthetic polypeptide
MDVDGGPAMPEPWVLRFDGACRRNPGPGGAGAALFKPCGTVAWTCSHYMPNSSETNNTAEYTALLLGVQSAVHHGASHLEIEGDSHLVVAQVKGTFACRNPRLRQLRNRVRHALRAVTSLTLKHIDRKANAHADRLANRALDLKRSLAECGEHQGAMESCLHMNPAAQRQREQPAPPARPACAPTRAESASDHDEDIDAEIAARDGGEAFPTLPIGPGTAPARQPRLRLRQLTEDEQEAAASALQAMAEELACKIEDADSWTSGDGYISAIPSRIRQLLQPFTAAQPHPRPPLQQQRQRPPRVTRTQREHRLDEALDEMAAVQQERPTSRSAVRRARRRVGRIRASMRQQQLRHDFARNESKCVEDILRAASAETAAEEHPETCPIDSGTLHEHFTAVNSPRINFLPDEACGALFREAMADVGTPQERRSALTDELTMDEVEDQLMQAATNSSPGHDGVGYDIYKKFAAQLVPLLHAAFQSCWRHHRVPALWKVGFVRLIHKKGDPNDPANWRPICLQTAIYKLYSGLLARRLSAYLEANGLLLMAQKGFRAYNGCHEHNFVATTLLDQTRRMRRRLYQVWYDLRNAFGSVHQDMLWYVLRLLGVERAFVERCDDIYEDSYFVVGNAADGATEPVRQEVGVYQGCPLSPLLFIAALVPLLRALEKLDGVGVALADGVRPCTTAYADDLKVFSDSAAGITRCHAVVEKFLEWTVLQANPGKCAFLAVTRNARGNPAHDKDMKLSLHDEEVSSIKLHDSYRYLGVGDGFDHVRHRLQLEPKLQQIKREAVALMQSGLAPWQVVKALKTYVYPKVEYALRHLRPLQSQLQGFDRVVAKGLRHLLRLPRSATNEVLYAPTSSGGLGLQPLVEMHRALQIAHAWQMLHSKDPAIREVARAQVWQVARKRHRLREEHWRERDDELVRCFLNSELAASPHAEALRRHGDIGSLWSDVQRWLRIYHLSLVVQDDRNGLDPLGLRVPHHAKWLDHKSVLRHVKLHLKIRHQTRWKGLADQGKTVRAHGGVGAKFMSTWAGLSDDDYRFGVKARLNQIDTNAVLKRKRLRSHKTCRDPTCSSAETLAHVLNHCESNMDAIRQRHDDALEQIGSKIRNALKRGKSTAELRLNQTVPEYTGAALRPDIVLRIVAAKKMVIADLAVTFEEHAAGARHSSLQLSHDHKTLKYQPIVAELQLKGWQVQTAAIVYGSLGSVQPSNSTPTRKS

SEQ ID NO: 1437 - protein, 1417 aa, synthetic construct
  source 1..1417: note = Description of Artificial Sequence: Synthetic polypeptide
MGTQSARERGAPSAPHSHTLGPRTPPRPPACSKHGELESAAGGRDGQCSDGAERERDAERDIRANERDCNGDGDGDDADSDSDDRNDARRRSRRPRATATTTTSAPTTTTTTTTSATTSATTPATDSSPWVLRFDGACRRNPGPGGAGAALFEPGGAVVWTVSHYLPGSETNNTAEYSAMLLGVRSAIHHGATRLRVEGDSHLALSQVRGTFACTNRRLRKLRNRVQAALRELGDYRLVHIDRQANAHADRLANRALDLRKTKVDCGPHATTTDACVQPAEILAPTARLSSSSSSSSSSSSDEPMPGLEEPAADDETDADAEADIAMRDGGEIFPTLQIGPGSAPAQQPRLRLRQLSDDESEAAARTLEHFANDMASKIADADDWRSGEGYISAIPVRLRELLAPYAVPIRSPPRNASSRPPRPQSRPPRPPRVTRHQREHRLDEALDDLAAAQRSTSTDQRSIRNARRRVGRIRTAQAQSDLRSQFATNERACVESILRAAKPDGTEPQASAGTCPIDRATLHAHFAGVNTPRERFDFDDALGADFRAALDVLPPPDQAADAFADELSLGEVEDQLDRVVASSSPGLDGVGYDVFKRFRLQLLPLLHAAYQCCWRHRRVPATWKVGLVRLLHKKGDRAEPNNWRPICLQQAIYKVYSGLLARRLSRWLEANERFTTAQKGFREFNGCHEHNFVASSLLDQTRRLHRKLYAVWYDLRNAFGSMPQPLMWRVLARLGVDTAFLQRCEDIYADSFFVVGNAADGATDPVRQEVGVYQGCPLSPLLFISALIPLLRALQRLPGVGVPLADGVRPCTTAYADDLKVFSDSAAGIQQCHGTVARFLRWTGLRANASKCALLPVTTTARGNPAIDDTLQLELHGDAIARLTLQSSYAYLGVGDGFDHVQHRVQLAPKLAELKRDAVALLRSGLAPWQVLKAIKVYLYPRIEYALRHLRPLQSQLEGFDRAVAKGFRHLLRLPANATNELLYAPVSSGGLGLLPLVELHKALQIAHGWQMLHSKDAAVQAIARAQVRQVVQKRYTLDADHWQGRDDELVQLFLNSELAASPHATIKRRNGDIGSLWSDVQRHLKTLQLRLETREPTADAPDSPNGLLHLRVPHHRKWLSHKTVLRHMKLHIRLCHKHKWQSMSDQGRTVRAHGQAGSHFVSRGVGLWDADYRFALQARLNQLDTNSTLKRRRQRTNATCRAPNCSRTETLAHVLNHCETNMDVIRQRHDGALEQIGAAINAAIKGRRTDTEVRLNQTVPEFNGPAWRPDIQVRDARSKTMVIADLAITFEDQPNDQSASSSLQHSREHKIAKYQPIAAALERQGWRVHTSAIVYGSLRSVHPSNFTVYTELLGLLKRDARRLNTTLSCHCIRSSRRVWNWHCGQHRARQHQRCQEGRAHGSGGNQRAEGGTATT

SEQ ID NO: 1438 - protein, 1369 aa, synthetic construct
  source 1..1369: note = Description of Artificial Sequence: Synthetic polypeptide
MATVRLKYPYPPEGILCGPCAANTNAPQTRPYSDKSGLAKHLKLYHKATLVVECRHCGHEESDLRKMKKHISTNHPVAAAAAPTVPPRLGPTAPPPPRVILRPRFIPRPRTPSPSSSSSSASSPASSRRSVSLPPASPPVSSASSPAARSGRNSPDSQGTAPVTPIGTVRNSPAGSPALSYSTASPIASTITTPRHLSPASPALSAGPGSLGASPPVSPTAATVPPAPPATVPAVMAATVPFVAATTVPSVGSSTVPQRPAGPRRPPPFPIDDWIGRIARVSSLPELDAVSRLLEDEVVKRRPPDPNARPASLHPTRRPPPPSTRPRPCHGTGGTSVSLAALTSSCIREDHRGSLPLLCTSGWDSPWPLSPSPSSHCPSSNPCPSSSTPPSSLLGPPRHSHLTWRGSGSTTPSHRHCSRARYHHLLWRLPYPSSPRLPYPPSALARYPSVPPALDDPLPSLSTIGSEGSPECHLCRNWTPSQGCSRMKWSRDAPLTPTPDPPHSIRHAALPLHLLALVPAMGPAELQSLWRRSRPRAFAKITEGASPFCALPVGTVHGHFLQVHQATAHLPTPVPLPPLRPPRSSDPLVTPISPGEVLDRLRRATDTAPGPDTIIYSEWRAIDPTGRLLSSLFQKVQTFGAPTRWKESTTTLIHKGGDHTAMSSWRPIALLSTVAKIYGSILSHRLTTWAVQNGRLSLSQKGFLPFRGCLDQNYLVQSCLQDARRNKKTLSLAFLDLKNAFGSIPHLTIRHSLEWLGLAPSSIDILEASFLGSSTRVRTETGLTPPISLDTGVVQGAPLSPILFNLAIEPLLRTVPSAHSGFSLHGHVVSVVAYADDLAILAPSTPALQSQLDAISGMADWAGLSFNPAKCATVTLTGKDNSRDTLSLQGSPVPSISDGDAYKHLGVPTGTTTFPSGTDAIKKMTTDLQAIDHSDLAPAQKLDALRTFIMPQLSFHLSHGSVPKAPLTQLDKKIKRAAKHWLFLPQRASNEILYMSHLHGGQSLLPLSVLADIGQVTHAVALLQSRDPAVADLALRTCREVASKRAKKTVNGPELAQYLSGSTDGIYCTPTSDIPSLWTTARAATRRLSSTLPLTWTSPLPSGVPFLSINGSPLSPFRVQSTLTNAIRHNHLSTLIAKRDQGNSYRTSHDPDPSNYWVKGGDFLRFCDWRFIHRARLNLLPVNGARRWDANSIKTCRRCGAPNETLAHVLNVCPVGLPEMKKRHDAIHARIKKALRPSPHTVVHHDRTVPGCGPLRPDILRISERDKSVAIVDIHVPFDNGTDAVERAHETKRAKYELIRRHYEHQGYRVTFDSLVVTALGRLWRGSEAALQALQISSQYSKLLRKLLVADAIHGSRNVYAHHMTGMVM

SEQ ID NO: 1439 - protein, 1305 aa, synthetic construct
  source 1..1305: note = Description of Artificial Sequence: Synthetic polypeptide
MSHSITEVFDYPLPSRWKCTVCLENFFNQQTLKRHQARHHQTTSFLYVFRCSACQAEFDSARKASNHWQSHKRKPILSQPAVNEIPSSGLDPSPPRSRPPVEVIGSSFPDDVSMLSEPSTPSTSLQMDPEVVHPPSRSISFSPMHLSPTQPASPIQIGVEVSFNSSSSLQMDPEVVQPPSPSISFSPMHLSPTQPASPIQIGVEVSFNSSGSLQMDPEVVQPPSPSISFSPMHLSPTQPVSPIQIGIEVSFTSSSPLQMDPEVVQPPSPSMSYSPMHLSLTQPDSPIPVDIDVIPAAEVPLPDIEIPPSPDRHPAAEVPLPDIEIPPSPDRHPVAEVPLPDIEIPPSPDRHPQSPPRPVMMEQPVHTPPPADTQQANGPQHWVTVLANATNWEDFGRVCVEFANHAVEAARSRQDAPQVRPAAQRQPRRPTRPRQPTFDVREASRLQKLYKRSKKRAVRHILRDDAPSFSGSNEQLLDYFKEIYAPPEIDENRAQQLAESLFTDLEEAKESAAALMSPISQQEISTRLSRMSNSAPGKDRLEYRHIRQADGACRVTHIMFNRCLQEHRIPSAWKEATTILIHKSGTTDDPANFRPIALQSCLYKLFMGILSDRMTQWACNHNLLSPEQKSARPCEGCHEHTFLLSSVIKDTKRNQKTANIAWLDLRNAFGSIPHQAIHAVLTTIGAPVSLVMLLKDTYTGASTSFLSTSGETDPIQIQSGVKQGCPMSAILFNLTIELIIRAVKKKATDDGLGLVVHGQRLSIMAYADDLVLMSKTPEGLDAILSVASEQAETLRLAFKPTKCASLSLSCRHGTSVLPREYTVQGHLMPALDEEEQYRYLGVPFGLPRFTNLKDLIGKLKGNIETIASSLLAPWQKLDAIKTFVQPGLSFVLRAADYLKSDLRSLKSAITTNVKKICQLPLRAANAYIFAAKESGGLAFIDPNVDADIQVITQAVRVLSSDDEVVQTIATSQLKSVVHRTIHAVPTEEDIDNYLSGSNEGLLANSGNSGQASSLWSRTRSAARRLHLTLRATTSGTVVVNQQADIDHTRDILPASITRGLRLIQRTTNAEKLKSLPDQGKVARSLSNDPFANGSSWHATGKFIRFCDWRFIHRARLNCLPTNVATKRWKANANGKNGHQQETLPHVLNHCLPNMVPIRRRHDNIQQRLVTAIRHGDVFVNQHVPGDPNPRERPDITVIEGNKVTVIDISVPFDNGPNACTTAAQAKVEKYSALRQALRDMGRDVEVHGFIVGALGTWHQGNERALGRLGVSRWYRTLMRKLCCIDAIQASRDIWVEHVTGHRQYE

SEQ ID NO: 1440 - protein, 1701 aa, synthetic construct
  source 1..1701: note = Description of Artificial Sequence: Synthetic polypeptide
MCSAKTPALKSGRRRGKEVNYEGQIVRVERRRGSRSSTSATDLGTRMVTRGRKKLMEASVREAGHHGGESASTVDVDVVESKKITGKTARRNRRAPSGDGKRRESCGAECGQAVCGNAVADRSEASSPRTPNVSKSGRDKCGQPTIKASTPSPPKRKPTTSSSPRTPCLSKRGARSKIPSTPDTPSTSGGSGKQRVLVSPLLRTEKLPDLEVLQRTEEQVTVRATFPIAQAVVCPLGCEKPYTAVRPDGQFAHQTLTRHFMRVHNCHSVQWHYRCRNCNTDFLPADHRYPLRVVNTHVRSCVSRWEITRKLGESEDLHGVRCDLCDYVGVSKRAVGLHRRRHANENIMQNTGTAAQIEALSKQVGEIRVAGDYSQFKFGKRVRQYVAPTQRRDGLDEEEVHEAEEEEVPAESRTILGEPSTATAIGAEEISATGPVRADTAAQQMICRIGQWCVWPQDYHSIPAPQCWTDTLMDLMIEQIVLQRYPDGAGVSVMSCSAVSAAIHHEISAEFAAQVMSSHDASLYCIIPVNVRNHWQMIVLDVAERVVHYYCSLREHNTVVLSSLLSLVELSGKHTGCTSWKIETHDGAPVQTNAFDCGPFSCLFLKHLLHGIDMNFGDRESAALRTDLKFMIDAVSTPVVPATDKLKKKPDGSATQLTQFQQKFLSASDNWQSPDVDLQAVYDEVVESIVSGHNEPSSRNTSRLQKKSPGKGGKGQVRRRSAVTRDPAWLKSASAVQKAFNSAPARTVNAILRRPNACPSFTATQVADHYFNLRPAVTSLAPEVIDILPPPATDHSMLVAELSESEVWEKMQKAPNSAPGADRITIRMVRMADPGAMILTRFYRACLLRKWVPLQWKQSVCKLLYKDGDKERLANWRPIALEPVLQRVLSAVVASRVTNWARANGLISLEAQKGFQPADGTSEHNFVMEVAIQEARRTNAQLAISWLDISNAFGTVSHQLLFSLLERYGLDPTFTSFIQNLYKDATIVVKGANGTHVTARWSVGVRQGDPCSGILFCLFVEPLLRSVLPSLPCEAETTAVNVLGQPITALAYADDIALFAPSIGVMQQQLCKIQGMASAMGFRFNPKKCASLYLNRAVVNAATFTISGEEIPALVHGDTFRYLGVAAGLGKPQTPFSLLRENLREAELIFRSKLAPWQKMDAYRTYVLPRLTFQLMIAKFNNIKQSAGQYDRAILRLVKRCFQLPVETSTDFIRAPRQCGGLGVPSLRELYATAKVSRALKMLWSPCRVVSSLAASQLQRVASAYFAKRLRDVEAADLSTFMNAARSTPLDRSGYPTCLWMDARKQMSYLTKVAGVDCYFLVGEAGTSFFIRNGLGQTVSVLSPLRKNKVMSVLGGAIQTRHLDAWLQCKRQGKTASCIVLDRSSSRFITTGRYTSFAAMRFALPARLDLLPCRARSSMRSYQNCRRCGYDRETLPHILQHCRQFSAPAYQARHDAVQGRLETVMRRRFPNLRVNRALPEIGSNKRPDLVVVDEEKRLVILLDIAIVFENTAAAFVDARTRKWAHYEKEILAYRLRGYSVTYDAIVVGALGTWDPKNDAILKRIGVVSQRYLRLMKVLVVSEMLEHSSRIYRKHLGLRDLLPDTGTKRRPVGTTETDPPGGDLRQKKRNTISARASGGKCLERRFTSPVGTPSQRGELQCQPCPGPRRPALAGIAPNPPSLQPRKPPPRQHQKPVTKSTAH

SEQ ID NO: 1441 - protein, 1195 aa, synthetic construct
  source 1..1195: note = Description of Artificial Sequence: Synthetic polypeptide
  VARIANT 231: note = Any amino acid
  VARIANT 253: note = Any amino acid
  VARIANT 275: note = Any amino acid
  VARIANT 387: note = Any amino acid
  VARIANT 389: note = Any amino acid
  VARIANT 398: note = Any amino acid
MLQLRLPTPQTLRLLHPSQLPQSHSTKRWSNIYEERARAPKDTTIERVSAASKIPKLDPAKRRIGAPLQLMQGNSISRQLSASSQYVQHNAVVRRVSAPPHTGNFTGSCRRKLALPHRPPSETQPAESYLHCWTTQRDPTLADQHGLQDHPTGLPPEGSHCIKDPRQNSSTEGQRRSGNSQARRIPKRASTAASKTVLPKRTSAALKSVREDTALVLEDPAKWSSQHREGXRQQANPTAVFQPEPAEIEQQPXVRAATPWQAAWMEELARTASFXDFDLLVDRLTKDLSAEIVSGRKGTQENTPTAHRQNQNNMREARRRNISRCYDPAAASRIQKLYRSNRPKAMREILDGPSSYCAIPSERLFLYFKGVFDRVAQNDMQRPECLXPXPRVDYAEDXEQDFTSWEVEARLTKTKNTAPGKDGIRYNFLKKRDPGCLVLTAIFNKCKQFRRTPSSWKKSMMVLVYKKGKQDNPNTRRPISLCSTMYKLYASCLAARITDWSVNGGAISSIQKGFMSCKGCYEHNFVLQTAIHMARRAWRQCAIAWLDLANAFGSMPHQHIFDMLREFGMPENFLQLVRELYEGCTTTICSMEGETPEIPIRSGVKQGCPLSPIVFNLAMEPLIRAISSGLGGFDLYDNRVNILAYADDLVLIADNPESLQQMLDITSQAANWMGLRFNARKCASLHIDGSRRDSVQATSFQIQGEPMIFLEDGQAYQHLGTPTGFRVQQTPEDTIAEILRDVARIDSSLLAPWQKINALNTFLIPRISFVLRGSAMVKVPLNKADNTIRQLVKKWMFLPQRASNELVYISHRQGGANVPRMGDLCDVAVITHAFRLLTCPDAMVRNIAESALQDAVKKRIARTPSNQDVATYLSGSLEGEFGRDGGDFASLWTRARNATRRLEKRIGCHWTWCEERQELGVLVPQVKNTDHTIITPRARTMLERTLKDAIRCQYVENLKRKPDQGKAFEVTCKWDASNHFLPGGSFTRFADWRFIHRARLNCVPLNGAVRHGNRDKRCRKCGYANETLPHVLCSCKPHSRAWQLRHNAIQDRLARAIPPPVGKVAVNSAIPGTDSQLRPDIVITNEDRKKIIMVDVTVPFENRTPAFHDARARKVEKYAPLAETLRAKGYQVQTHALIVGALGAWDPSNERVLRECGIGQRYARLMRQLMVSDAIRWSRDIYIEHITGHRQYQEG

SEQ ID NO: 1442 - protein, 1465 aa, synthetic construct
  source 1..1465: note = Description of Artificial Sequence: Synthetic polypeptide
  VARIANT 27: note = Any amino acid
  VARIANT 59: note = Any amino acid
  VARIANT 61: note = Any amino acid
  VARIANT 425: note = Any amino acid
MQDMEEELLLDVEMETETTEPQTSTAXDATTTTDRPTRWGPHPRAVAAAAIAQLVTGEXAXPALPSRQDRRPAPRSHAPTRSRWGPRHQAVGAAAIASLATGLPASAAPVSRATKHGEGRRRLQTRWGPRVSIPRAARRPGSRWGPPRAAGASGQLPASASGATGQLPEHVEAITTTPRVASDADEGPTPPDPWILRFDGACRRNPGPGGAGAALFKPSGAVVWTCSHYMPSSNETNNTAEYTALLLGVQSAVHHGATRLDIEGDSSLVIAQVKGTFACRNAKLRQLRNRVRHALRSVEKYTLRHIDRKANAHADRLANRALDRRSSSSECEPHGSCMERCCGTDTTPAVQGPTPQAAAAVPVQVWPQWQRQTMVAWTTSHGGRCRDCSTRCGRSLPSLAHRPRLSPRRQPRLRLRQLSDEERDXAADALQELSDVMASKIVDADSWDTGEGYISSIPERIREVLQPYTTRPPRPGHQQQQRRRPPRVTRNQREHRLDEALDDMQATQQAAPRDQRAIHRARRRVGRVRASMAKQELRQAFAKDESKCVSKILAGASAETAAEEHVDECPIDAATLHAHFTGTNAPRTDFDYDAACGQEFRGALDSMQPPTVATDAFEEELTIDEVEDQLTRAAKTSSPGHDGIGYDIYSRFAAQLVPLLHAAYQFCWLHRRVPALWKLGIVRLIHKKGDPMQPTNWRPICLQPAIYKIYSGLLARRLSRWMEQNQRLPMAQKGFRAFNGCHEHNFVATTLLDQTRRSHRRLYQVWYDLRNAFGSLPQQLMWSVLRHLGVDASFIARCKNIYQDSAFVVANAVDGATDPVRQEVGVYQGCPLSPLLFISALVPLIRRLEKLDGVGVPLAEGVRPCATAYADDIKVFSDSAAGIRKCHDAVTRFLEWTGLRANPGKCASLAVTTNARGNPVRDDGVHLELQGEVIAPLSLHDSYRYLGVGDGFDHVRHRLQLEPKLQQIKREAVALMQSGLAGWQVVKALKTFVYPKVEYALRHLRPLQSQLQGFDRAVVRGLRHLLRLPQSATTEFFYTPTSGGGLGLQSLVEMHQALQVAHAWQMLHSKDAAVVAVAKEQVCQVARKRYRLQEEHWRGRGDELVRLFLNSELAASPFADCLRRNGDIGSLWTDVQRTLRLHHLSLTAQDDRDGQDPLALRVPHHTKWLDHKTVLRHVKLHMKIRHQTRWKGLVDQGKTVRVHGGLGAKFVSTGAGLSDDAYRFGVKARLNQVDTNAVLKRKRLRSSKTCRDPTCSSAETLAHALNHCASNMDAIRQRHDDALEQIGSKIRGALERAKSTTELRLNQTVPEYTGAALRPDIVLRNVAAKKMVIADLAVTFEDHAAGARHSSLQLSHDHKTLKYQPIVAELRVQGWQVQTAAIVYGSLGSVQPSNFKTYTEKLKLHKREARQLDLQLSSHCIQASHRIWGWHCRRHREGQRSGNTSRASRGSGGTPRRTSQVRARR

SEQ ID NO: 1443 - protein, 1812 aa, synthetic construct
  source 1..1812: note = Description of Artificial Sequence: Synthetic polypeptide
MLADPAALAAGLARAPPPPSAPQDPSPAFPAGPAGQNPRAAAPARVEVHTVVAPPGRAGGMLPDPGLVDSSPAAATAATPAPVAATATTARAAARVAVEHHAHAEPNQEHLPMARVLVEPMQVDECSSCDRSTLTADDGSGDDVAAPSSMLSNDVAAPMDVDSGTSCPPTLQQPLQRPRALHVGSKRRRLDADDGEEAHQLQEEEEAGIHAPALRLSAASAQPASVLAVYTHNASRFDCTLCAYTAGSFASLLTHRNSRHRRTAFLDRFSAGCACGVPFASRLAAARHAQACASLSSAPSAEASSAAGTSSPTADGADSTVSAVAHAEPGLPHHNDTELTASPPLVSSSDVEVQATKTEATDNRWGAPLPRVLVASRIAGRLAQVPPPRWGPPLPRTTIAARIATRLAATPAPRWDPPLPRSLVVSRIAARLLPALPDAPACEEEAKDSDTMDWAPTWTNEETKESEPHDEAPGQVDEETIDDADGEWLLRFDGACRANPGPGGAGAALFKPSGPVVWTCSHYDPSTTATNNTAEYTALLLGARAAADHGVTKLRIEGDSTLVIQQVRGIFATRSTRLRALRNKVKLELARVGSFSLHHIDRQANGHADRLANAGLDRRRTKLECSVHPDGRGCTNTSVATAAPTAPAAPLPSARPPASTAAPSPDDDHSDQGDIDDGEVYAAMCISPDAVPHRRPRLRLRRLTDEESEEAGNVVERLAASLAAKIADAPDWETAEGYITALPYALYDKLQPYSQSQHQPPRQQQQQQRQRPRQQQQTRQRRQRRCKRGGGSQHRQRKTRRRRPPRVTRHHREHRIDEALDDLHALESRRPQDRTAISKARRRVGRIRSALDQHQLRHRFDTDEKACVDGILAAARDKDRAASVTTTAQTAAPPHSAPASAPSSAVDDGICPIPGDLLHAFFTDVNTPRTEFDADSPIGARFREALAQLPAAIAATELLMEPPSPDEVEDQLQRVRGTSSPGLDGVGYDVYKTFTQQLLPALHAAFSRCWTDQRVPQSWKLGVVRLLFKKGDRQDPANWRPICLQQAVYKLYAGILAHRFTRWLDANTRHADAQKGFRAVNGCGEHNFLAATLTDNARRRRRELHVVWYDIKNAFGSVPHELLWEVLRRMGVPAQFIACCQGIYDAAAFTVGNAADGTTAPIQLRLGVFQGCPLSPHLFTAVISPLLHALKRLPGTGVQLSAVDRPGASAYADDLKVFSDTKDGITRQHQLVTDFLRWTGMVANPSKCSTMSVQRDNRGVLKTANLTLQLDGAQIPALGMTEAYAYLGIGDGFDHVRRRVELAPKLRELKADTTALMQSGLAPWQVVKALKVYIYPRVEYALRHLRPFQQQLQGFDRHLARGLRHLLRLPTSATTEFLYAPTSRGGLGLLPLTEVHGALQIAHAWQTLHSPDPAIRRIARVQLRQVADARHRLDAEHWKERGEELCERLLNSQLGTSAHAPPKRRNCDIGSLWVDVQRHLRSLGLQLQTAPADTHTGAPAQPLQLRVPHHDKWLTHKDVLRHVKLHIKNNHWHRWTSMRDQGKTARAHGGEGSGFLTQPRGMWEADYRFAVAGRLNQVDTYSVLKRRRLRSHDRCRQPGCHRAETLAHVLNHCPGTMDAVRGRHDGALKRIERELHASATDRRDRVELRVNQTVPSLAGPALRPDLQLYNHTKKTVAVVDLAVAFEEQASDDASSSALSLIASHKRAKYDRIKRHLERQGWKVHLSALVYGSLGAVASGNYQVYTTHLGLLKRDAKRLDRQLSVECIQSSRRIWNLHCSQHRTRQHQARPSQGPRGSRATETGGTPSQTSRR

SEQ ID NO: 1444 - protein, 1595 aa, synthetic construct
  source 1..1595: note = Description of Artificial Sequence: Synthetic polypeptide
  VARIANT 337: note = Any amino acid
  VARIANT 1389: note = Any amino acid
  VARIANT 1441: note = Any amino acid
MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGAPFASRLAAANHAHACASLNRTLSVAATPAAGELSPTAGAANATVKAATVTPDSPRQDPPELAASPPLASSPDVAVQAADMQAPTRWDPPLPRTLVATRVASRLTDLTPPRWGPPLPRATVVSRIAARLEAAPTPRWGPPLPRVVVASRIAERLAPPELAADDETKDGEEDQSFTEPVAAARSXGGEDANGEWLLRFDGACRANPGPGGAGAALFKPSGPVVWTCSHYMPSSSETNNTAEYTALLLGMRAAADHGATRVHVEGDSTLVIQQVRGIFATRSTRLRGLRKSVKAEMARMEHVTLHHIDRQANGHADRLANAALDRRKTKLECGLHPDGQGCSSTAATTAVPSVVPDRPPSSTAAAPTPSAEPDETEQGDIDDGEVYAAMCIGPDSIPERRPRLRLRQLSETEEEEAGAIVERLAATLAGKITDASDWATAEGYITALPYTLYDKLQPFAQHRHQPRPQHRQQPQRDPPLGTHDGDHGQPSTSRSRRRRRRAKDRLRRRPPRITRHHREHRLDEALDDLRAVEHASPHDRPAVARARRRVGRVNSAIAQQQLRHKFDKDEKACVDGILAAARASRGLATPSASASRHPPPVPSTAADDGSCPIPSDELHAFFTAVNTPAGTFEPMAPVGAPFRSAVAHLPAATSQPELLSDAPTTDDIEDQLQRARGSSSPGLDGVGYDIYKAFAAQLLPALHAAFACCWRHKQVPQSWKVGVVRLLFKKGERTEPANWRPICLQQAIYKLYAGVLARRLTRWLDANGRHADTQKGFRAMNGCGEHNFLAATLVDQARRKRRELHVVWYDFANAFGSVPHDLLWEALERQGVPSPFIACCRGLYADAVFTVGNAADGTTAPIALRVGVFQGCPLSPHLFTAAIAPLLHALKRLPDTGVQLSRVDCLGASAYADDLKIFSGTEGGTKRQHALVADFLRWTGMRANPAKCCTMSVQRDTRGVLKACNLGLQLDGAPIPALTMSASYAYLGIGDGFDHVRRRIELAPKLQELKHDATALLQSGLAPWQVVKAVKVYLYPRVEYALRHLRPFHQQLEGFDRHLVRGLRHLLRLPANATTAFFYAPVSRGGLGLLPLTELHAALQVAHGWQMLNSKDPAIRRIARVQLRQIADARHRIDAQAWQDREEELAQLLLNSQLGASTGAPPKRRNGDIGSLWVDVQRHLRHLSLKLETAPACAETGTAAAMLQLRVPHHDKWLDHKTVLRHVKLHYKNKHWARWAAMXDQGKTARTHGGAGSGFLTRPRGMWEADYRFAVAARLNQLDTHSVLKRRRLRXHDRCRQPGCTQGGDAGARAQPLRRHHGRGPRPPRRRPQAHRARAARVVAGRPGPRRAPGQPDGAVARRPRATARPPAVQPHQEDGGGGRPGRGVRGAGERRPGELGAGTHRRTQAREVCRRQATPRAPRVEGPPLGARVRLARRGAGRQPQGAY

SEQ ID NO: 1445 - protein, 1614 aa, synthetic construct
  source 1..1614: note = Description of Artificial Sequence: Synthetic polypeptide
MDYDDSEFFDAICIPDEDADVLDDGDEGDEGGNDDESSEPLPLAITNAPSAPLHATMLCGTVTQPWLLRFDGACRRNPGPAGAGATLTRPNGIILWTHYRYIPDKTATNNVAEYEALLDGLRCAAHHGVKHLRIEGDSNLVIEQVKGIFACSTSLRPRRDQVREILRHFETYSFRHIDRALNRQADRLANQALDLLKTVSVCALSQTRVQDDTGAAHGCWHWTPPDASPTDDASTSILTQDVPVPMDIDDYDPDEPMNAADDPVSINAEREGGTVYPVLRLGPNVVPERQKRLQIPWLPPREMQKLEKKIEVLGETFASRIRDAPDWFSAEGYITALTSELATLIRQSTAATTGPNAARPCERTISKEKRRARRTTPLQRALAEAKHELQIIQPDASRKSVRKAARRVKRISQAQQRHDLRRLFSTNERRCVEKILRDPPVGPSSTSSSLPATDDDRCTIDPADLFAYFQTQATAPTNFDFDDEGGELFRSVLDELPRADQEVHLLEDEITRDEIEDQLSRISKSTAPGLDGITNAVYVRFKLQLLDALQAAFNACWRYNRVPSMWKAAFVRLIYKKGNRAVPSNWRPICLQQTVYKLYTAILASRLQRWMDANARFTMSQKGFRAFNGCHEHNFVATCLHDQTRRLRKKLAIVWYDLRNAFGSLPHEYLWRVLARLGMPPQFVARVRQLYADASFTVESRDGTTDPVQLERGVYQGCPLSPYLFIAALIPLVRALHKLKDQHGIVLAPGVTDCVSAYADDIKIFARSGTGAKALHEIVVRFLSWTNMAANPAKCALMVTDGARGGDDTDASMTLSIEGETIPRLTGKEGYVYLGVEDGLAHERRATCLRDSLKAASADVVRLLRSDLAPWQIVRAIKSHVLSRFDYVLRHLRPFLSLFDGFDKMLVRGIKRLCQLPQTATSEFLFSPTSAGGLGFLPLKELFAALQIVHALQMLHSKDANVRAIARHQALQVVRKRYALQSDHWSDREEELLEEFFNGTLERSPFALAKKVSGDIASLWTDVRVNLTKYGLKFGEAHGRRLQPLVSHTDKQLAPQQWASAIKTHMRLRHLKRWTTLVDQGKTARMHERIGSAFLTRPSGVYDASYAFAVRARLNQVDTRSALKRKRIVNNSRCRVSGCSELETLAHVLNHCRFGSDSIRARHAETLLLIKTTMERELTRPGRQHQRLLVDATVPEARDPVPSNDAAESNIGAMAPSISHLRPDIQLYDNKTMEAVIIDLAVAFEDQSTDDAASSSSFARVKGVKTKKYEVIKQFLEYKGYTVHVAALVYGSLGSVDTGNFAVYTERLGLRKGAVRRLECSLSARHINFAHRMWRRHAIAHTTGLRLIGTNSVQQQGVQRAPAEKQQHQRPVQRPSRAQAPRDQPSQQQQSQQSFQQQSQQSQQSQQSQQSQQSRQRHAPTPTPVPVPVPVPVSTPTLTPTPTPTRRPKPAPSSTQPQQGAPAQRRQQREQKKQPACRRRHATAVRETPPAAPTAARTATPTARPTATTRSTSTTRSTATATSTTRSSAPTSRPSAPRPRSSAPRPRSSAPTTRSAAPTTRSAAPTAIATTSVYKSRRTTNAISGATTRRSASSKRAPMQPRTALTPTQQQQRQ

SEQ ID NO: 1446 - protein, 1983 aa, synthetic construct
  source 1..1983: note = Description of Artificial Sequence: Synthetic polypeptide
MPRSLASEPVHSSASRLPSQAPPTSRSGAAHTPPPSLQARPLASADAGLAATALASPQDPPYDVAPPGRAAGRLPDSVSPGATLSAATARALAVRHWPLELDSDSSDDEDAQDPHAAAPGPPADVASVLAPPGRAGSMLADPAALAAGLARAPPPPSAPQDPSPALPAGPAGQNPRAAAPARVEVHTVVAPPGRAGGMLPDPGLVDSSPAAATAATPAPVAATATTARVAVEHHAHAEPNQEHLPMARVLVEPMQVDECSSCDRSTLTADDGSGDDVAAPSSMLSNDVAAPMDVDSGTSCPPTLQQPLQRPRALHVGSKRRRLNADDGEEAHQLQEEEEAGIHAPALRLSAASAQPASVLAVYTHNASRFDCTLCAYTAGSFASLKTHRNSRHRRTAFLDRFSAGCACGVPFASRLAAARHAQACASLSSAPLAEASSAAGASSHTVDGADSTVSAAGHAEPDLPRHNATELTASPPLVSSTDVEVQATETEATENRWGTPLPRVLVASRIAGRLAQVPPPRWGPPLPRTTIAGRIATRLAATPAPRWSPPLPRSLVASRIAGRLLPALPDAPACEDEAKDSDEMDWEASEPHVEAPGPVDEETIDDADGEWLLRFDGACRANPGPGGAGAALFKPSGPVVWTCSHYDPSTTATNNTAEYTALLLGARAAADHGVTKLRVEGDSTLVIQQVRGIFATRSTRLRALRNKVKLELARVGSFSLHHIDRQANGHADRLANAGLDRRRTQLECSVHPDGRGCTNTSVATAAPTASAAPSTPTRPPATTAAPFHSDQGHIDEDDERRADIDDGEIYAPMTLGPDEVPARRPRLRLRQLSDEELEAAGAIVERLSASLSAKITDAEDWGTAEGYITALPHLLYDKLLPYSRTAPRHQRPPRPSRNQQDHPQPRRDQPQRNVDEQQHAESQQGEDQRQQQPPTRRRRRRGKRRGRRQRRHPRQPGQSTRASQQSRQRRPRPPRVTRHHREHRIDEALDELHTLERARPQDRSAIDKARRRVGRVRGAINQHLLRHRFDTDEKACVADILEKAHAARAARTAQAAGAATSTGGAATAPTQQAATSALGDADDGTCPILADELWQYFTGTNTPRWEFNPATPVGEAFRTAMARLPPATRLRELLTEAPTADEIETQLQHVRGSSSPGLDGIGYDVYQRFAQQLLPVLTASFKRCWTAKMVPQSWQVGVVRLLYKKGAHDDPANWRPICLQQAIYKLYTGVLARRLVRWLDVNDRHAPGQKGFRAVNGCGEHNFLAATLIDQARRKRRSLYEVWYDFRNAFGSVPFQLLWDSLQRLGAPADFIDMCKGLYHQAAFVIGNAADGPTAAIRQQVGVFQGCPLSPQLFNVAISPLLFALRRLPETGVQLSGDDRVGVSAYADDLKTFSSTKAGATKQHELVAAFLAWTGMKANAAKCSSMGVRRNSNGATEADNLDLALDGTPIPSMTHMQSYTYLGIGDGFDHVHRRIELAPKLKTLKQDTTALLESGLAPWQVVKAVKVYLYPRVEYALRHLRPEDQLLESFDLHLRAGLRHLLRLPKNANNDFFYSPVSRGGLGLLPLVELHAALQIAHGWQMLNSTDPATRRIAREQLHQIADARHRLDKAHWKERGDELCQLFLNLDLGTSAHAPPKRRNCDIGSLWVDVRKNLQAFGLKLETAPADAESGTPALPLQLRVPHHEKWLTHRDVLRHVKQHLKNKHWRAWCAFQDQGRTARAHGGVGSSFITRPRGMWESDYRFAVAARLNMVDTSATLARRRLRAHDRCRYPGCRWKESLEHVLNHCPGTMDAVRGRHDGVLREIEHALRAPSGARRELRVNQTVPGLPGPALRPDIQVYNHDQRTVAVVDLAVAFDRQDRDDPETSGLAKAAAEKKAKYTGIQRHLERQGWKVHLSALVYGSLGSVAPNNYKVYTEHLGLLKRDAKRLDRTLSVACIQSSRRIWNLHCAKHRARQHQTPSQSRGRRVTETGGAPSRTDRR

SEQ ID NO: 1447 - protein, 1493 aa, synthetic construct
  source 1..1493: note = Description of Artificial Sequence: Synthetic polypeptide
MQDQVDAEQQARNRWGPPLPRPLVASRVAARLGEVPPPRWGPPLPRGVVVSRIAARLEAVPVPRGGPPLPRSFVATRIADRLAPPSPDLSLLDEEMKESEPPDPTHHSADEDSTDAETADAVMEPAFVSDPPTATPREWRLQFDGACRGGPNPGGAGALLYNPEGAVVWTGSHYMPGAKETNNSAEYTALLIGARAAADHGARQLRIEGDSLLVIRQVKGLYATKSTRLRQLRNAVRHELARVGQHSLHHIDRQGNAFADRLANRALDLKSDKVECKEHPVAGACTTCMGSPSAGPPATPPPTTADIEMADAGSDDELRADIDDGEVYAPMRLEPGVIPTRRSRLRLRQLTDDEMEAAGEVVERLSAGLSAKIADADDWETAEGYITALPYMLYDKLQQYTQVRHGTARSPAPHPQRRDVQGQVETHREPRHETIGQPDQPGEPSPTRRRRRGKRKGRRQRRHPRRTNCGGGGRQQRKQRHPRPPRGTRHHREHRIDEAIDELHALERARPQARPAIAKARRRVGRIRSAIDQQLLRHRFDTAEKECVDGILAAARTARDARTTVRAAAATGTTATPETAVTSGTEQQDDNGTCPIPSEVLWRHFDSVNTPQRDFDPEAPEGAAFRSAMARLPAATRFMELLKEEPSTDGIEVQLQHASSTSSPGLDGVGYDVYKRFASQLLPVLKAAFKCCWTHKQVPQSWKLGVVRLLYKKGDREDPANWRPICLQQAIYKIYTGVLARRLTRWQDANDRHAPGQKGFRPVNGCGEHNFLAAMLIDHARRKHRPLYEVWYDFRNAFGSVPLGLLWDALERTGVPAEYIAAVQGLYDHAAFMVGNAVDGSTAPILQRVGVFQGCPLSPPLFSAAISPLLHALQLLPSSGVQLSGDDRPGVSAYADDLKTFSGTKAGVTEQHELVAMFLRWTGMAANPAKCRSMGVRRNGNGAIEADHLELALDDTPIPTLTHLQSYTYLGIGDGFDHVRRRVALAPKLKLLKQDATALMESGLAPWQVVKAVKGYLYPRVEYALRHLRPDDQLLESFDLHLRRGLRHLLRLPKSANNDFVYAPVSRGGLGFLPLVELHAALQIAHGWQMINSPDPAIRRIAREQLHQVADARHRLDKDHWKQRGDELCELLLNGELGTSAHAPPKRRNGDIGSLWVDVRKNLKAFGLKLATAPADPESGAPAKPLQLCVPHHAEWLDHRNVLRHVKQHMKNKRWRAWCSHVDQGRTARAHGGVGSGFLTRPRGMWESDYRFAVAARLNMLDTVNVLARRRLRAHDRCRHPGCRWKETLAHVLNHCPGTMDSIRGRHDDALKEIERTLHASSGDRQGRTELRTNQTVPGLAGPALRPDLQVYNHDQRTVAVVDLAIAFDEQPRDDPESSGLAKAAAEKKAKYAGIKRHLERQGWKVHLSALVYGSLGSVAPSNYKVYTEHLGLLKRDAKRLDRQLSVACIQSSRRIWNLHCAQHRARQHQDQPAPRGRRVTETGGTPSRTDRR

SEQ ID NO: 1448 - protein, 1716 aa, synthetic construct
  source 1..1716: note = Description of Artificial Sequence: Synthetic polypeptide
MLADPAALAAGLARAPPPPSAPQDPSPAFPAGPAGQNPRAAAPARVEVHTVVAPPGRAGGMLPDPGLVEEPIQATYAHDAAQFECALCPYVAESMAVLVQHRRSAHRGTRFKDIFTSGCQCSLVFYARIVAASHAVACARRNQRAVPPAPTPVAPTRPEATPQPTGYLAAAMTAAAAAASSDTVVAAATNMQSAVPAAAKTTGLQLVPPELEPALPQRASCHAGKRRRLNADEAVTPCTPTARVSPQTEVAMAPHDAPQDDTVLQREAAEPQPDPAATQGAQVQRVEDTTAAQDDTVQQDHDADTAQVSPPRRTPTRWGPRPSSTQEPSPMTGEPAATLAARRPLTPAATGTRATRWGPCHRAIGAAAIARLVTGLPTEPAQPQRRQPPPPQEPPLQPEPQAAAATVAADIAATVAADIAAAAANAAMDVDGGPAADETWLLRFDGACRRNPGPGGAGAALFAPSGAVVWTCSHFMPSRSETNNTAEYTALLLGAQSAVHHGAKRLNIEGDSHLILSQVRGAFACNNKRLRSLRNRVQASLRQLDWYRLQHIDRKANQHADRLANRALDLRRTVTECGPHAETRNRCFQTPQPLVEPGETHCVPGSDEVLAANTAMEDATAVPTEDDEAEVAARDGGEVFPTIAIGPDSAPAKQPRLRLKKLDEDDFDAAAAAVTRVSEELASKIVDAGDWTSGEGYISAIPERLRAALRPFALPTQPARPQPREPRMQQPPRRPPRVTRDHLEHRLDEALDTMENVQRSTPQNQKAVRRARRRVGRLRSAMDRTRLRKKFATHERECVAEILRRASTEEAANPSQEKCPIDRATLHEYFTATSTQRTPFDYDSAKGTEFRTFLEVMSTPSHETSALTAEPTLDEIEDQLAHVKAGSSPGHDGVGYDVYRRFQVQLLPLLHAAFRFCWRHRRVPALWKVGFVRLLHKKGDPQQPNNWRPICLQTAIYKLYSGLLARRLSKFLEANELLPMAQKGFRAFNGCHEHNFVATTLLDQTRRMHRRLYQVWYDLRNAFGSLPQQLMWGVLRQLGVTEEFVARCSGIYEDSYFVVGNASDGATEPVRQEVGVYQGCPLSPLLFITALVPLLRALENQDGVGVPLADGVRPCATAYADDIKVFCDSATGIQRCHALVTRFLEWTGLQANPAKCAFLPVTRSQHSNPTRDRDIELRIHGEAIATLGLQESYRYLGVGDGFDHVRHRLQLEPKLKQIKREAVALLHSELVPWQILKALKVYIYPKVEYALRHLRPLKSQLQGFDSAIVRGLRHLLRLPENSHDGLFFSPTSAGGLGLLSLVELHEALQVAHAWQMLHSKDPAIRAIARTQVGQVARKRFKLVEEHWRGREDDLAQRFLNTELAASPHATETRRNGDIGSLWNDVRDTLQTLGLKFAAGDEEEAPGLLQLRVPHHTKWLSHSTVLRHVKLHMKLRRMDTWKSKVSQGTTVREHGGVGSRFITAGAGLSDAEYRFAIAPRAHLIDTNSTLKRRRLRANDTCRAPGCSYTEPPAHILNKCSPNMDAIRKRHDDALERIADALRRKVEKSGGRLEVAINKTVPEYDGAALRPDIVLRNTETKRAIIADLAITHENQPTDATTSSALQQSRDNKITKYQTVAAAMMRAGWRVRVTGIVYGSLGSVLPSNFKVYTELLALLKRDARRLNRQLSSHCIRASARIWSAHCRRHRERQRSGNASRASRGSGGAPRRTSQASARR

SEQ ID NO: 1449 - protein, 1546 aa, synthetic construct
  source 1..1546: note = Description of Artificial Sequence: Synthetic polypeptide
MSGDVVSSDGSSRTTDASGDGDDGAGSSDAAGDVGVVAMDVDQGARRQQPPWQRVGGKRRRLNDVDDEDTRELAELLLEEEDEAGDHAPAPRLSAASARPASVLSVYAHNAQRFQCTLCTYTAASFASLKRHRDSRHRRTAFLDRFSAGCACGVPFASRLAAANHAHACDSLNRTFSVAAAPAAGELSPTAGAANATVKAATVTPDSPRQDPPKLAATPPLASSALVVDPDHAEQQARERWGPPLPRTLVAGRVAARLSEVPAPRWGPPLPRGVVAFRIGHRVLPPEMTSDEETKDDSSVQDGDRQDYPVAAMDVDSGMSGEWLLRFDGACRANPGPGGAGAALSQPDGSVVWTCSHYMPSSSETNNTAEYTALLLGTRAAADHGTTTLRVEGDSTLVIQQVRGIFATRSVTLRHLRDQVKLELARVGRFSLHHIDRQANAHADRLANRALDLRRTVSECGVHPDGNGCTPTAIDDRPLAPTQQPPDAPPPPPAADIEMEDPDDEDLADIDDGEVYAAMRVGPNATPQRRRRGRSGTAKKHRRQRPPRVTRHHREHRLDEALDDLHAVERSTPSDRTTVRRARRRVGRVNSAIEQQRLRHRFDTDEKACVTDILAKACATREAARTTASGGDPPAGPATPAAGSADDGTCPILGEELWRFFDSVNTPRQEFAPDAPVGAAFRSALARLPAATSCKELLTAAPSAGEVEDQLQHVRGASSPGLDGVGYDVYQHFAAQLLPALTAAFKACWTAKRVPQSWKLGVVRLLHKKGAREDPANWRPICLQQAIYKLYTGLLARRLVRWLDANDRHAPGQKGFRAVNGCGEHNFLAATLVDQARRKRRTLFEVWYDFRNAFGSVPFALLWDALARLGVPDDYVTMCKGLYESAAFVVGNAIDGTTDPIALRVGVFQGCPLSPQLFNAAISPLLFALQRLPATGVQLSGDDCPGASAYADDLKIFSGTEDGIKRQHALVADFLRWTGMAANPNKCCTMSVQRDGRGVLKTDDLQLDLAGTPIPALSMSASYTYLGIGDGFDHVRRRVELAPALKQLKDDATTLLQSGLAPWQVVKAVKTYLYPRVEYALRHLRPFQQQLEGFDRHLARGLRHLLRLPGNATAECFYAPVSRGGLGLLPLTELHAALQVAHGWQLLNSKDPAIRRIARVQLRQIADARHRIDSRAWEGRDEELCELLLNSQLGTSPDAPPKRRNGDIGSLWVDVQRHLRTLGLKFATAPACADAGSAATTLQLRVPHHDKWLDHRTVLRHVKLHVKHRHWSKWAAMRDQGKTARAHGGAGSGFLTRPRGMWEADYRFAVAARLNQLDTHSVLKRRRLRAHDHCRQPGCSRAETLAHVLNHCAGTMDAVRGRHDDALKHIERALHASSPGGQDRVELRVNQTVPSLAGPALRPDLQLYNHTKKMVAVVDLAVAFEEQASDDPESSALARIAAHKRAKYAGVKRHLERQGWKVHLSALVYGSLGAVPAGNHKVLTEHLGLLKRDAKRLDRQLSVACIQSSRRIWNLHCSQHRARQHQAPGGSRAAETGGTPPRTGRR

SEQ ID NO: 1450 - protein, 1392 aa, synthetic construct
  source 1..1392: note = Description of Artificial Sequence: Synthetic polypeptide
MARVLVEPMQVDECSSCDRSTLTADDGSGDDVAAPSSLNSNDVAAPMDVDSGTDCPPALQQPPQRPRALHVGSKRRRLDADDEEEARQLQEEEEAGIHAPALRLSAASAQPASVLAVYTHNASRFDCTLYAYTAGSFASLKTHRNSRHRRTAFLDRFSAGCACGVPFASRLAAARHAQACASLSSAPLAEASSAAGASSHTVDEADSTVSAAGHTEPDLPRHNATELTASPPLVSSPDVEVQAPETEATENRWGTPLPRVLVASRIAGRLAQVPPPRWGPPLPRTTIAGRIATRLAATPAPRWDPPLPRSLVVSRIAARLLPALPDAPACEEEAKDSDTMDWAPTWTNEETKDSEPHDEAPGQVDEETIDDADGEWLLRFDGACRANPGPGGAGAALFKPSGPVVWTCSHYDPSTTATNNTAEYTALLLGARAAADHGVTKLRVEGDSTLVIQQVRGIFATRSTRLRALRNKVKLELARVGSFSLHHIDRQANGHADRLANAGLDRRRTKLECSVHPDGRGCTNTSVATAAPTAPAAPLPPARPPATTAAPSHDDDHSVQGDIDDGEVYAAMCIGPDAVPHRRPRLRLRHLTDEESEEAGDVVERLAASLAAKIADAPDWETAEGYITALPYALYDKLQPYSQAQPQPPSQQQQQQQQRPRQQQQTRQRRQRRGKRGGGSQRRQRKTRRRRPPRVTRHHREHRIDEALDDLHAIESRRPQDRTAISKARRRVGRIRSALDQHQLRHRFDTDEKVCVDAILAGARASQGATTAPPSATTDPPAPMDDSRCPIPGDDLWRFFDSVNTPRRSFDAEAPDGAAFREAMACLPAATRAQELLTEAPTVDEVEDQIQHARASSSPGLDGVGYDIYKQFAAHLLPALHTAFVCCWNHKRVPQSWKLGVVRLLHKKGDRQDPANWRPICLQQTIYKLYAGILSRRFVRWLDANARHAEAQKGFRAMNGCGEHNFLAATLVDHARRKRKELHVVWYDLANAFGSVPHDLLWETLARQGVPPTFVDCCRGIYSDAAFTIGNAADGTTAPIRLRVGVFQGCPLSPHLFTAAIAPLLHALKRLPVTGVQLTGVDRPGAAAYADDLKTFSSSVDGIKRQHELVATFLRWTGMAANLSKCSAMSVQRDSRGVLKTGDLCLKLNDAEIPALSMTASYAYLGIGDGFDHVRRRLELAPMMKQLKHDATALMQSGLASWQVVKAVKVYLYPRIEYALRHLRPFKQQLEAFDEHLRRGLRHLLRLPTNATSAFFSAPTSRGGLGLLPLTELHAALQIAHGWQILNSPDGATQRIAREQLREIPDARHRLDTAHWRNRDAELCELLLNSQLGQSSHAPPKRRNCDIGSLWIDIRRQLGTLGLKFETAPGRRSHQPARPAIAAFACRTTTSG

SEQ ID NO: 1451 - protein, 1606 aa, synthetic construct
  source 1..1606: note = Description of Artificial Sequence: Synthetic polypeptide
MSGDVVSSDGSSRTTDVSGDGDDGADGAGSSDAAGDVGVVAMDVDQGARRQRPPWQRVGGKRRRLNDVDDEDTRELAELLLEEEDEVGAQAPALRLFAASAHPASVLSVYAHNAQRFVCTLCAYTAASFASLKRHRDSRHRRVSFVDKFSAGCACGTPFGSRLAAARHAQACASLSIPRTVTAPAAAGDLSPTATGANATASAAATSPDLPRPASPELAASPPQTSPFDVAIQADAAEQTAWTRWDPPLTRAAVAARVASRLAVVPAPRWGPPLSRTLVASRIAARLDAQTSRWGPPLPPAMVASRIASRLAAMPAPRWGPPLLRTVIASRIADRLLPPELAADEETKDDDVHMDNAASVDVDEESEVADVVMTDHDGEWLLRFDGACRANPGPGGAGAALFKPSGPVVWACSRYMPSSSATNNTAEYTALLLGARAAADHGATHLRVEGDSTLVIQQVRGIFAARSTRMRALRNQVQSELARVGSFSLHHIDRQDNAHADRLANRALDLRRTVIECGIHCDGVGCTATTTEVQSSSAPEIPTRPVADDHDEHEVVDVVDVCGVCGVCGDRGTCGVCDVSGDIDDGEVYAAMRTGPDAVPARRPRLRLRKLTDEEQEEAGTLAERLGATLAAKIADARDWESAEGYITALPYLLYDKLLPYSQGPARSLPVRQHQRQQQQPDGQFQRPTQSRSAARRQRRQRHRARRRPPRVTRHHREHRLDEALDDLHAVERATPSDRRSIRRARRRVGRVNSAVEQQRLRHHFDTNEKGCVEILLAKARAQRSTTVARTAVGEPNSGAAEDDGTCPIPSERLHRHFTEVNTPGSSFDAMAPVGAPFRAALAHLPAATEASELLTEAPTPDEIEDQLQRAKGTTSPGLDGVGYDVYKAFSTQLLPVLHAAFQCCWQHHRVPQSRKQGIVRLLYKKGPREDPANWRPICLQQVIYKTYAGVLARRFTRWLAANGRHADAQKGFRTVNGCGEHNFLASTLIDHARRSRRELHMVWYDLKNAFGSVPQELLWEVLQRMGVPPAFVEVCQGLYQDAAFTVGNAADGPTDLVRQLVGVFQGCPLSPHLFTAAISPLLHALDRLKDTGVRLSADDRPGASAYADDLKIFSGTADGVKRQHALVADFLRWTGMVANPNKCCTMSVQRDGRGVLKACDLELQLDGARIPSLIMNASYAYLGTGDGFDHVRRRIELVPALMQLKDDATALLQSGLAPCQVVKAVKTYLFPRVEYALRHLRPFQQQLEGFNRHLVCGLRHLLRLPVSATTSFFFVPVSRGGLGLLPLTELHAAPADRRPAPPPRPRPLEGAGGENMRAADQLAARDVGPRPTQAPQRRHRLVVGRRPAPPPRTRPQARDRAGVRGDRHRGGDAAASRAAPREVAGPPHGPAAGEAAHEEQALAAVGRDEGPRQDRPHPWWCRERLPHAASRPMGDRLPLCSGGSAQPAGHAQRAEAPAPPRARPVSTAGLLPCRDTGTRAESLRRHHGRGPRPPRRCAQDHRARAHRVVRAARTAPSSGSTRPCPRSPAPRCGPTSSSSTTPRRRWRWSTWPWRSRSRRATTPRALRWRASPRTSEPSTPASSGTSSAKGGRSTSRRSCTARWAR

SEQ ID NO: 1452 - protein, 1540 aa, synthetic construct
  source 1..1540: note = Description of Artificial Sequence: Synthetic polypeptide
MATSSSSVSSGNVQTEVRCVYHGKGDLLLECPVAHCPSIHPTVATITKHLKKHHTPQFEQITTKNLTITYTCSQCSFSTTGLTQHHISKHYKTCKGVGAVQEGNKGRFCCPACGTRWALLCKARHHFNNVHFEYDTPPIAAFSGTPYKLKKRKFTIINKALTYSCPLPLNQLLCPLWSCSLTILNKPLSSVQQETAHGDGSQGQSYVPTQLRQVLRARCHCGNPPIGKGHWASCQGKRPLSSPKGGRSSPTPPANLTLHFLNYLPFQLPSQSSSPQSSTLDPTACKARVPIPSFLRGDCEVTFFIIPSVNFYRPYLSYPLRMFWRNRTSSGHCSLHRVVRGFVRERLVPHPRSKSPARTPLEFLCEFRLAGVFPDPGKVASLRPVPAPLTLCLSPPVAGPMISCEDHSAPPSVRSSSPIPNSPASVSSVEAHLSDLLDKVSSGELRPLSPTLPSSGFFGPLLPPTPPPRPTPSAEKASPSGLSYLPCREVKIASIARPSPASQRVGCDADRTGPSLNPNYQQTSPPSTPSFSPIVRPPKFPRSGAKVNSKSKPPGVRPRRAKPIEPGTESASPVDVDTISSSVQEPCTPENRTPEFFYERKWLVSILNIHEREGSNFFQFNRDLEYWTQLLSGSQKGGRAKRASYNRGAANQAMKNRDSGRKDFDPRPVAGHSSGGGTELGSRPRYPKGARLRADFWRDMKGTVRKLLDGSNGERRCGIPLDIIERKFRQVSMPGWIDHRRYAAGASPSLVTQAETDVAITSEEVEAVLSGLNVQSAPGSDGLSYRFWKGLDPSGRLLSCLFEIVRRHGRIPGAWPTCSVILLCKDAQGDVQDVGNWRPITICRTLYKLYAAVIARRIQTWAKQGGVLSRLQKGFMPVEGVFEHVFMLDTVLSDAKLRRKNLLAVFLDVRNAFGSVRHECLLKVLRHFDAPHYLVELVRDIYTGATCRVRSSVGETGDIPCDRGVRQGYPLSGILFNLVTEVLIPGLSAGNDGYRMACLGGKLTQVLAYADDLVVVTENRDQMLRQLGVCEEFGRWAGLAFNQRKCGLIGWRTLRGGRRVALEDPLLLNGVEIPLLRPGEHYKYLGAMTGVMSVPRTGSQLIKDFRARLQRLFTSFLTPHQKLIALKRFLLPSLSFHLRVRPIARSELIALDRRVRECLRVAFRLTKPSCQAVFHTPTDMDGLGVPSVCSESSILTIAQGFKVLTSPDGTVSATASARVKLYAAKFGGLTEAGPSDWARYLSGDDVNGNSTRKPGANLPSGLWTRVRCASRQLGAVWRVCPENGITVRVRNSVITSRDRRKLIRSFHDCSNQQWKEQWMQHPNQEKTAAAHMAYADANRWVKQPSVMEPHTYFFALRARLNLLPTRVSRAIYSRDQHPDILCRRCGASVESLPHVLNHCPPNMSIILGRHNLVLQEVLNAVDKTQFKEISVDRTVPEHMSETGEALRPDIVARRNDGSVVVVDVACPFDQKANFDEAAKRKLLKYDKLCCNIAASTGKPVECHSIVVGSLGSLAEGLSTSLRALGITDFARSKLVACHQG

SEQ ID NO: 1453 - protein, 1144 aa, synthetic construct
  source 1..1144: note = Description of Artificial Sequence: Synthetic polypeptide
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLCQHISTILTRRTAEAVKRRLLHLQWSRSPTAITTSSNNHTITDIPNTEARYIFPVDLDEHPPLSDATTPNASTHPLPELLVILTPLPSPTRLQNISESQTSHESNKNSMHTPPTYACDPDETLGATPSSTIPSCFHSYQDPLAEQRGKLLRASASLLQSSCTRIRSSSLLAFLQNESTLMDEEHVSTFLNSHAEFVFPRTWTPSRPKHPSHAPANVSRKKRRKIEYAHIQRLFHHRPKDASNTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHTGASFALLDISRAFDTVSHDSIIRAAKRYGAPELLCRYLNNYYRRSTSCVNRTELHPTCGVKQGDPLSPLLFIMVLDEVLEGLDPMTHLTVDGESLNYIAYADDLVVFAPNAELLQRKLDRISILLHEAGWSVNPEKSRTLDLISGGHSKITALSQTEFTIAGMRIPPLSAADTFDYLGIKFNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVVLTFRGILDRASSQSLRRLCFSSRDLGDLCLSAIQGSIKIYNTYMRGT

SEQ ID NO: 1454 - protein, 1132 aa, synthetic construct
  source 1..1132: note = Description of Artificial Sequence: Synthetic polypeptide
  VARIANT 46: note = Any amino acid
  VARIANT 59: note = Any amino acid
  VARIANT 89: note = Any amino acid
  VARIANT 172: note = Any amino acid
  VARIANT 204: note = Any amino acid
  VARIANT 205: note = Any amino acid
  VARIANT 217: note = Any amino acid
IAKFDNNTNSASDAAPLSPGGAVADLSASEGTTDNDQAMSPAMSLXTVPLVGNRVACPXCEKREANLFFLNLSDLDRHLTQHHPDAPIXWSCIDCAKCFPKLHGARCHIPKCGGASSQARTGEFQCEACPMSFGSRRGLSTHERHAHPAVRNIKRRGADPPEENTKSWKVEXVARLKGLWEIFKDHKYPNKEISKFLTTKTVDXXKYQRKKLNLIGXESPQEATSLATEGGCDLVSSGNASFGSPVGRNENEEELIHEWKLSLKNEINKPTEVPPILKEVYNRLMLIWEEHQDDRDSLTESLDHFIRTALYELINKINKNQTDLKTKRAAKTKSPKNNRNSRKRFSYARCQELFHECPRRLADAVVNNDQAYLEPARQPPGSEEVRGLYEKLWGQVGSTYVPAPVTRVPKLSLSEIFPPIAAEDVGERIGKIRKKAAAGPDGLQRDHLTIPGLPIIMAKIYNILVYCSYFPSAWKENRTTLIPKINKPCSLVENWRPITISPILGRIFSSIIDGRIRRGTVLNMRQKGFTSENGCKINIELLNSALNYSKRNSGGIFTIVDISKVFDTVPHAALKPCLAKKGVPALIVDLIDEMYKNVKTTIKTKDGGVEIMIRRGVKQGDPLSPLLFNLCLEPLLEEIEEQASGINVSEHRKVSVLAFADDIVLLGADAREAQHQINVLTDYLQSLMMNLSIEKCQTFEVVAKKDTWFIKEPGLKIGNQIMPTVDPDEAFKYLGAKIGPWKGVHCGVIVPELLSVVKRVRKLSLKPGQKVELLTKYIFPRYIYHLLVSPPSDTVLKLLDSEVRQEVKTILHLVPSTATGFFYTPKACGGIGIPRFEHIIKLGTLKSAIKIANSIDPAVAGLIDDAAIKKLKQTANSLRINWPASLEDIEKARKRLRKEHISQWADLKCQGQGVPDFIKNKTGNLWLEDHSLLKPSRLIDALRLRTNTFGTRSVLARADKNIDVTCRRCRAQPETLGHILGLCQHTKGLRIKRHDEVKSLLEGRLKSKKNNEVFVEPTIKAGGSLFKPDLVIKNGERVLVVDVTVRYENKNYLALAEKEKIEKYRPCLRALKEIFNAKGGEILPVVLGSRGTITPNTEKVLKRLGIANNDIKTILLNVLRSSIELCNIFIDD

SEQ ID NO: 1455 - protein, 1186 aa, synthetic construct
  source 1..1186: note = Description of Artificial Sequence: Synthetic polypeptide
  VARIANT 16: note = Any amino acid
  VARIANT 18: note = Any amino acid
  VARIANT 27: note = Any amino acid
  VARIANT 33: note = Any amino acid
  VARIANT 49: note = Any amino acid
  VARIANT 50: note = Any amino acid
  VARIANT 51: note = Any amino acid
  VARIANT 63: note = Any amino acid
  VARIANT 66: note = Any amino acid
  VARIANT 88: note = Any amino acid
  VARIANT 90: note = Any amino acid
  VARIANT 95: note = Any amino acid
  VARIANT 96: note = Any amino acid
  VARIANT 120: note = Any amino acid
  VARIANT 122: note = Any amino acid
  VARIANT 128: note = Any amino acid
  VARIANT 133: note = Any amino acid
  VARIANT 155: note = Any amino acid
  VARIANT 168: note = Any amino acid
  VARIANT 173: note = Any amino acid
  VARIANT 182: note = Any amino acid
  VARIANT 184: note = Any amino acid
  VARIANT 186: note = Any amino acid
  VARIANT 192: note = Any amino acid
  VARIANT 195: note = Any amino acid
  VARIANT 203: note = Any amino acid
  VARIANT 204: note = Any amino acid
  VARIANT 218: note = Any amino acid
  VARIANT 237: note = Any amino acid
  VARIANT 260: note = Any amino acid
  VARIANT 271: note = Any amino acid
  VARIANT 280: note = Any amino acid
  VARIANT 285: note = Any amino acid
  VARIANT 311: note = Any amino acid
  VARIANT 347: note = Any amino acid
  VARIANT 353: note = Any amino acid
  VARIANT 357: note = Any amino acid
  VARIANT 365: note = Any amino acid
  VARIANT 367: note = Any amino acid
  VARIANT 369: note = Any amino acid
  VARIANT 386: note = Any amino acid
  VARIANT 387: note = Any amino acid
  VARIANT 401: note = Any amino acid
  VARIANT 410: note = Any amino acid
  VARIANT 413: note = Any amino acid
  VARIANT 414: note = Any amino acid
  VARIANT 445: note = Any amino acid
  VARIANT 457: note = Any amino acid
  VARIANT 459: note = Any amino acid
  VARIANT 483: note = Any amino acid
  VARIANT 490: note = Any amino acid
  VARIANT 505: note = Any amino acid
  VARIANT 516: note = Any amino acid
  VARIANT 523: note = Any amino acid
  VARIANT 528: note = Any amino acid
  VARIANT 533: note = Any amino acid
  VARIANT 545: note = Any amino acid
  VARIANT 556: note = Any amino acid
  VARIANT 599: note = Any amino acid
  VARIANT 621: note = Any amino acid
  VARIANT 647: note = Any amino acid
  VARIANT 650: note = Any amino acid
  VARIANT 664: note = Any amino acid
  VARIANT 691: note = Any amino acid
  VARIANT 694: note = Any amino acid
  VARIANT 701: note = Any amino acid
  VARIANT 716: note = Any amino acid
  VARIANT 719: note = Any amino acid
  VARIANT 720: note = Any amino acid
  VARIANT 724: note = Any amino acid
  VARIANT 736: note = Any amino acid
  VARIANT 743: note = Any amino acid
  VARIANT 752: note = Any amino acid
  VARIANT 762: note = Any amino acid
  VARIANT 773: note = Any amino acid
  VARIANT 775: note = Any amino acid
  VARIANT 782: note = Any amino acid
  VARIANT 785: note = Any amino acid
  VARIANT 789: note = Any amino acid
  VARIANT 804: note = Any amino acid
  VARIANT 817: note = Any amino acid
  VARIANT 820: note = Any amino acid
  VARIANT 836: note = Any amino acid
  VARIANT 837: note = Any amino acid
  VARIANT 841: note = Any amino acid
  VARIANT 873: note = Any amino acid
  VARIANT 876: note = Any amino acid
  VARIANT 880: note = Any amino acid
  VARIANT 890: note = Any amino acid
  VARIANT 895: note = Any amino acid
  VARIANT 896: note = Any amino acid
VPPGAEARGRYHHPRXEXARQGEPPSXRVFLVXLPDSNPPCPICGDHVXXXSVLALHCVEGHXWAXVQYQCTHCGILCHIPRCQGRVXEXTGKDXXCPECPASFDEKAGLSQHKRHTVTXSXERVAGXLLRAXLRHGCWSVEEEETLTRLDAMFXGARNINQLIAAEXVSKMXKQISDKWRXLXLXPEQTTXGGXAESASVVXXESMTPEMEAQSPAXPPGKIRKIFTGQDGHAGGXAWENQEDFHWTRWARRWLKRGQXLSDKVQEVLGXWVEGQPRIXAWVDXVSLDVLTLFLGVPPGPQRAPSKKGPXEGGKPTSWMNKRAIKWGTFLRYQHLFGANRKLLAAXILDGAXRNQXTLLLEEVXQXYXGKWEAEPPFEGLGRFGXXRDVDSFAFEALITXEEAVKHMMXMAXXSAPGPDKLTLRDLRRADPEGDALAELFSLWXITGVVPDRLKEXQXVLIPKAVDFEKLRQLGNWRPITIXSIVLQLXSRVLTARLTAACPIXPHQQGFISAPXCAENLKXPELIXRKVKXDRRPLGVAFVDXARAFDSVSHDXISWVLKAKGVDQHIVNLIEDSYQKVTMRVQVFSGSTPPISIKXGVKQGDPMSPLLFNIAMDPLIXKLKTVRQGVKVGSASLTTLAFADGLXLLXDSWEGMQHNITTSXTPGRACNTTSRHPRGLLQPHGPTSATXKMXGVLLESXMRLLYGEQLRGLEDXRPXXHDAXARRADTISGLEXRSLGWDXQTRFGYATXLLAREDGDCXAQTNAEALCWXSXPFPGCAXRPXYANXGWVASEALDSMSRRXVKEWFHLPACTDXLLXSRHRDGGLGLLRLARXXLAAXVRRPIRVATSSDEVTRKVSYACGISDEVERLXLAXGGDXSNVPRFEDPXAPKSXXVQGPHEAAQETPRVVRTQAIPWPSNWRAEEHSKWAQLSCQGERVELFCNDPVSNGWINSRGQLAERLWIMALKLRSNIYPTREFLGRGQAGTNIGCRHCTHPRETLGHILGICPAMQEARILRHNKLCKILAAEGKNCEWTVYYEPHLHNAAGELRKPDLIFVRDGTALVVDITVWYEGGPATLLSTTAEKATKYLDLNTQIQELTGAEQVTYFGFPIGARGKWHADNWRVLSELGLSNSRKERVTRLLSWRALLGSVDMVNIFVSKHRQENLLDEHCTPAEQVVSSYAS

SEQ ID NO: 1456 - protein, 1055 aa, synthetic construct
  source 1..1055: note = Description of Artificial Sequence: Synthetic polypeptide
FERRSNSWGYRPLEPRSVGTESNNNSPRSNITITSATSRPGDQPREAIAVVNLAGEIPCAVCGRLFNTRRGLGVHMSHQHKDELDTQRQREDVKLRWSEEEAWMMARKEVELEASGNLRFPNKKLAEVFTHRSSEAIKCFRKRGEYKAKLEQIRGQSTPTPEALDSITSQPRPSLLERNHQVSSSEAQPINPSEEQSNWEIMRILQGYRPVECSPRWRAQVLQTIVDRAQAVGKETTLQCLSNYLLEVFPLPNEPHTIGRSNLRRPRTRRQLRQQEYAQVQRRWDKNTGRCIKSLLDGTDESVMPNQEIMEPYWKQVMTNPSTCSCDNTRFRMEHSLETVWSAITPRDLRENKLKLSSAPGPDGITPRTARSVPLGIMLRIMNLILWCGKIPFSTRLARTIFIPKTVTANRPQDFRPITVPSVLVRQLNAVLASRLASKVNWDPRQRGFLPTDGCADNATLVDLILREHHKRWKSCYLATVDVSKAFDSVSHQAIIKTLQAYGAPTNFVSFIEEQYKGGGTSLNGAGWSSEVFIPARGVKQGDPLSPLLFNLIIDRLLRSYPREIGAKVGNTMTSAAAFADDLVLFAETPMGLQTLLDTTVGFLASVGLSLNADKCFTVSIKGQAKQKCTVVERRSFCVGERECPSLKRTEEWKYLGIRFTADGRARYSPADDLGPKLLRLTRAPLKPQQKLFALRTVLIPQLYHQLTLGSVMIGVLRKCDRLVRQFVRRWLDLPLDVPVAYFHAPHTCGGLGIPSIRWIAPMLRLKRLSNIKWPHLEQSEVASSFIDDELQRARDRLKAENVQLCSRPEIDSYFANRLYMSVDGCGLREAGHYGPQHGWVSQPTRLLTGKEYLHGVKLRINALPSKSRTTRGRHELERRCRAGCDAPETTNHILQKCYRTHGRRVARHNSVVNAVKRGLERKGCVVHVEPSLQCDSGLNKPDLVGIRQNHIYVIDVQVVTDGHSLDQAHQRKVERYDRADIRSQMRRFFGATGEIEFHSVTLNWRGIWSGQSVKRLIAKDLLIAEDTKLISVRAVNGGVTSFKYFMYCAGYTRS

SEQ ID NO: 1457 - protein, 1222 aa, synthetic construct
  source 1..1222: note = Description of Artificial Sequence: Synthetic polypeptide
  VARIANT 1109: note = Any amino acid
  VARIANT 1124: note = Any amino acid
  VARIANT 1139: note = Any amino acid
  VARIANT 1170: note = Any amino acid
  VARIANT 1191: note = Any amino acid
  VARIANT 1217: note = Any amino acid
PAAPRAWGAVEAGPWPGRTRAVEPAPSPESSPSEAARAAPAGEGHGPGHESPSVQRPEADTTAPGVSAPTREGEPPSTRVFLVRLPDSNPPCPICRDHVGKPSALALHCVESHAWADVQYQCTHCKKVSANKHSILCHIPCCQGRVPEWTGKDWACPECPASFNKKVGLSQHKRHVHPVTRNVERVAGSLSRAGLRPQTRRGCWSVEEEETLTCLDAMFRGARNINQLIAAEMVTKMPKQISDKRRQLGLCPEQTTLGGDAESTSVVEEESMTPEMETQSPINPPGKIRKILAQRARRWLKKGQGLSDKVREVLGAWVEGQPRIHAWVDSVSLDVLTLFLGVPSGPQRAPNKKRPKEGGKPTSWMNKCAVKWGTFLRYQHLFGANRKLLVAIVLDGADRNQCTLLLEEVFQAYREKWGLEEVLRAYRGKWEVESSFEGLGRFGVRRDADNFAFKALITPEEVVKHMMAMASKSAPGPDKLTLRDLRRADPEGDALAELFSLWLITGTVPDGLKECRSVLIPKTVDREKLGQLGNWRPITIGSIVLRLFSRVLTARLAAACPINPRQRGFIAAPGCAENLKVLELLLRKRKRDRQPLGVVFVDLARAFDSVSHDHISWVLKAKGVDEHIVNLIEDSYQKVTTRVQVFNGVTPPISIKTGVKQGDPMSPLLFNIAMDPLIAKLETDGQGVKVGSASLTTLAFADDLVLLSDSWEGMLKNISILEDFCNLTGLRVQPKKCQGFFLNPTCDSFTVNNCEAWKIAGREITMLGPGESTRYLGLNVGPWVGIDKPDLGTQLSSWLERIGTAPLKPMQKLSLLVQYAIPRLNYQADYAGIGRVALEALDSMNRRKVKEWFHLPACTSDGLLHSRHRDGGLGLPRLAKAIPEAQVRRLIRVATSSDEVTRKVSYACGISDEVERLWLARGGDMSSVPRFEDPEAPRSPGVQGPCEAAQEIPSVVRKLAIPRPSNWRSKKHSKWAQLSCQGEGMELFCNDPVSNGWNNSRGQLAEHLQIVALKLRSNIYPTREFLGRSQASTNVGCRHCTHPHETLGHILGICPAVQEARIIRHNKLCKILAAEGKKCEWTVYYELQLLNAAGELCKPDLIFVRDGTXLVVNVTVGYEGGPAXLLSTAAEKATKYLDXNAQIQELTGAEQVTYFGFPIGARGKWHADNXRVLSELGLSNSRKERVARLLXWRALLGSVDMVNIFASKHRQENLSDXALSPS

SEQ ID NO: 1458 - protein, 1247 aa, synthetic construct
  source 1..1247: note = Description of Artificial Sequence: Synthetic polypeptide
MQCTSRLADAPRFARVGVEGEGVGASGNGTDAQLWYGCTGCDEAFSSLRGLRIHAAQKKHGNQDGLLRLPAGRPRKRRVGKSTTAGASDRVTTDPVPAPVPESPGLLPGLPGPSLPGCSDLPPGVLPGGWSASPGPLSWPPSLDAGPLPGPSRVSPGPSRPSPGKPTGPPSLDAGPLPGPSRVSPGPSRPSPGKPPGTPEPLPGSPGGRRGVSPGQPGSRTDPSSSAGAGHFVCPQCSRAFSSKIGMSQHQKHAHLEEYNAGINITRTKARWDPEETYLLARLEATLNPDHKNINQTLHAALPRGSCRTLESIKAHRKQAAYRDLVTSLRSARESSEAQHVPDRPLETPEPQTPANPQRDSKQAVIEALQSLIGRAPPGSFQGARLWDIARQATRGTNILPLLNSYLRDVFTLPTKPTRKKPAVRPARSRRKQKKQEYARTQDLFRKKQSDCARAVLDGPTSSSVPGTGAFLQTWREIMTGPSPALEAPPLPTRGEVDLFFPATAQEIQSAEIAVNSAAGPDGFSARLLKSVPALLLRVMVNLLLLVRRVPAALRDARTTFIPKVPDAVDPSQFRPITVASVLQRLLHRILAKRALEAIPLNFRQRAFQPVDGCAENIWLLSTALNEARTRRRPLHMASVDLTKAFDRVTTDAILRGARRAGLSGEFIGYLKELYTTSRTLLQFQGESLLVEPTTGVRQGDPLSPILFNLVLDEYLSSLDPDISFVSGDLRLDAMAFADDLIVFASTPAGLQDRLDALVEFFDPRGLRVNVKKSFTLSLQPGRDKKVKVVCDQIFTIGGTPLPASKVATPWRYLGMTFTPQGSINKGTSEQLDLLLTRTSKAPLKPQQRLVVLRNYLLPRLYHRLVLGPWSAALLLKMDTTIRGAIRRWMDLPHDTPLGFFHAPVTEGGLGINSLRASIPAMVLQRLDGLHFSTHPGAEVAIQLPFLTGLHRRAEAAAQYQGQRLLSKADVHRMWSARLHGSCDGRPLRESKRVPAAHRWAAEGTRLLSGRDFISITKLKINALPTLERTSRGQHKDIQCRAGCQAVESLGHVLQACHRGHRGRIRRHDNIARYVCGRLTQIGWAVKWEPHYSVAGRTLKPDIVAHRGAETVVLDAQVVGTSMRLGFHHAQKKEKYSLPDLLHQVCEGRRDAARVSTITLNFRGVWAPESAQDLKSLGLTDNDLKLLTVRCLQGGAQCFRLHRRMTTVVKATGDEANALPAHSGLPPTQLGGRTLGPSAHNQSARTT

SEQ ID NO: 1459 - protein, 1099 aa, synthetic construct
  source 1..1099: note = Description of Artificial Sequence: Synthetic polypeptide
MSNTSHSKLNLKMDNKLKTSLETPSGVRADSIITRVRTSSNRGEHSNGVTYPRCEQGVAPLDTHGGICDAPPQVTVPATETDKQKKCEYCEFTYLKPRQIGTHMRKRHPQEWNDIKRTKFLSEKRQKRWLDEDFELLCIGQEEYLVLSSIGKQGKGINQYIQTKYFPTLSTDAIKSQRKSRRFSEYSEKRSRELQPCNTSSDPEELPNEAVTENSPLSFDPLDRDVVKKISSKDHGDQILLVQEHLINGRYQEANTLAKAIFEKLSGKFPNLKTGDHRPGKQQTARKVGKKRVRGSGKKLSPSKQNRRELYAIVQKQWRTKKRSKVINQILTGNLNKEQSYTHTPDQLAQFWSTLFGRVSPRDDRPINHRRSVIPELDKPLSVEEVEAALKGAKDAATGIDGVPISHLKHLGSAALTILYNGLYVTGSIPDPWKRARTILIPKSNPPASPGDYRPISISSYFYRIYTSAISKRLASAVSLDDRQKGFIKEDGIRDNLSLIDTLINETKAGSKSLFMTFMDVKKAFDSVSHYAIARSLEWAGVPDGMRSVIADLYQDCTTDICGRSVKVTRGVKQGDPLSSTLFNLVIEMVMSNVPERLGIQFQGHRLFYLAFADDLVLLTRGPTANQKLVSLVHEQLARVGLELHPGKCKSIAIMADPKRKTTFVDQGSSVLIGGEPVSSLGPQEWYKYLGIKLGSGGMPQGIYRDQLADLLAKTDSAPLKPQQRLYILRSHILPKFNHRLMFERVTCQTLEGLDKLIRTHVRKWLKLPKDTPGPAFYADKGSGGLGLITLRYRVPLLKLRRHKKMADSPDPVIRLIPNAEPTISLLARWTKMCSLYGKQYQHKSELSKIIRDKYWTMCDGKGLRTEVPPDTAKKTLSLLFEDRTPLKPGQLIGAIGVRLNTLGTPARNNRAKGYSPEANICDKCPGNRQATLGHISQTCPATHGRRVKRHDKIVNRIAKALKERGSVKNILTEPHLRHDKLPLRKPDLIVHTEKSVEIIDVQVVADQGISRHEDEDQQKKIVKYDVDGYKRAAYKMLGIDYGSIPCNVSAFTITWRGNLAPHSLKLASRLQFSPVLKYIVADSLVDTWGAFLIWGKTS

SEQ ID NO: 1460 - protein, 1085 aa, synthetic construct
  source 1..1085: note = Description of Artificial Sequence: Synthetic polypeptide
MNERLTDELTTEFILSDMFLWDYPCTDQNKCYPCNLVFLDHRTWSSHMARVHPHANKTYKCRICNRTADSIHKIASHYGRTCKSLIGKTNAITTTIDETLFSCLHCSRGFTTKTGLGVHTRRTHPTEHEAILQQNTPGRKVRWGEEEVEIMAHKEAQQKDEDINMNQLIQNSVMPHRTLEAIKGKRRNIKYKELVRTLKETTYKVENQCLVNLVLPTTSEITTTPSEGDQPAIRAEKEQSPTAAEDLQVIINDLKSQNFSHNQALLLLNSHVEKFLNRSKPIKRKDHVNQQEIDENRHRRQSKQTKYRRYQYLYHTNKKALLDEITSDRSGPSIYPTEESIRGTFVTLFESNSPPDNIPSKLKNDQSCIDIVKAITLDELIKTLAIMKDKSPGQDNITLSDLRTLPIKYLLDILNIILYIQDIPQIWKQHRTRLIPKTKEELEKPSNWRPITISSIVIRLLHKILSYRLGQQLKLNYRQKAFLPVDGCFENSALLHFIIHNARQKHENTQIVSIDLSKAFDSVSHESIIRALNRFNLSKESITYLTNIYKCNLTDIVFGSTIMRNINLKRGVKQGDPLSPLLFNMIMDELLDNLPTYIGVNVGNQKVNSMMFADDLILFAETECGMNKLLDITTKFLDDRHLKININKCNSLRFIKYGKQKTFSVATTSSYFINNEPINPVSYVKGFKYLGIEFDPRGKRSISCNLLAAMLNKLTRAPLKPEKKVYLINNNLIPRIIHQLVLGKVTKGLLMSLDSEIRKTVKLLLRLPHDTPDSFFYTSVSNGGMGIRNLCDSVALSIINRHNKLITSDDLVIRALSQQSYTIATLKQAHIIAGSKFPSKSLNQNKWSNKLYQTTDGRGLVYCQSQTENNSWITGNHRTIKSYNYIDMVKLRINALPTKSRCNRGTLETKQCRFKCRSINNQISEETLAHILQKCDRSHYSRIARHDSLVQFLATAAQKLNWEVIKEPTLPSDTNKAKPDLILVRDSHVLIVDVAVPWESRSLAHAYDFKVKKYATDKKMQAYLKTIYPEKEIRTEALIISARGGWCALNNMVTKKVGLSSAWVKLALIKVMEGSVKIWRSWSKG

SEQ ID NO: 1461 - protein, 1031 aa, synthetic construct
  source 1..1031: note = Description of Artificial Sequence: Synthetic polypeptide
  VARIANT 78: note = Any amino acid
  VARIANT 87: note = Any amino acid
  VARIANT 200: note = Any amino acid
MKKVLNNETEKLPGSNLTFMCGFCDREFDTARGRGVHESRGHLVERDAAVQSRVKAVVSKKYYYSNEEDVALAKMQLXHADLAKSEXLEAMYLALGKGRTREAIEQHIRKSLRYKGVLEEQRKLLETARGNVRQNNVGVPASNATKNLQRFLESLPLGTNRREERLDRIIRSNSIESQRLELIHYCNDMCQDFVQLDCQXNPINAIRRRNPKRLSKKQLKRAKFSALQRLWIRDRKAAAQLVLKDKLDSLLSNKEDSKDLGSYWQQVFERESELDRRPIPQVVENEELNSPVLEKEVEWAVKNIKKSTAAGPDGLTALALKKIPYSELVKLFNIILLVGFLPDVLKNSRTILIPEVDNPQGGGDYRPISINSVLTRTLNKILAKRVSEGDFGINGQKGFKSVDGCLENLATVESILADARMKKNKLAVVFLDMSKAFDSVNHESIVRAGEIKGYPKLLMTYVKECYNDATTNVAGVTAKFNRGVKQGDPLSPALFNNVIDLAIERVSGTGIGYNMGGKKYSVVAYADDLVLFGESREGLQIALTALLEELKLNGLTPNPAKSASLTFERSGPHWFASTDTVTALGDQIPAMGNIETYKYLGIKFNSCGVVKGSLPGIYTKKLELISKAPLKPQQRLAMLTDFLIPGVLHQAVFGQTNAGDLRSLDKRTRRAVRSWCHLPSDTSTAFIHAKAKDGGMGIPSIRAEVQFGKLDRFGKLPNVKDERSKVLADNAHIKKKMLEKLGVGIPIKGVRCKNKLEFYNKMREELIKSNDGIGLKEASLVPSANTWLKLSDLHMSGRTFVGCLKTRGNLMATVTRTSRGGQNPGIELNCKKGCQYQGSLNHIVQKCPVVKGLRIKRHDEVVKYVEEITKKAGWSATMEPIIPFEGSHRKPDLVLVRGDLGKVVDIQIVSDHCGLDEKNSCKIGKYDNDIIRNYVRGLGPSRVEVAAITLNWRGVWSRDSFNLIKRLGMTEMDAKIISMRVLASTAKMFKTCKKVLEPVCRTKTADCDGYGPEETSARPCHELNLKESSGT

SEQ ID NO: 1462 - protein, 1395 aa, synthetic construct
  source 1..1395: note = Description of Artificial Sequence: Synthetic polypeptide
MENSFAWEGTSSAEGRTTVEDSPSSSDDFVSNVGFKVAKADPTVWEEANMSEDNTIIEDPPSSSDDFANNVGFKVTRADPTAWEEASTSTETEDLPSSSNFIDNVETQIDMAGPTAWEDADSNEDNIDEGTPNNINNNLAIVRGRADAYACSCCERNFISLKAIGTHLKETHNKKVVFECAKCQHTFVKAHGLACHVPKCKEDADTPMLNRLLHGCGECGLAFNTRRGLSQHERHRHPSACLSTRRRSRLDGIARKKSLRNRRDIWTNDEIRLLKQLMIQYEHAKKINIKIAEHFNHKNAKQVMHKRRSLREKDMALGAPHDAPPPLAEEPIIEVVEGAREELEQAPVDVILPDLEALTVNDGRGGGSPVLTEGGESTRDMEENGGTDTRSPSPREERAGSTPWERGWQPRVDRGRGEYKGYGGERGDRHTVSLSQRGESGVDPLTPGGVVEDYDDSYLEDYFPGWDEDEHMHIIGRLDLSDESEQGEAAVSPRLGSFGDLLEEVNAMEGKDNLSEALAETLGLVLHEGHRVEYIKEKMNINVKQMATEILAHGANKGNPKRRKEAVAAKRNPGTRLDRAQRDNQAKAKAKEKKRIFSETQTQYKKNPHRLVEKLLDGKGDERCSVSLEVIQRTYMNRFSRESKEVDIGAYVDPETVEDNQGIVDPISKAEIERAISTTKKGSAPGPDGVTYDALKAYGNCQLYLLIMYNTWLAMGKVPSEAKTYRSILIPKGQGDPMDINNFRPLTLANVISRLYSKILTRRLDGAVSVCPRQRGFTHKASIEDNTLILRELIMKSKRNKECLAVVLLDLAKAFDTVSHDLIIKALRRHRVHEHLISVIMDLYEGGTTSFTTDEGTTCPIAIRSEVKQGDSLSPVLFNLALDPLLATLEQRGKGVEIGGHTFVSLAYADDTALVSSSHLDMTANLDITVEYLNATGLSLNVRKCQGFLLTPINKSFLVNEAESWVVEREAIPWVEPGDTAKYLGVQVGPWSRPWPSIQPVIKRLTAYCESIDKAALKPRQRIHILTTYIAPRIAFEIAEGGYSTLVDCRGGIQYTRIREVDMTIRNYVRKWLFLPACLSNSFLYTRRGEGGLGLVSFYDYVPTERMRKLVRVCDSEDPVIAGAAASLGLRERAAKISAQTGLPVPVKPKGAHNAWRKVQKKKWKAQPTQGKGVSCYQHRLGNKWLGAPSFLTENDYIWAIKLRTNLVPTREAMGRGIIGRNQVECRHCHTTIETMGHISGYCQMVLDIRLIRHNRICKALIKAATATGLRVTEEPRIVGTDGKNYLPDLIFSAGAGEPCYVVDPTVVWDDDPKNLREAWRGKVRKYTPIIPAVEAMLHPSSVQIFGFVCGARGTWCPMNDDIAKIVGLKNSGISRTLQIVLCDTIRMVKAFMAR

SEQ ID NO: 1463 - protein, 1236 aa, synthetic construct
  source 1..1236: note = Description of Artificial Sequence: Synthetic polypeptide
MSGKRIVEMSGCDEKICQNKHCLKRRWAWISGPKGETSPPRKRGTCENVSFQDKSHASDPDPLKAPEAREDAGSVAPQWVGEIKTPSLTSRDGVSEVVLPPQPVHAEGVSPASDSKDKATKITLLISLPVCDLRCGRCERPLETVGKAVRHFAVAHPTVSVVFKCQKCEKSSKNSHSISCHIPKCKGMTETRTDVEGDHGCDHCQEKFTTAMGLTQHKRHRHIVQYCKEKEGEMTARRKGEVEAVKWSEWEESEVARLSDGLAGLKMINRRIADSLGTGKTAEQVRQKRRRMRPEKVRCDKPKEAKDKSNLIKMLSIPSATPTPQTGLKGFLLGELNGVATKGEVQIGGVTLSLRGVEQDSALLNTSALELQRLLGGRAGSANPLSLQRERETTLPSERRKTKQGEYRRVQKMFRSNEKKIAKYILDGNGDGEAASPPLEIALAFKSRWEEVETFHGLGQFYSRGEADGVVFRSLISMSEVCENLGAIKNNTAAGPDGITKPALLEWDPTGAKLAAIFSIWLTSGTLPGPFKKCRTTLIPKTDDPILLTQVAGWRPLTIGSVVLRLYSRILTHRLERACPINPRQRGFISSPGCSENLMILGGLIKRSWAKGERLAVVLVDFARAFDSVSHSHILEILRQRGLDEHIIGIVGDSYTDVTTTITVSGEQSPPIDMRVGVKQGDPMSPLLFNLALDPMIDTLERYGLGYRMGEQQITALAFADDLVLVSDSWEGMACNIRILEEFCRLTGLRIQPRKCHGFLIQKIQRARSVNLCKPWIVCGEELHMVGPEESVSYLGMKVSPWHGIMEPDPVERLCNWISSIGRSPLKPSQKVRMLNVYAAPRMTYQADHGGLGPIVLNVLDGMIRKAVKVWLHLPLCTCDGLLYSRCQDGGLGIVKLACQIPSIQARRVYRLWHSKEAITRVVTRRTVEAEEYRGMWLRAGGSEAGLPPLEDREEGAVQCTDTAGSVKPKNPVIPDWRRAEFLKWQNLTAQGVGVQVFGGDKNSNHWMANPETLGSKERHYIAGLQLRANVYPTREALSRGRPDLPKVCRQCLAGTESCAHILGQCPAVKDSRIRRHHKLCDLLASEAESAGWTVIREMCCRTRAGALRRPDLVFVKTGFALVVDVTVRYEMAYDTLMGAAAEKVARYTPITPYVAMTLKARRVKVFGFPLGARGKWPGSNDRLLKAMGVGGGRRKQLAKLFSRRALLYSLDVLRDFYRAEGETGDLDDESVDDHL

SEQ ID NO: 1464 - protein, 1298 aa, synthetic construct
  source 1..1298: note = Description of Artificial Sequence: Synthetic polypeptide
  VARIANT 129: note = Any amino acid
  VARIANT 184: note = Any amino acid
  VARIANT 218: note = Any amino acid
  VARIANT 259: note = Any amino acid
  VARIANT 369: note = Any amino acid
  VARIANT 370: note = Any amino acid
  VARIANT 402: note = Any amino acid
  VARIANT 721: note = Any amino acid
MSRRPGKSNEPPVRSRAMGLTTLSGTKTSNSGAQGPSTSAPMQNMAGGFVCDCGRSYALKTSLARHKKECGKNNAECRWCGTRFNTLAGTRQHERKAHFVQYQSDLAKALPQPESELMEKIAIVEARSXNGIFYKEMMASTGLTHQQVRSRREKPEYKGFLERARRSLAQTNIRAGSISPASTXAGSLESASPKAGCSSSASPGPTTRSRAPTKGVPXRSSNSARIVVEAQVHTRAPPNTGETEVALRESRRTVPRLGXNPSRPCGISPLMAIAIDEDSVLGGLRVQAGPSPTAVHSVEAFPGTSSMTPMETDRVHNKSGIDPILEHNGTRQVRREESSTREDPVEQWSPNYPKTPVTMPNITTTADAXXTSYNRTPQTLPGNRRRRSRSLPPVQRKSASDXLESVDSLGPWAVFLQDQVDAGSLSGNDSLADLVRVALTKSDRGVLNDAVNRYLAQRAESLRIRKRGSKGKRKSKTGRHYGQTTSGSGQRAALFKKHQDLFLKNRRGLAETILSGKEDFGPRPEPPVTSVEEFYGGIFESPSPPDNEPFEVRATGVEDPPPLTSPWTKRTLRSPCYWRRRPPPTYITMDEIKAARAGWQISAPGSDQIPVAAVKTMSELELAILFNIILFRNVQPSAWGVLRTTLVPKDGDLRNPANWRPITISSALQRLLHRVLAARLSKLVSLSSSQRGFTEIDGTLANALILHEYLQYRRQTGRTYXVVSLDVRKAFDTVSHCSVSRALGRFGIPSVIREYILATFGAQTTIKCGSVTTRPIRMLRGVRQGDPLSPVLFNLVMDELLEKVNEKYEGGSLQSGERCAIMAFADDLILIADRDQDVPAMFDDVSTFLERRGMSVNPAKCRALIAGAVSGRSVVRTGSSYKIHNTPIPNVDALDAFKYLGLEFGHKGVERPTIHNLSVWLNNLRRAPLKPDQKCLFIRQYVIPRLLYGMQNPQVTSRVLREADRLIRRHLKTYYHLNVHTPDSLIHASVSDGGLGIMELRKAIPRIFLGRLVKLLNKNKDSVLSSVLQSNRVRTLMGKLSTMAGEVPESTFWRNQIASGPLSKGLEQAAEDSASRLWISEKPSGWSGRDHVRAVQLRTGNLPTKAIPSVPVGQRRCRHGCACDESISHVLQMCPLTHADRIRRHDEVVKKVARHCTSRGWTVEVEPHIRSRCGRLFKPDLAVHQPGGAIVIADVQVSWDSESLTVPYERKRAKYDVPQFHQAAQHAWPGKALTFAPVIVGARGIWPRINNDRSAALQIPPVVRRACVNSVVKWGSSIHATFMRSVWANRLNPRPLRA

SEQ ID NO: 1465 - protein, 1243 aa, synthetic construct
  source 1..1243: note = Description of Artificial Sequence: Synthetic polypeptide
  VARIANT 40: note = Any amino acid
  VARIANT 71: note = Any amino acid
  VARIANT 84: note = Any amino acid
  VARIANT 347: note = Any amino acid
  VARIANT 495: note = Any amino acid
  VARIANT 503: note = Any amino acid
  VARIANT 572: note = Any amino acid
  VARIANT 724: note = Any amino acid
MGSWIVNFVSVATQTGEFPVDTARRAPVPVTSYPESECHXPLPLTFCNSDVTIWGGVRPEPVDCLGDLPEXYDALPGVAGPREXVGGSPPGEGVRSPGIASPSGTAVQHDFGSPILVPGAEAAEVSTPVVKVPQDHPACPCCGTRVVKVTALSEHLRRAHGRKRVLFQCSRCGRMNEKHHSIACHFPKCRGPPVEEGPLGAPEWCCEECGQKFNTKSGLSQHKRSVHPLTRNVERIEAARPKGKGKRGAHKGCWTEAEVAQLIELEGRFKNQRFINKLIAEHLPSKSAKQISDKRRQLAAATKTSSPEKRVTSSTSGESSPEVEKVEGIKREYRRRVGEWLCAGSLXDQTSFQKILEDVESGSEIVTGPLEELASFARGKLAAARVRHHRKHPAEAVPAREEQRWMKRRVGRRGLYLRFQRLFALDRRKLAGIILDDVESIKCPLPMEEVADVFRRRWEEVAPFTGSGSFRSLGKADNGAFKPMISAKEVMKNVXEMSRRSAXGPDGLSLRDLMKIDPQGSRMAELFNLWLLAGRVPDQVKAGRTVLIPKSADPGKIGNIDNWRPITIGSVXLRMFSRILSARLRRACPINRRQRGFIAAPGCSENLKLLQALIKSAKRDHRTLGVVFVDLAKAFDSVNHQHIFQVLVQKGVDGHIIDILRDLYTNAGTYLESGSQRSGFIKILRGVKQGDPLSPILFNLALDPLLCRLEDRGLGYKYGDQQIXSLAFADDLALLSDSWEGMQQSIRVVEEFCQRTGLRVQAPKCHGFLIRPTKESYTINDCDPWTIADMQLDMIDPGSSEKYLGLGIDPWIGLSRPELSEVLTRWVKNIGGAPLKPLQKVDILRSYALPRLLFIADHAGLSATCLHSLDLSIRSAVKGWLHLPPSTCDAIIYVSYKDGGLGLPRLASLIPNVQARRLVRIAQSEDDVIRSVVLQEGIQEEIRKVWISAGGRPEKVPSVTGEFPVMEAQAADEALSEWERRAPRTIYPIPCKWRKREMENWTNLKSQGHGIRNFENDRISNDWLLHYGRIPHRKLITAIQLRANVYPTREFLARGLGEGAPRGCRHCPAEWESCSHIIGYCPAVQEARIKRHNDICGVLAEEARKLGWVIFIEPHLRDNTNELFKPDLVLVKGSCAKVVDVTIRYESGLTTLSDAAAEKARKYQHLAGEVRALTSATTVDFLGFPIGARGKWYVGNNGLLSDLGFSTSRVVRIARALSKKALLSSVDIIHIFASRARQAQTSE

SEQ ID NO: 1466 - protein, 1085 aa, synthetic construct
  source 1..1085: note = Description of Artificial Sequence: Synthetic polypeptide
MSNRLANTAAAGGVPEKTSGTLDIPGQPSSSGEKRAISYPGPFGCNSCSFTSTTWLSLELHFKSVHNIRDFVFLCSKCKKSWPSINSVASHYPRCKGSVKAAVVPTSLANTCTTCGSSFGTFSGLQLHRKRAHPDVFAASCSKKTKARWSNDEFTLLARLEAGLDPACKNINQVLAERLMEYNITRGVEMIKGQRRKDQYKALVRQLRSNSETQQCVGLAGSMDSNVPANDTSSSVASEVSITYPEYGAVMSCDLIKEATGMAIVDINELQSNLRKAFLSGRKLPMKFHGARETAQKKMANPRVAKFKRFQRLFRSNRRKLASHIFDKASLEQFGGSIDEASDHLEKFLSRPRLESDSYSVISGDKSIGVAHPILAEEVELELKASRPTAVGPDGIALEDIKKLNTYDIASLFNLWLKAGDLPASVKASRTIFLPKSDGTTDISNCRPITIASAMYRLFSRIITRRLAARLELNVRQKAFRPEMNGVFENSAILYALIKDAKVRSREICVTTLDLAKAFDTVPHSRILRALRKNNVDPESVDLISKMLTGTTYAEIKGLQGKLIPIRNGVRQGDPLSPLLFSLFIDEIIGRLQACGPAYDFHGEKICILAFADDLTLVADSAAGMKILLKAACDFLEESGMSLNAEKCRTLCITRSPRSRKTFVNPAAKFIISDWKTGISSEIPSLCATDTFRFLGHTFDGEGKIHIDTEEIRSMLKSVKSAPLKPEQKVALIRSHLLPRLQFLFSTAEADSRKAWLIDSIIRGCVKEILHSVKAGMCTDIFYIPSRDGGMGFTSLGEFSLFSRQKALAKMAGSSDPLSKRVAEFFIERWNIARDPKVIEAARRVYQKKRYQRFFQTYQSGGWNEFSGNTIGNAWLTNGRARGRNFIMAVKFRSNTAATRAENLRGRPGTKECRFCKSATETLAHICQRCPANHGLVIQRHDAVVTFLGEVARKEGYQVMIEPKVSTPVGALKPDLLLIKADTAFIVDVGIAWEGGRPLKLVNKMKCDKYKTAIPAILETFHVGHAETYGVILGSRGCWLKSNDKALASIGLNITRKMKEHLSWLTFEIIFITQISRIYNSFMKK

SEQ ID NO: 1467 - protein, 1086 aa, synthetic construct
  source 1..1086: note = Description of Artificial Sequence: Synthetic polypeptide
MCILGGLTSHSREGGLSRGSSQLKTVKPQNEEDNGTTQLKAGSADSFPRPSGDLNPEEPLSIDICPVCFRQMKSYLGVRVHMQKMHLEEYNASIPDPVVSHTRWSDEEAAQLAFTEAKIEVDKLLPRGKGINKFLLELLPGRTLESIKSHRKRQSHKDLVRKYVKEFVDTLAADNDDDTIICQDNGDIFNDPIVGATDSQSETETVADPAEFKTFIELADDPTKPKVVAKLRNLIKDKPKSEILGSDILVRILRRTLHGLPVEDELDQYLEVYFTGKIKQRRSKTQTALSKKQIKQRDYGRLQELYSRSRKRCANEILNPTSMSGGFGHQELSEFWTKTFGPDEQPTLGEVEIIPKENCWWDIFSPISSDEIKASYPSIGKAAGPDNFSAYQLRKVPVWHLECLYNIFAFYKDIPSRLKDAKTILIPKKDNAESPGDFRPITLSSIITRHFHKILATRVNNFVRFHPMQRGFIQSDGCLENTALIQTVIREAKVRRKQVHITFCDVRKAFDSVRYDSIIAAIAKKGAPGSFIMYLSNLYRGNKTTLLTAGGETRITPTRGVRQGDPLSPILFNCVMDQILTALPSRTGFTLSAGDESVNVNCLAFADDIILISKTKNGHQELLDVTQRILKENGLDLNPDKCCSLSLIPHSKTKKIKVVRADFVVNGVKVRSMSIGDSTCYLGVSINVTGQVAPVKMYQALCEKLDSAAIKPHQRLYILKHFVITKMFHPLILSTIAAHKIKNLDLISRRYVRKWLHLPHDCGSGMIHAKVSDGGLGVPLLFRTIADLKVRRKEKLQVHENPIFRILAKLSTVSKELENCKKIASKTTDIQEKTFKEMLATYDGLSLKEARAVPEVHKWVDSYDKRYKFAGRDFVQVIQARFNALPTRSRVWRGRGADEKSLRCRAGCNARETLNHVSQSCFRTHRVRTARHDKILDFICERLDVVGVKYVREKPISFPGKKLIPDLIVENTDQALVLDLQIVGDNSELPLDERGKNKVIKYNCSEMQELYKRKKKTLAVKALTLHYKGLMAPETSNILRSFGFKSKDLEKMAYMALFGTVAAWGIFNRSTETMRSVANWPRPEEL

SEQ ID NO: 1468 - protein, 1054 aa, synthetic construct
  source 1..1054: note = Description of Artificial Sequence: Synthetic polypeptide
FERRSNSWGYQNLEPSNVGQDMNTVPRINNTTTTPATSRPGDQPREAIAVVNLAGEIPCAVCGRLFNTRRGFGVHMSHQHKDELDTQRQREDVKLRWSEEEAWMMARKEVELEASGNLRFPNKKLAEVFTHRSSEAIKCFRKRGEYKAKLEQIRGQSTPTPEALDSITSQPRPSLLERNHQVSSSEAQPINPSEEQSNWEIMRILQGYRPVECSPRWRAQVLQTIVDRAQAVGKETTLQCLSNYLLEVFPLPNEPHTIGRSNLRRPRTRRQLRQQEYAQVQRRWDKNTGRCIKSLLDGTDESVMPNQEIMEPYWKQVMTNPSTCSCENTRFRMEHSLETVWSAITPRDLRENKLKLSSAPGPDGITPRTARSVPLGIMLRIMNLILWCGKIPFSTRLARTIFIPKTVTANRPQDFRPITVPSVLVRQLNAVLASRLASKVNWDPRQRGFLPTDGCADNATLVDLILREHHKRWKSCYLATVDVSKAFDLVSHQAIIKTLQAYGAPTNFVSFIEEQYKGGGTSLNGAGWSSEVFIPARGVKQGDPLSPLLFNLIIDRLLRSYPREIGAKVGNTMTSAAAFADDLVLFAETPMGQTLLDTTLGFLASVGLSLNADKCFTVSIKGQAKQKCTVVERRSFCVGERECPSLKRTEEWKYLGIRFTADGRAQYSPADDLGPKLLRLTRAPLKPQQKLFAHRTVLIPQLYHQLTLGSVMIGVLGKCDRLVRQFVRRWLDLPLDVPVAYFHAPHTCGGLGIPSIRWIAPMLRLKRLSNIKWPHLEQSEVASSFIDDELQRARDRLKAENVQRCSRPEIDSYFANRLYMSVDGCGLREAGHYGPQHGWVSQPTRLLTGKEYLHGVKLRINALPSKSRTTRGRHELERRCRAGCDAPETTNHILQKCYRTHGRRVARHNSVVNAVKRGLERKGCVAHVEPSLQCDSGLNKPDLVGIRQNHIYVIDVQVVTDGHSLDQAHQRKVERYDRADIRSQMRRFFGVTGEIEFHSVTLNWRGIWSGQSVKRLIAKDLLIAEDTKLISVRAVNGGVTSFKYFMYCAGYTRS

SEQ ID NO: 1469 - protein, 1253 aa, synthetic construct
  source 1..1253: note = Description of Artificial Sequence: Synthetic polypeptide
RPQTKLMTDKLKFSSQLARGLAKQRAMDGARVGDPPITVRPTETDLCNTEGSWGRRPMKLLFVSVSTQTQNEDALWASDVAKPMASRSALKMTSIPSMTFHNSSLEKEEEMNYDFYEQIKSLVESDDSSDDFTEDDEDVEESFLDISAEEPVLGKFPIDTKGTITVVLPSLEYICVICKQHMGKASELVAHFNIKHRDIPLVFKCAKCDKTNSNHRSIACHAPKCGGIKLTEESLPMVCECCQARFATLSGLSQHKRHAHPVTRNEERIKDGIKGTSQRGVHRSCWSLKEVEQLALLELQFQGKKNINKIIAEALGTKTNKQVSDKRRDLSKKTGAPMSDSLHFSSRPLETLSPPPNVTTGTSSILAQAAERLTNENSGTLEKPAMEAIKAWLNGEGQHDALVETATALMLCPMRLVKNKGKRSKPENDIIKPRILPTRSWMKKRAEKRGSFMKHQKLFFKNRSLLASLVLDGTERHECRIPNADVYRFYCEKWEKVLPFNGLGQFKSSGVANNEYFEPLISVEEVQTAIRAIKPTSAAGPDGLTRAAICAADPEGRTLTALFNAWMITGIIPKELKKNRTILIPKVMDDEKLKELGNWRPITIGSMILRLFSRIMTARLARACPLNPRQRGFIAASGCSENLKVLQDLMRHAKKLHRPLAVMFIDIAKAFDSVSHAHILWVLRHKKVDEHVVGIIQNAYDRCTTSFKSNGESTREISIRVGVKQGDPMSPLLFNLAMDPLICTLESHGVGYSIDTDHVTALAFADDLVLVSESWVGMAANLAILESFCGLSGLEVQARKCQGFMISPTKDSYTVNNCDPWTIKNKDVHMIQPDESTKYLGLKICPWTGIIRSDLHVQLKTRISKIDEAPLKPTQKVELLNAYALPRLLYPADHSDCKQSTLRVLDQEIIKAVKGWLHLPASTCDGLLYARARDGGLAILKLENAIPSVQVRRLQRIANSSDAIARNIASSQGVEEEYRSLWVRAGGDSEAIPTFFLRGSESKEPVYPRPCDWRKRESRRRCEKPVQGRGIVNFAQDRISNAWLGPRCGFKQCFFIAALQLRANIYPTRESINRGRDGASRSCRKCSARLESLSHILGQCPAVQKFKDCATQTEAEMVPHGPAGNALPGWSLSRTFLVNVPQYKNSRIARRNKISDILADEAARLGWWVYKEPRFTSEAGELRKPALVFAKGEEALVIDVTVRFELSRKTSSEAASHQVAYYTPPCDQVKVLTKASNVTFFGFQVGARGKVAP

SEQ ID NO: 1470 - protein, 1127 aa, synthetic construct
  source 1..1127: note = Description of Artificial Sequence: Synthetic polypeptide
RKELVTIKNLFEESGATAPAPVPLEVAVEVHQSSSVPEITDESTTTQEGSYSEPPIHRCENCGREFRTRAGVQQHRRKAHTNEFMEEKEKAAPTKKLRWTDEEKEILIESEIKIIKEGSLKEQHEINKILASRMPGRSQDGIAKIRQKQEHKAEIQRRLHGTVTTNETRGNRTSEITEPIRSLPINTKTWSEDEMKRMLAEEVKLRTKNEKDINKKLAEIFPNRTMGSIKSKRTKDKDYQDLVKLTMQTISENPDNETDFNTSNTENNSTDAEKEVKNYLNMLLLTINEEEWLTSTLKEAATLALQGKKTEASEKLNEYASKTLFPGLKITNQTRKREKKISKRETRRQEYAEIQKLYKKNISSAAEKAINGKWSIKPEEEYHNNKDLIKAWKPILEAPPFSDCRPIENIKEMDYALMEISTAEIFLAIRAMGKTAPGPDGIKYSKLKKNIQSMAILFNTCLLTSFLPLPLKIARTILIPKQENPGILDYRPLTIASVVTRVFHSILAKKLDNNAQLSQRQKGFRKCDGVAENIVILETILTNSRSEKRPLCMAFVDLRKAFDSVGHESIIRGAKRVGVPPMLLEYISSSYQNASTNLFGEILNSRRGVRQGDPLSPILFNFVIDEALENLNRNIGYLLKEEKVSCLAFADDIVLIAETKGGLENHIEKLLEKLNGAGLELNASKCATLMVMKNGKEKSTYISTKAIKIKENDIPTMKATETYKYLGLQMGFKAREQNANEVITEGLENITRAPLKPQQRIHILRDFLIPRLIHKLVLGRVAKKSLKRIDQNIRKKVRNWLHLPKDTTAAFIHADAGDGGLGVPALEHTIPLLKRERITNLRKSNDPVTKECLRMEYTKQVLGKWSRPTKIGETLATNKSQLKEAFRKQMLITLDGKGLKDHHETPTIHKWIRRGENMTGKQFITAVKIRGNLVATKSRNSRGRPEQEKLCEAQCGRPDSLGHILQGCWRTHGMRVERHNNICRRIKAIMKGKESEVVEEPRLQTNEGLRKPDLLICHKGKIIICDAQVVADSSNCSLESENQRKIDYYKKDSVVSEARKLIGRVDEDIIIMAVTFNWRGAISKTSIRDLDMLLDIKSKEVIKMSRKIIRDNSIMVEMHRNRTEKRR

SEQ ID NO: 1471 - protein, 1089 aa, synthetic construct
  source 1..1089: note = Description of Artificial Sequence: Synthetic polypeptide
  VARIANT 546: note = Any amino acid
  VARIANT 551: note = Any amino acid
MKSRSFRRIGDCAAGSSRRGVRLTGKAGREGRFAASPHLSPRYLAGSVSGNVPSVPPGPGLGAGAPAFAAGRNADGGPAQNPCPYCARSFTTANGRGLHIRRAHPDEANNAIDIERIHARWSHEETAMMARLEAGAIQRGGVRFMNQFLVPRMPGRTLEAVKSKRRDATYKALVQRFLQAPQINLPELRDGDAPRQPDPQQENPPEPPSFDGAIRGAVADLVGGVDWQRLGFQGDRLCNIARRACDGGDVSGQLLGWLRDVFPVKRVSTRGDQSDLDVDGALVSRRTARTREYARVQELYRKEPKACLARILGDRREGANRAPNRDPAFIDFWRGVFSEASAEVEGWAEEVSDHGELARRVWDPISVEEVGRSRVRNGAAPGPDGIAVSVWNKLPPEAAALLFNVLLLGRCLPAELTRTRTVFIPKTDAPRTPADYRPISIASVVARHFHRVLSARVQRIPDLFTKYQRGFLSGVDGIADNLSVLDTMLTMSRRCCKHLHLAALDVSKAFDTVSHFAIVRACRSIFGSAETVLEEGGRRHFVQVRXGVRQXDPLSPLLFNLVLDRALKRLSTDVGFRLTDATKVTALAFADDVVLCATTARGLQTNLDVLEAELRLAGLLLNPNKCQALSLVASGRDHKVKLVTKPTFKVGQNTIHQVDASSIWKYLGIQFRGSGMCGCGSEGVAAGLKRITCAPLKPQQRMHLLRVFFLPKFYHAWTFGRLNAGVLRRLDVVVRTSVRTWLRLPHDIPVGYFHAPTKSGGLGIPQLSRFIPFLRLKRFDRLGRSAVDYVRECAFTDIADRKIRWCRERLSGIVDQVAGGRDALDAYWTAQLHQSVDGRALRESASVASSTQWLRCSTRAIPASDWLHYTAVHIGALPSRVRTSRGRRGGQDVSCRGGCLLDETPAHCIQVCHRTHGGRVLRHDAIAKRISADLMELGWIVTREVSFRTTAGVFRPDMVAVKEGVTVILDVQIVSPAPTLDEAHRRKVAKYRDRADLARYLAEAAVARGRAPPANIRFASATISWRGVWSAESVGSLRELGLSARHFDRYTTMALCGSWRNWVRFNASTASRMGRGRGDASPRRHENQQ

SEQ ID NO: 1472 - protein, 1123 aa, synthetic construct
  source 1..1123: note = Description of Artificial Sequence: Synthetic polypeptide
SGPATSTFGETKSRLCEPTSALGCRPGAVVIQWAQIHKEKRKRIVGWPLGHLGSPTSLKLRHPRLQAKRIVPVLAELMQCLCARHVSGRSPQKSAWAFTLEERTSACGVDAMFVCSTCQRSFATKIGLGVHVRRAHVEVANAAISVERVKDRWSEEERRIMAAVEVRGVLSGARFINEYIMSHLQTSRTLESVKGTRKNPKYKELVATLLEEARTSVREESPRSAVNDSATQPSGPSDTRSLRTEHLFTESTEPFEHRIRELIGDLEGVTDFRAELLVSIAEQQLQGDEVAESLTRWLGEVFKPENQQQQVQRKRRRQRKAPVSGQLPKWRERRRDYAAMQTLFHRNPSLAAGRVLDGKNESRPPDLPEMTAFWEPILTEQSAEHRAVGPASEKSELCSVWGPVEKEELLSSVPPLDTAVGPDGVTARQWRAVLPAVRALLYNIILKRGSFPASMLESRTVFLPKKQHSVNPADFRPISIASVVVRQLHKILAMRLRRTNLVDERQRCMDDGCAENITVLASLLDDARHGLKELHLVSLDCAKAFDSVSHHAIDATLKECGLPAGFVQYISRTYSDSSTRLEVGRNRSEPIKTNRGVRQGDPLSTLIFCLCFDRVARTLSPHIGYDLNNTRISTLLYADDAFLVSTTAPGMNILLRSVEESAGEVGLSFNTSKCSALSLIPSGKEKKMKVGTTPTFKTSQGFITQITPSQEWRYLGVDFQYSGPKKASRSLKIELERISKAPLKPQQRLLILRVYLLPRYYHHLVLSRTTLGHLRGLDLQVRAAVRRWLSLPRDIPIAYFHTTAKEGGLGLPAFETSIPCLMLARLRSMETSTCKAARAAVQGFWVQKRIHWATAALTKNGEALTCKADVDRWWASRLHKSVDGRELRECSGVGSSSTWVNSALNITGRDYVQYHHVRINSLPTRIRTSRGVRREGMEVTCRAGCQVTETAAHVIQSCHRTHGGRILRHNAVCKVLASGLRDKGWEVREEPKLRTRQGLRKPDIVAIKDGVARVIDAQVVSGSGPLDEAHETKRKYYSDNGDVTAAIARECNIAPSNVAYSSCTISWRGVWSPRSAADLLQVGLSKKLLGFITLRVLRGSHLNWTRWNKMTTMRVHHQRTGIG

SEQ ID NO: 1473 - protein, 1133 aa, synthetic construct
  source 1..1133: note = Description of Artificial Sequence: Synthetic polypeptide
MSSNEEGASDTGAPGPGVPVADVSAADGRATYDDHGMSTDYEKQTIELPLNGQIQCLWCHIEGRNQRFLQESQYLKHKDTQHPKGEIIWRCAACQKEFEKLHGCRCHLPKCKGRKEAKGVAKFKCDSCEESFLTQRGLSMHELHRHPAIRNLKRTQGTSRGNTRPINRASVWSKEETDLLIKLNERYKHLKQPNVALKEYFPDKTLKQISDKRRLLPVQEPEDVATTDETGPPPSDSSEESIYESATEDEGGGDMQQTAPNDSWKEPFIQSIRTNHLEEEDSLRKVEEAIERMAMNEGVTEQEVGTLLEQFVDSLTQSPTTERKGSRRKSQKTTKRKTTHNNRKKFLYAKHQELYKKSPRRLLELALSGESSSGREVVNLPEADSVGPLYKSLWGQIGPEKTHRNQPMCNNIDMSEIWTPIALESLVEKFKKIKSDTAAGADQIKKFHLRKKGALHVFAKLCNLLMLHRIYPAQWKTNRTTLIPKPGKSAEEVENWRPITIGSLLGRIYSAMIDRKLRSKIKQHIRQKGFTQEDGCKNNIAILSSALTKMKEDSGGIITIIDISKAFDTVPHGEISQSLMNKGVPSPICEYIQKMYIGCKTIIYCRDKKTLPVDILRGVKQGDPLSPLLFNLIIDPIIGTLDETTEGIKLENENISVLAFADDLVLLAKDKETADKQNRLINEYLDDLKMKVSAEKCTTFEIKRQNKTWFLGDPQLTLGQQRIPYADPEAAIKYLGTNFNPWRGLCKTSIKEIIDAARTVKQLKLKPHQKINLIRTYLLPRYIHKLVANPPPLGTLDLIDKELKTIIKEILHLHPSTTDGLIYTDKSHGGLGIQRVANIVKLAKLKHSILMTRSEDNAVKIALNGQEGMVKRYATSIGLQWPCGIEEIEETRKKLKRADTNKWKTLISQGQGIKEFFGDKTGNAWLYNPEMLRPSRYLDALKLRTNTYGTKAALHRAKRDIDINCRRCGVQVETLGHILGLCTHTKNKRIKRHDEICDLIAKNVSKEYVIFREPEVEVNGDRRKPDMVIKDHDKVYVVDVTVRYENNDSLNKAYKEKENKYKETAEIMRRDLKAKESRVLPVVIGSRGAVPRATIENLKVLGLQTKHALTASLIALRSSIEMANEFLDYDHTT

SEQ ID NO: 1474 - protein, 1279 aa, synthetic construct
  source 1..1279: note = Description of Artificial Sequence: Synthetic polypeptide
  VARIANT 81: note = Any amino acid
  VARIANT 111: note = Any amino acid
TFAPTHPMVRSGPCRKTKRPGSDYRESLIMDSGNNVASEPRGAVDVTSAAPIGAELNAEPCEGRNQRREAALSAQTRRRNXARRARNAQQADEPGDDEEIETHGPLTIRTXEPMEIVAIAKNPQACPKCLQGGTQLLCMGSWELSRHINKEHPSVDVTWVCGACQRRCTTLRSWSCHVLHCKGRQEPKDLPFKCEHCSLSFDSQIGLSQHERHVHPEVRNDKRAAEANKPKGKSGRRPSIWSDEDLLLIRELESEYHGARNINEKIAEHFPDRTGRQVSDARRRKDYAALRGRGGPQGPAEGVEAIEEVDEGEIPEGEELVATDGAALESGPPENGGSAPAEQVNAPALESSSQQDRECSPAVGSDEQIEDSSDDDEFSDALGEISLPEPLSVERTTISPPPRDDWKGPMRWEICNASEEAGSYANWVTGLQELVRNNALSEIGLDSLYDQLIQIMRHPSDDNEQDRLQLNARGPPRRGHRKNRRRRRLTAADRKRFAFARCQDLWNNNPKKLAELVIANDLSILQRRQAPGRTETQTLYNELWGRVGPNIEAPRRTEDPIPVSRIFTPITPQEIMGRIRRIKNDSAAGPDGVTKDDLRGRGVSIALSKLFNSILLAGYYPKAWRENRTTLLPKPEKDPADVKNWRPITISSMVSRVYSGLLDQRVRAVIKQCDRQKGFTEENGCFSNIQLLDDAVSNAKKAGGVITILDVSKAFDTVPHAVIQGCLEKKGIPETVAAYISSMYRDCSTAIRTRSGDVKIGMKRGVKQGDPLSPLIFNLVLEPLLERLQETSGVEIEGMNLSCAAFADDIVCFANTAPEAGRQLRMVADYLGRLDMSLSVSKCIAVEYVPHRKTWYTKNPGLEVNGNAVPSISPSETFKYLGAKVSPWKGLLEGFESDAFREVISRVQRLPLKPMQKVDLLQMYIFPRYTYGLITSPPAKAVLKTIDRIIRTRIKEILHLPESVSSSFLYTPRKQGGLGLLEVEKMVLIAALRNGLRARQSHDPVTRAAMNSNAADDRLKSYADALRLHWPLTTKELDTYKYQLRLSYAQKWAEQKWQGQGVEEFAQDPVGNSWLQRYDLLPASRYIDAIKLRTNTYPTRALMKIIDGRVDSSCRKCQGSSETLGHILGRCRYTKDKRISRHNEIKDLLKARLAKNHQVMDEPQITVRGQRFKPDLVVKTNEGRVHVIDVTVRYEHRTYLDEGRTEKIGKYRQILSTLRRDLHSNAEEVIPIVIGSRGAIPRETRKALSKLGIGKSDWLTISLIALRSSLEIVNAFMDD

SEQ ID NO: 1475 - protein, 1104 aa, synthetic construct
  source 1..1104: note = Description of Artificial Sequence: Synthetic polypeptide
MGEWPWVSWSLTVLVEKWRPFTILQPYPMPGQLRVDVYLPRKTSYLMDKNIYENTTSPGGGPLCGEKTHRSDVIIPPPGFAPSTDTASNTLGENVDASATTSSANPLSQEPGWCESCSKLFKSQRGLRVHQRSKHPELYHSQNQPLPRSKARWSDEEMVIFAREEIANRKIRFINQHLHKVFPHRTLESIKGLRGKNVRYARIMADLEAEMTSQPEAATSLCTETSENLASSNVLPQTRGWAENLVENIDTAHLANLGPLSQFEPGKPSSSTKEAINTEYNDWISKWLPSGAAHRERRANPPSTKLNARATRRLQYSRIQNLYKLNRSACAQEVLSGAWKVQSGELNLKEVQPFWEKMFRKESAKDRRKPKPTGEVLWGLMEPLTIAEVGSTLKSTTPSAPGPDKLTLDGVKRIPIAELVSHYNLWLYAGYQPEGLREGITTLIPKIKGTRDPAKLRPITVSSFICRIFHRCLAQRMETSLPLGERQKAFRKVDGICHNIWSLRSLIHNSKDNLKELNITFLDVRKAFDSISHKSLGIAAARLGLPPPLITYISNLYPNCSTKLKVNGKISKPIEVRRGVRQGDPLSPLLFNAVMDWALSELDPRVGVQIGEQRINHLAFADDIILVSSTKIGMVSSINTLSRHLAKSGLEISAGKEGKSASMAIVVDGKKKMWTVDPLPRFKVNSQKIPALSITQQYKYLGINIDAQGARNDAARILTEGLAELSRAPLKPQQRLYLLRVHLLPKLQHGLVLSSCAKRALTYLDKSVRSAIRRWLTLPKDTPTAFYHAKACDGGLGITRLEHTIPILKRNRMMKLTLSEDPVIMELVKLTYFTNLLHKYSNVKLLNSWPVTDKDSLARAEASMLHTSVDGRGLSNCSDVPRQSDWVTNGASLLSGRDFIGAIKVRGNLLPTKVSAARGRQREITCDCCRRPESLGHILQTCPRTWGPRISRHDSLLKRVRNQACLKNWTPIIEPSIPTNIGLRRPDLVLAKGNIAFLVDATVVADNANMQLQHEAKVEKYNNSDIKEWIKVHCPGVDEVRVTSLTANWRGCLYGGSASFLTEDLGLPKAELSLLSAKINEKGYYLWCAHYRGTARLWNRPLRS

SEQ ID NO: 1476 - protein, 1115 aa, synthetic construct
  source 1..1115: note = Description of Artificial Sequence: Synthetic polypeptide
WVTSPRRPRYVGPQKKKASDGNDGRAAARAEPTNPGGPDRADDDEGDVKFWCEFPGCDRFFMTRSGRGLHHKKGHPDWNDQRNLAGKQHRKEIWSEEERLLLAKKEAELAISGARFINVELRDFTARSLDAIKGQRKRPDYKILVEKFVRELRVRGIRQGVASRSQQARAMAVAGAPAATSSGAPPVATQPPPSGRVLRSQVVEAPAMEIPVAESEGDSSGDELFEDVEPVRLSDLPPDRFTIYFAGLEIPGTEDIYAHRLHTICLMTTWRTKEEVRLELGLFLKDLFPSKGSQERPERTNLPDPRNRIERRRGEYKKCQDLWRRNKSTCVQRILKEDLSQGECLPRELMEPFWNATFTQNPGTAPVLPPPTEVYSSVWEPIRPENIKGNYPPQNTAAGIDGLTVGDLKGVSREMLARIFNLFMWCGKLPEHLCASRTILLPKKPGAKVPGEFRPITVTSVLIRTFHKVLAERLKVVPLDPRQRGFRESDGCAENVMLLDMTIRYHHERRRKMFLALLDMAKAFDSVSFESMREVLTTKGIPTPFIEYFMTHLEDSFTVLQHGNWQSGKIHPTCGVKQGDPLSPPIFNFIMDEMLKRLPKEIGVNLDGLFVNAMAFADDLSLVANTEQGLQILIDEATSFLGLCGLRANPNKCVTLAIKTIPKEKKTAIDPSSHFRIGNAVIPSLKRTDEWVYLGIKFNSNGRLISDAKPKLIKDLELLTKAPLKPQQRLWALKVIVIPGILYRGTLGSSTAGYLRSLDCVIRAYVRRWLRLPGDCPNGYFHAAVADGGLGVHPIRYKAMVDRLARLRKLEKSAYITGPEAARYLQRQVSIAENRLRDGANRIMSDASMLREFLRELLYKSFDGRPLENSSKVPGQHRWVEEPTRFLSGADYMNCIRARIAALPTAARCARGRLKDKHCRAGCGNVETLNHVLQFCHRTHGTRIGRHDAVVKYVVGGLKKRGYAVKEEPKIVLQDVVYKPDMVATKEGKTLILDAQVLGDQRDMRLAHEDKLRKYGAPEFKRKIRSETGSATIKSLSVTLSWRGLWGPDSVKGLLEEGVILKKDLKILSTRVLIGALAGWRRFNERTSMATSGRREEVTTRMVRRWKRRERVGVG

SEQ ID NO: 1477 - protein, 1013 aa, synthetic construct
  source 1..1013: note = Description of Artificial Sequence: Synthetic polypeptide
  VARIANT 753: note = Any amino acid
MSGKSSKPRTVSSGSSSQETPPSGSNACDICGKCFMKPVGLSRVHPSQYHARLEKNQPKAKKFRWTDEDLYFLAKKEAELLHLGSIKFVNKELAEFFPEKSVDQIRGQRRSETYKQQVLSIHSELLKLQTVADSPPPSRIPAKEVSAWLDFFLALPKTKNKFSEDKLDQLIRTAQDGTLILDDLDLYLREVLVQPTSQGEKQAKLLPPPKSSREKRDREYARAQNLYRKNKTACVNAILDGNKKCENKIPDIDDFWKTIFESHSPPDAEPVCYVVDEEPTNIWSWISFFEMNHNYPDSSTSPGPDGVTARMLRSIPARVLNKLLNLLLFIEDLPAVFKCHRTVLIPKIDNPTSPGEFRPITISSIVVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISASKIPMNRGVKQGDPLSPVLFNLVINEIIRKLPASIGYPINSELSINCIAYADDLILVTNTREGLKLLLGLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPTIETINHIAQVCPRTHGARIKRHDRLVQFLSLNLRKNPKRNVLVEYNFRTVAGIRKPDIIVIEDTRAVILDVQVVGDSSNLEMEYLEKSRKYSNDANFINALQKLYPTVTNLTFHAVTFNNRGLIAKSTVAALRMLGVPPRCIMILCVISLEKTLEVWRMFNQSTASARK

SEQ ID NO: 1478 - protein, 1016 aa, synthetic construct
  source 1..1016: note = Description of Artificial Sequence: Synthetic polypeptide
MSEESRPKQTASKRGAAVEKTMMSGTYVCTLCGRSFEKSVGLSLHTNRMHPEAYNKLKEAKKPVLKKARWSEEEVFLLAQKEAELSFIGGIKFMNIELHKIFPERELEGIKGQRKNPTYKAQVVSLLAEIRESKANDSSSSSSSSSSCDSASLGISNWLEFLLALPKTSNQFQEGRLDRLISDALRGVDVLENLDAYLLEVFAKPMAQNPCPKPPPPAKNSRERRDREYSRVQNFYKKNRSACINSILDGNTRSQNVIPGLTKFWTETFEKNSPPDDEAPDQFVADEPRDMYKWITFYEMSQDYLDSSTAPGVDGFSAKQLRSMSPRVLNKILNLLLLSENLPNSFKMHKTVLIPKIDDPKSPGDFRPITISPVLARLLNKILAARLSKLVPISQRQKAFLPVDGCGENIFLLDYILRSSKKSSKSVAMAVLDVKKAFDSVSHHSILRALNEAKCPINFINFVRNSYDGCTTKLTCGGTSFPDSVRMNRGVKQGDPLSPVLFNLIIDSAIRKLPDSIGYVIRDGLKINCLAYADDLILVASSRAGLKTLLNIVAEHLSLRGLDLNAAKCHGLSIIASGKAKTTYVSAADSLDLDGQPIKNLGVLDTWTYLGIPFSHLGRAEKVSPDLTNLLNKLQKAPLKLQQKLYAVRNFVIPRALHGLILSKTNLKELNTLDRAIRVFLRTLLYLPKDTPLGFFHSPIKSGGLGITCFRTSVLKCRLQRIARMRSSCDGVIQAVAESDIFADEYAKLRDLIRINGNVLDTTESIKRYWAQRLHSSVDGKTLAYMDYFPQGNLWMSEDKVSQRSYVFADCVKLRINAIPTRVRVSRGRPNKEMCCRAKCFDSQRMPAFESLNHITQVCPRTHGSRIQRHDKIAKFLFKNLNNCPSRSVLYEPHFVTVDGLRKPDIIIYDDSHMVVLDVQVVSDSANLEKEFECKAKKYANDVALRSAMLIKYPFIKSFSFVAATYNNRGLIAKSSVQVLRQLGLSPRSIMVSILICLEGTLETWRIFNQSTMNAH

SEQ ID NO: 1479 - protein, 1020 aa, synthetic construct
  source 1..1020: note = Description of Artificial Sequence: Synthetic polypeptide
  VARIANT 757: note = Any amino acid
MSGKSSKPRTVSSGSSSQETPPSGSNACDICGKCFMKPVGLSLHMSKVHPTQYHARLEKNQPKAKKFRWTDEDLYFLAKKEAELLLLGGIKFMNKELAEFFPEKSVDQIKGQRRSETYKQQVVSIHSELLKLQAVADSPPPSRIPAKEVSAWLDFLLALPKTKNKFSEDKLDQLIRTAQEGTPVLNDLDLYLREVLVQPTRQGERQAKPLPPPKSSREKRDREYARVQNFYRKNKTACVNAILDGNKKCENKIPDIDEFWKAIFESQSPPDAEPVSYVVDEEPKNIWSWISFFEMNRNYPDTSTSPGPDGVTARMLRSIPARVLNKLLNLLLFIEDLPAVFKCHRTVLIPKVDNPALPGEFRPITISSIIVRQLNKIIAARVSEGVPINPRQKAFRQIDGCAENVFLLDFILRDAKTKIKSLSLATVDIKKAFDSVSHHSIFRAIRGARCPENLVNYIQNSYSGCTTQISVGGSISTTKILMNRGVKQGDPLSPVLFNLVINEIIRKLPASIGYPINSELSINCIAYADDLILVANTREGLKLLLNLLNEELPKRGLELNASKCFGLSLTALGKLKKTHLCTSDQLDLHGTLIKNLTAEESWVYLGVPFSHIGRSKSFSPDLEALLNKLQKSPLKLQQKLFALRVYLIPRLLHGLVLSRVAIGELKIMDKLILKHLRVWLRLPKDTPLGFFYSPVKLGGLGIKNLRTNVLKCRKQRIERMLVSPDDVVRLVAESEIFLKETDKLKDLLTINGMCLDXRNVPRTGKNNKFWSERLYTSFDGKTLAYSEYFTQGGGWIREDKILQPAHVFAECIKLRINALPTKSRVAHGRPTKDRSCRAGCLDVQKVPAIETINHIAQVCPRTHGARIKRHDRLVQFLSLNLRKNPKRNVLVEYNFRTVAGIRKPDIIVIEDTRAAILDVQVVGDSSNLEMEYLEKSRKYSNDATLSMRINALQKLYPTVTSLTFHAVTFNNRGLIAKSTVAALRMLGVPPRCIMILCVISLEKTLEVWRMFNQSTASARK

SEQ ID NO: 1480 - protein, 1138 aa, synthetic construct
  source 1..1138: note = Description of Artificial Sequence: Synthetic polypeptide
MLRGTGNMNDKRDGSATADPTSALLGAVGDGSLVCNLCGLACKSRGGLSIHRRSKHATVYHAERQPAPRAKARWTNDEMILVARKQIASEKSRCSAVVEGMREAVPHRTFDAVKSLKTKNRNYTRILEQIRAECSEEEVIESGVLKDRTENVCVQTTSNVPGSAGRAASVELEGNIQVGHQLAQKTMAGNNSRKQPANHTNWAEFNIEEGNITLRKSKRKANGMPDATHRPGPPTVDSLKHPVCLLQGAADKRDEPHTVEQLYYNIEEGMPLAEEQQWSEKLFDAIDSSLLSVEVELGRIVPGCPDEETRQLIDREFLDFIHSYSREKPPQRGLAKSKPPPKGPKSLRRQQYRQLQRLWDKNRSAAAEQALTGKWQEVRTAAGVPLSLMEVPWREIFETPSTTDVREPAPAGPVLWQLLRPVTIAEVEDAISSKKSASGPDGVPCAALQTMGAASLAAHFNLWLLAGTQPKRLTECRTIFVPKEVNTHLPLHHRPITIGSVVVRLFHQILGKPMEAVLPLGSGQRGFRKGDGICQNIWLLHTLIRRSTDLLRPLKLVFLDVKKAFDSVSHESLLIAAKRLGVPGPLLTYINELYSRSETVFEVGGESSGSVKVSQGVKQGDPLSSTLFNCVIDWAVSDLDPHIGVLLGESRVSFLAYADDLVLLSETEAALTSQLNSIEKSLAHCGLKLSTGDSGKSASLNIVIDGKAKRWVVNPTPFLRASGGEIRSLVANETYKYLGINIGAQGVKAAEYNAFKEALDNLSRAPLKPQQRLFLLKTYLLPQLHHSLVLSRTTGKLLNSLDALVRKAVRGWLKLPHDTHRAFFYAHQADGGLNVPSLYHLIPLLRRSRYERLTRVEDPEIREVSRTDYFKRVLGAAAAATTVAGHRIDSKVTLRLAWREALYASADGRGLSQCPLVPEVHSWVTDVSGLQTGSQYISAVRLRGALLPTAVRKSRGRGGVNSNCDCCGRGQPEFLGHVLQTCPRTWGSRISRHNHVLSLIAKACRSRRWQVLEEPIIQTPAQLLKPDLVIWNHQAAYVVDVSVPGDNTPLSTCHNRKVAYYSGESVREWVRSKTGHNPTVSSVVINWRGAMAKESYRLLTKDLRLAKTLPRLLVLRVLEGGHGIWLNFHRSTFAVGVT

SEQ ID NO: 1481 - protein, 1148 aa, synthetic construct
  source 1..1148: note = Description of Artificial Sequence: Synthetic polypeptide
MPVSTGAETDITSSLPIPASSIVSPNYTLPDSSSTCLICFAIFPTHNILLSHATAIHHISCPPTPVQDGSQQMSCVLCAAAFSSNRGLTQHIRHRHISEYNELIRQRIAVQPTSRIWSPFDDASLLSIANHEAHRFPTKNDLYQHISTVLTRRTAEAVKRRLLHLQWSRSPTAITTSSNNHTTTDIPNTEARYIFPVDLDEHPPLSDATTPDASTHPLPELLVILTPLPSPTRLQNISESQTSHESNRNSMHTPPTYACDSDESLGVTPSSTIPSCFHSYRDPLAEQRSKLLRASASLLQSSCTRIRSSSLLAFLQNASTLMDEEHVSTFLNSHGEFVFPRTWTPSRPKHPSHAPANVSRKKRRKIEYAHIQTLFHHRPKDAANTVLDGRWRNPYVANHSMIPDFDCFWTTVFTKTNSPDSREITPIIPMTPSLIDPILPSDVTWALKEMHGTAGGIDRLTSYDLMRFGKNGLAGYLNMLLALAYLPTNLSTARVTFVPKSSSPVSPEDFRPISVAPVATRCLHKILAKRWMPLFPQERLQFAFLNRDGCFEAVNLLHSVIRHVHTRHAGASFALLDISRAFDTVSHDSIIRAAKRYGAPELLCRYLNNYYRRSTSCVNRTELHPTCGVKQGDPLSPLLFIMVLDELLEGLDPMTHLTVDGESLNYIAYADDLVVFAPNAELLQRKLDRISLLLHEAGWSINPEKSRTLDLISGGHSKITALSQTEFTIAGMRIPPLSAADTFDYLGIKSNFKGRCPVAHIDLLNNYLTEISCAPLKPQQRMKILKDNLLPRLLYPLTLGIVHLKTLKSMDRNIHTAIRKWLRLPSDTPLAYFHSPVAAGGLGILHLSSSVPFHRRKRLETLLSSPNRLLHKLPTSPTLASYSHLSQLPVRIGHETVTSREEASNSWVRRLHSSCDGKGLLLAPLSTESHAWLRYPQSIFPSVYINAVKLRGGLLSTKVRRSRGGRVTNGLNCRGGCAHHETIHHILQHCALTHDIRCKRHNELCNLVAKKLRRQKIHFLQEPCIPLEKTYCKPDFIIIRDSIAYVLDVTVSDDGNTHASRLLKISKYGNERTVASIKRFLTSSGYIITSVRQTPVLTFRGILERASSQSLRRLCFSSRDLGDLCLSAIQGSIKIYNTYMRGTQRLNE

SEQ ID NO: 1482 - protein, 1031 aa, synthetic construct
  source 1..1031: note = Description of Artificial Sequence: Synthetic polypeptide
MSQKRRPEKAVPDEGATAHDVAQPDKSKCSVCGETFKGPASVTMHMVKKHPVEFNELKMAKKPVPKKVRWSEEEIFQLARTEAELTLQGVRFINVELQKIFPAREIEGIKGQRKLAKYKELVKDQLDEIGRAPNPPEQEIGEDVPSPFKAWLELLLALPKTPNDFLEHKLDNIIVQALKEDVNSDQVFNDLNSYLKLILEPSGRAKSVPGEIIHGDPSGSAKTSVTKAPKPATVSSSRKKRRDAEFARIQRLYRKNRTSCINTILDGNTREHEAPKNMEGFWREIFERESPDDPDDPDIFLEEEASDIWKYISFYEMCNLYPPPSTAPGPDGFSSKDLRRMTPRVLNKILNLLLHLRDLPQILKSHRTVLIPKTDLPTKPGDFRPITISNILVRHLNKILANRVSHLIPINERQKAFLPIDGCAENIFTLDFILHHARTKIKSLSMAILDISKAFDSVSHHSIFRALREARCPIGFIKFIENCYGGCFTKLFCGGVKYPSEVSMNRGVKQGDPLSPVLFNLVIDGLIRQIPSALGFNVSDQVKVSCIAYADDLILIATTRAGLKTLLDLTNSYLAKRGLSLNPDKCSALSIVASGKQKLVYIASSEHFDLAGQKMRNLNVGDSWRYLGIQFSHLGRAEKVTPDLTCLINRLQKAPLKLQQKLYALRIYLIPRLIHGLTLSKTNLGELKTLDKLIRKYIRAWLHLPDDTPMGYFYTPLKAGGLGLPSLRLVILNNRLERILRMKASQDIIVRTIAESETLGVEIRKLHDLLSIDGTILDTSVKIHSFWAERLYSSYDGKCLCNSANFPPGNKWIGEDSLNQRSHIFADCLKLRINALPTRSRTARGRPLKDKPCRAGCRNSDGVKVIETLNHITQVCERTHGARVKRHDRLVDFAVKGLQRPHRVVLKEPHYKTVNGVRKPDIVIKIPDHTYICDFQVVSDTSCLELEFRKKALKYAEDKGLCDQLTRDHPGELSFTAITFNTRGLIAKSSVTALRKLGMPPRSIMTLQKICMEGSLEIWRIFNQTTAMARN

SEQ ID NO: 1483 - protein, 1056 aa, synthetic construct
  source 1..1056: note = Description of Artificial Sequence: Synthetic polypeptide
FERRKDPWGYRPPGTLKQIGATENNEPRNLNRFVRGESTASSLESTQFGTSAEVNLAGRVPCTICEMTFSSKRGLGVHMSHRHKDDLDAQRLRVDKKARWSEEETLMMARKEVELAASGVRFLNKKLAEIFTHRSADAISSYRKRSEYKAKLEQIRGQSVPTPEAEEINTTQRRPSNSEQNRRVPRSEGGPIAPTEQTNNEILRVLQGLAPVVCLPRWRAEVLQNIVDNAQVSGQETTLQSLSSYLMEIFPPRNEPHILTRPRTEPRNMRQRRRQQYARVQRNWDKHPGRCIKSLLEEDDESVMPNQEVMEPYWRRVMTQPSSSSIKRDMFNMEHSLERVWSAVNQRDLRATKVKLSSSPGPDGITPKTARSVPEGIMLRIMNLILWCGNLPYSIRLARTIFIPKKATANQPQDYRPISVPSVIVRQLNAILASRLSAAINWDTRQRGFLPTDGCADNTTIVDLVLREHHKRFKSCYIGTLDVSKAFDAVAHEAVYNTLASYGAPKGFINYLRKAYEGGGTMLAGNGWVSEAFIPARGVKQGDPLSPILFNLVIDRLLRSLPSEIGAKVGNAMTNAAAFADDIVLFAETPMGLQKLLDTTVCFLSSVGLTLNTDKCFTVSIKGQAKQKCTVVERRSFLIGGRECPSLKRTDEWKYLGIKFTAEGRARYDPAEDLGPKLLRLTRAPLKPQQKLFALRTVLIPQLYHKLTLGSVTIGVLKKFDKLVRYTARKWLGLPVDVPVSFFHAPHKSGGLGLPSLRWTAPMLRLKRLSNIKWPHLERSEVASSFVEEEMRRARDRLQAGSEELLTRSQVDSYLANRLHMSVDGCGLREAERFAPQHGWVSQPTRLLTGKEYTDGIKLRINALPSRSRTTRGRHELERRCRAGCDAPETTNHILQQCYRTHGRRIARHNGVVNFLKRGLERRGCVVHVEPSLQGETGLNKPDLVAIRQNRIYVIDTQIVTDGHSLDQAHQRKVGKYDTPDIRTNLRRSFGAFDIEFHSATVNWRGIWSGQSVKRLIASDLLSSGDSNIISVRVISGGLWSWRQFMYLSGYTRDWT

SEQ ID NO: 1484 - protein, 1022 aa, synthetic construct
  source 1..1022: note = Description of Artificial Sequence: Synthetic polypeptide
MTTRPSVDIFPEDQYEPNAAATLSRVPCTVCGRSFNSKRGLGVHMRSRHPDELDEERRRVDIKARWSDEEKWMMARKEVELTANGCKHINKQLAVYFANRSVEAIKKLRQRGDYKEKIEQIRGQSALAPEVANLTIRRRPSRSEQDHQVTTSETTPITPFEQSNREILRTLRGYSPVECHSKWRAQELQTIIDRAHLEGKETTLQCLSLYLLGIFPAQGVRHTLTRPPRRPRNRRESRRQQYAVVQRNWDKHKGRCIKSLLNGTDESVMPSQEIMVPYWREVMTQPSPSSCSGEVIQMDHSLERVWSAITEQDLRASRVSLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRTLPSEIGAKVGNAITNAAAFADDLVLFAETRMGLQVLLDKTLDFLSIVGLKLNADKCFTVGIKGQPKQKCTVLEAQSFYVGSSEIPSLKRTDEWKYLGINFTATGRVRCNPAEDIGPKLQRLTKAPLKPQQRLFALRTVLIPQLYHKLALGSVAIGVLRKTDKLIRYYVRRWLNLPLDVPIAFVHAPPKSGGLGIPSLRWVAPMLRLRRLSNIKWPHLTQNEVASSFLEAEKQRARDRLLAEQNELLSRPAIEKYWANKLYLSVDGSGLREGGHYGPQHGWVSQPTRLLTGKEYMDGIRLRINALPTKSRTTRGRHELERQCRAGCDAPETTNHIMQKCYRSHGRRVARHNCVVNRIKRGLEERGCVVIVEPSLQCESGLNKPDLVALRQNHIDVIDTQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1485 - protein, 1070 aa, synthetic construct
  source 1..1070: note = Description of Artificial Sequence: Synthetic polypeptide
SSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNSEILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHTYGGLGIPSVRWVAPMLRMKRLSNIKWAHLAQSEAASSFLTDELNKARGRTLAGLNELTSRTEIETYWANRLYMSVDGRGLREAGLFRPQHGWVCQPTRLLTGQDYRNSIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1486 - protein, 1070 aa, synthetic construct
  source 1..1070: note = Description of Artificial Sequence: Synthetic polypeptide
SSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNREILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHIYGGLGIPSVRWVAPMLRMKRLSNIKWAHLAQSEAASSFLTDELNKARGRTLAGLNELTSRSEIETYWANRLYMSVDGRGLREAGLFRPQHGWVCQPTRLLTGQDYRNGIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 1487 - protein, 1057 aa, synthetic construct
  source 1..1057: note = Description of Artificial Sequence: Synthetic polypeptide
FERQNFSDGLVPQRKFIHIGTTNRNNEPRSNLRNLMTTRPSVDIFPEDQYEPNAAATLSRVPCTVCGRSFNSKRGLGVHMRSRHPDELDEERRRVDIKARWSEEEKWMMARKEVELTANGHKHINKQLAVYFANRSVEAIKKLRQRGDYKEKIEQIRRQSALVPEVANLTIRRRPSRSEQNHQVTTSETTPITPFEQSNREILRTLRGYSPVECHSKWRAQELQTIIDRAELEGKETTLQCLSLYLLGIFPAQGVRHTLTRPPRRPRNRRESRRQQYAVVQRNWDKHKGRCIKSLLNGTDESVMPSQEVMVPYWREVMTQPSPSSCSREVIQMDHSLERVWSAITEHDLRASRISLSSSPGPDGITPKTAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRNLPSEIGARVGNAITNAAAFADDLVLFAETRMGLQVLLDRTLDFLSLVGLKLNADKCFTVGIKGQPKQKCTVLEAQSFYVGSREIPSLKRTDEWKYLGINFTATGRVRCNPAEDIGPKLQRLTKAPLKPQQRMFALRTVLIPQLYHKLALGSVAIGILRKTDKLIRYYVRRWLNLPLDIPIAFIHAPPKSGGLGIPSLRWVAPMLRLRRLSNIKWPHLTQNEVASSFLEAEKQRARDRLLAEQNELLSRPAIEKYWANKLYLSVDGSGLREAGHWGPQHGWVNQPTRLLTGKEYIDGIRLRINALPTKSRTTRGRHELERQCRAGCDAPETTNHIMQKCYRSHGRRIARHNCVVNRIKRGLEERGCVVIVEPSLQCESGLNKPDLVALRQNHIDVIDIQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1488 - protein, 1063 aa, synthetic construct
  source 1..1063: note = Description of Artificial Sequence: Synthetic polypeptide
TCLAANLSGKNFSDGLVTQRKFTHIGTTNTNNEPRISLHNLMTTRPSVDIFPEDQYEPNAAATLSRVPCTVCGRSFNSKRGLGVHMRSRHPDELDEERRRVDIKARWSEEEKWMMARKEVELTANGHKHMNKQLAVYFANRSVEAIKKLRQRGDYKEKIEQIRGQSALVPEVANLTIRRRPSRSEQNHQVTTSETTPITPFEQSNREILRTLRGYSPVECHSKWRAQELQTIIDRAELEGKETTLQCLSLYLLGIFPAQGVRHTLTRPPRRPRNRRESRRQQYAVVQRNWDKHKGRCIKSLLNGTDESVMPSQEVMVPYWREVMTQPSPSSCSGEVIQMDHSLERVWSAITEHDLRASRISLSSSPGPDGITPKSAREVPSGIMLRIMNLILWCGNLPHSIRLARTVFIPKTVTAKRPQDFRPISVPSVLVRQLNAILATRLNSSINWDPRQRGFLPTDGCADNATIVDLVLRHSHKHFRSCYIANLDVSKAFDSLSHASIYDTLRAYGAPKGFVDYVQNTYEGGGTSLNGDGWSSEEFVPARGVKQGDPLSPILFNLVMDRLLRNLPSEIGAKVGNAITNAAAFADDLVLFAETRMGLQVLLDKTLDFLSLVGLKLNADKCFTVGIKGQPKQKCTVLEAQSFYVGSREIPSLKRTDEWKYLGINFTATGRVRCNPAEDIGPKLQRLTKAPLKPQQRMFALRTVLIPQLYHKLALGSVAIGVLRKTDKLIRYYVRRWLNLPLDVPIAFIHAPPKSGGLGIPSLRWVAPMLRLRRLSNIKWPHLTQNEVASSFLEAEKQRARDRLLAEQNELLSRPAIEKYWANKLYLSVDGSGLREAGHWGPQHGWVNQPTRLLTGKEYIDGIRLRINALPTKSRTTRGRHELERQCRAGCDAPETTNHIMQKCYRSHGRRVARHNCVVNRIKRGLEERGCVVIVEPSLQCESGLNKPDLVALRQDHIDVIDIQIVTDGHSMDDAHQRKINRYDRPDIRTELRRRFEAAGDIEFHSATLNWRGIWSGQSVKRLIAKGLLSKYDSHIISVQVMRGSLGCFKQFMYLSGFSRDWT

SEQ ID NO: 1489 - protein, 1057 aa, synthetic construct
  source 1..1057: note = Description of Artificial Sequence: Synthetic polypeptide
FERRIFPKGLVPLTKDNHIGTTNLQNEPRIFTNDLLTTRPSVDHVPEDQYEPNAAATLSRVPCTVCDRSFNSKRGLGVHMRSRHPDELDEERRRVDIKARWSEEEKWMMARKEVELMANGFKHINKQLAVYFANRSVEAIKKLRQRGDYKEKIEQIRGQSALAPEVANLTIRRRPSRSEQDHQVPTSEASPITPLEQSNREILRTLRGYSPVVCPSKWRAQELQTIIDRAEFEGKETTLQCLSLYLQGIFPVQGVRHTLTRPPRRPRNRRESRRQQYAVIQRNWDKHKGRCIKSLLNGTDESVMPSREFMEPYWREVMTQPSPSSCNGEVIRTDHSLETVWSAITEQDLRASRVSLSSSPGPDGVTPKTAREVPSGIMLRIMNLILWCGNLPHSIRLARTIFIPKTVTAKRPQDFRPISVPSVLVRQLNAILATRLTSSIDWDPRQRGFSPTDGCADNATIVDLVLRHSHKYFKSCYIANLDVSKAFDSLSHAAIYGTLRAYGAPKGFVDYVQKTYEGGGISLNGEGWCSEEFVPARGVKQGDPLSPILFNLVIDRLLRALPSEIGTKVGNAMINAAAFADDLVLFAETRMGLQTLLDKTVDFLSTVGLKLNADKCFTVGIKGQPKQKCTVLEAQSFCVGSREIPTLKRTDEWKYLGIHFTASGRVRCNPAEDIGPKLQRLSEAPLKPQQRLFALRTVLIPQLYHKLSLGSVTIGVLRKTDKLIRFYVRRWLNLPSDVPIAFVHAPPKCGGLGIPSLRWVAPMLRLRRLSNIKWPHLVQSEEASSFIEAEKQRARGRLIAEQNELLSRPAIEKYWANRLYLSVDGGGLREAGHYGPQHGWVSQPTRLLTGKEYLDGIRLRINALPTKSRTTRGRHELERQCRAGCDAPETTNHIMQKCYRSHGRRVARHNCVVNRIKRGLEERGCVVIAEPSLQCESGLNKPDLVVLRQNHIDVIDVQVVTDGHSMDEAHQRKINRYDRPDIRTELRRRFEAAGDIEFHSATLNWRGIWSGQSVKRLIAKGLLSKYDSHIISVQVMRGSLGCFRQFMYLSGFSRDWT

SEQ ID NO: 1490 - protein, 1309 aa, synthetic construct
  source 1..1309: note = Description of Artificial Sequence: Synthetic polypeptide
MEVPLTSSLGSGATQAPGTPELLGEHTVERPGLDQGHSYGLLMDDVELPVRLPFFGPLICPGCRTLLTSEETISSHHRRVHPDARTRWVCYGCDSPFMTYRAIKCHLPKCSGRKVVTGDHICNGCTKRFESQRGLSLHKRRAHPGLRNEEMLEPPVRAERRPNAHKSSIWSIDEIRILEQYEAAYVGDLHINMKIAAHLPFKTNKQVSNYRNDRRKKSRTATDASQQGLGPNDGNRGIVPSGQSSPLFLEGSDAEGDEDVFNVLVPPTLGGLEPAGQVHSLSEGETSPLVGEADPCFMGGTPSAGEASGSTLLGPDPTPADGYSLVRKDLQLSVQTSPLLAVGSVGTESVQFERGVLSCGTPPEFLHPEQFAHCANNDPVLNASEEQVHAPLGEEANDLPDNNHPSELGVDPEDPTCSPATEQVQPSSEEEADDPFAQFKAWRRRVASYALKIETGVLPAQVDDLLRRLRDGDTQSKVTCEEVEEVVLSLTRTILGGTAPKKRVEGRTKWTYKSRTNHEARKRIMYARCQDLYRRRPQRPVERAVGYQAEESLLDNQDERPSHGAFETFYTGLWGKSGQCNITMPPGVPRHTGHVLREVTPKDIYSRLRKLKKDYAPGPDGVTKLKVQSMGAYPSLLAKVYNLVMLTGYFSSCWKEHKTSLIPKDRGSPMDVSNWRPITIGSLLSRIYTGLIERRLRTVSDIHQRQVGFMPVNGCAANLFIFDECIRQAKKEGTIVGSLIDVAKAFDTVPHEAILRALSSQGVDEHTMAHIRDMYSGIRTRINGKGSDIPLVRGVKQGDPLSPMLFNMVMDPLIRDLQRKGFRIGGHEIGALAFADDIVLLADSIDGAQDHVDQVGRYMNKLGMTLNPRKSSSFLITAMRKTWICRDPGLSIGETKVPGARPSSALKYLGVNYTLSEGLESGALIDKLMQAVNRARGLALKPLQKVNLILERIIPKFLYGIILGGPSLTRLHAADKCVRMAVKEILHLHPSTTDHVLYARKKDGGMGIPRLAHLVRLASLRSGLALLASGDVAVQAAGMAGDLEGRCKKVANDLRLNWPVTLRDVVRASNKFKSQESKDWERLASQGHGVKDFRNDRLGNCWLYDPTVLSSSRYTDALRLRTNTFGVNVALRRADKDLEVNCRRCHGKPETLGHVLGECVAGKGMRIQRHDKMAAFVATKCEEKGYQTTREQLFSIEQGKLKPDLVVIDGERALIVDVTVRFESGNALSRGASEKIEKYQPLADYFVSQGAVREANVLPIVVGSRGAITQATLKSLATLGLDVERVGKYLAICAVASSVEIACMHLDYT

SEQ ID NO: 1491 - protein, 1198 aa, synthetic construct
  source 1..1198: note = Description of Artificial Sequence: Synthetic polypeptide
MMADYNNSVDHALEDNTRLIFARDAVLARVCGPFDNLECGLCGVLLTSLQGVREHCHRAHHNLDLTFQCTKCDKGFSSYRGICCHFSKCIGARISVSEGPLSCSECEREFDSKRALSTHERHMHPGIRNAKRLKDFNPRGGGGKTIHGNTKWTEEEVQLLVSLSKRFEGYKSINKEISLILTSKTCKQISDKRRYLNLHNGNGGLAAAEAVLEFCEDSHPEVTESDGAVLSEIMDEECHQSSVTMRSSIVHGDIGREVQGKELVRIPPDNSVMGNCVVLLRKLATDKRSDLDLSKDKELRIDIEKATKANRESADGRVIQSVAGNEIDPDTFQWKELLLGQVRGFPRVDENSELFDLDDKLTKELSSDSPVWNDNCELIVSDLCQVLCKKKYELGRQHHVRKGKRHRGIHHKREKFRECQKIFRKSPRKLAEYLYRDKDLSHISKDASTPQGIEQYYSQLWGEPELLESNTIEEKLPSSSLFDCLPPITPEEVEGRIHKIRPSSAPGLDGVRKIHLVGKGITLVLVKLYNLLFLTGGYPECWKRNRTVFIPKIGKDLSEVGGWRPLTIGSLLARMYSAFLERRIRRVTSLSLSQRGFTNIQGCHVNLTILKEGIRQAKVKNGGVIVSVDIEKAFDTIPHSVIFSRLASQGVPPLLRKIISNMYKDVYTVIEGQCIPIKRGVKQGDPLSPLLFNIAIDPVLRSLEEFQGGLPLGNSAIKILAFADDIILGASSAGQAQQMVDMLGIGLTSCGLGVSHRKCFGFQIVNKNKTWTIVDPMITLNGSSLPFSGPEDRLPYLGVDINPWDRKSRYDAGQRLISAAKRGSQLSLKPQQKINLITAFLLPKFLYILIEDPPSPAYLKSIDHDLRQIYKNILHLPNCVSTAFMYSPKRDGGLGLPRLSCLVPLAHLKAGIKLGSLQDSLVREITTSDRFVRTMGSVAHSLWASWSLTLQDIYKLKSALKRREAKAWESCVSQGQGAAQFRGDSIGNNWLHNPGTYRPGQYIEALKLRANLTGVRVNLKRSGYNVPITCRFCKDIPETQAHVLGLCPKTKGMRIQRHDSIVNRVRDKLKTKSPVALMHEQNFTVEEGQVFKPDIVTILGEVGYVIDVTVRYDDRDYIKDASVEKIRKYEALKGYLKDLYPQLNKVEVLPLVFGSRGAVPGSTVHNMGLLGFTKREMVHISRKVIADSLIISNFLEVY

SEQ ID NO: 1492 - protein, 1198 aa, synthetic construct
  source 1..1198: note = Description of Artificial Sequence: Synthetic polypeptide
MMADYNNSVDHALEDDTRFIFARDSVLARVCGHFDNLKCELCGVLLTSLQGVREHCHRSHHNLDLTFQCTKCDKGFSSYRGICCHFSKCRGARISVSEGPLSCSECERKFDSKRALSTHERHMHPGIRNAKRLKDFNPRGGGKTIHGNTKWTEEEVQLLVSLSKRFEGYKSINKEISLILTSKTCKQISDKRRYLNLHNGNGGLAAAEAVLVFCDDSHLEVTDSDGAVLSEIMDEEYYQSSLTMRSSIVHGDIGREVQGKDLVRIPPDNSVMGNCVVLLRKLATEKRSDLDLSKDKELRIDIEKATKANRESADGRVIQSVADNEIDPDTFQWKELLLGQVRGFPRVDENSELFDLDDKLTSELSSDSPVWNDNCELIVSDLCHVLCKNKYELGRQHHVRKGKRHRGIHHKREKFRECQKIFRKSPRKLAEYLYRDKDLSHISKDVSTPQGIEQYYSQLWGKPELLESNTTEEMLPSSSLFDCLPPITPEEVEGRIHKIRPSSAPGLDGVGKIHLVGKGITLVLAKLYNLLFLTGGYPECWKRNRTVFIPKIGKDLSEVGGWRPLTIGSLLARMYSAFLERRIRRVTSLSSSQRGFTNIQGCHVNLTILKEGIRQAKVKNGGVIVSVDIEKAFDTIPHSVIFSRLASQGVPPLLRKIISNMYKDVYTVIEGQCIPIKRGVKQGDPLFPLLFNIAIDPVLRSLEEFQGGLPLGNSAIKILAFDDDIILGASSAGQAQQMVDMLGIGLTSCGLGVSHRKCFGFQIVNKNKTWAIVDPMITLNGSSLPFSGPEDRLPYLGVDTNPWDRKSRYDAGQRLISAAKRGSQLSLKPQQKINLITTFLLPKFLYILIEDPPSPAYLKSIDHDLRQIYKNILHLPNCVSTAFMYSPKRDGGLGLPRLSCLVPLAHIKAGIKLGSLQDSLVREITTSDRFVRTMGSVSHSIGASWPLTLQDIYKLKSALKRREAKAWESCVSQGQGAAQFRGDSIGNNWLHNPGTFRPGQYIEALKLRANSTGVRVNLKRSGYNVPITCRFCKDIPETQAHVLGLCPKTKGMRILRHDSIVNRVRDKLKTKSPVALMHEQNFTVEEGQVFKPDIVTILGEVGYVIDVTVRYEDRDYIKDASVEKIRKYEALKGYLKDLYPQLNKVEVLPLVFGSRGAVPGSTVHNMGLLGFTKREMVHISRKVITDSLIIISNFLEVY

SEQ ID NO: 1493 - protein, 1009 aa, synthetic construct
  source 1..1009: note = Description of Artificial Sequence: Synthetic polypeptide
MSNYNETNTSGGDNPRMATQTTGSLSSGPINQHTCELCCRTFGTRAGLGQHVRKTHPIESNQSINVERKKRRWSPEEIRRMANMEAQATINNIKHLTQYLATYLPQRTLNAIKGRRRDAEYKELVTGIIANLRSNSSTQQTNQVCNESEMSQRSKILQSIRESVRDLRSRRNKYAKALQELGEAALCGKMLNEEQLIHCIKSMFNTAKCPKGPRFRKTATHSGTNKQQRQQRYARVQKLYKMNRKVAAKMVLEETDKIQIKLPDHDPMFKFWESEFKEGEGMPERMPKDLKESPDLKAIWDPVTEEEVRKAKVANNTAAGPDGIQPKSWNRISLKYKTLIYNLLLYYEKVPHKLKVSRTVFIPKKKDGSSDPGEFRPLTICSVVLRGFNKILVQRLVSLYKYDERQTAYLPIDGVGTNIHVLAAILNDSNTKLSELHVALLDITKAFNRLHHTSIIKSLVGKGFPYGFITFIRRMYTGLQTMMQFEGHCKMTQVNRGVYQGDPLSGPIFLLAIEKGLQALDKEVGYDIGDVRVNAGAYADDTDLVAGTRLGLQDNINRFSSTIKQVGLEVNPRKSMTLSLVPSGKEKKMKVETGKPFRANDVPLKELSINDFWRYLGISYTNEGPERLSLTIEQDLERLTKAPLKPQQRIHMLNAYVIPKYQDKLVLSKTTAKGLKRTDRQIRQYVRRWLKLPHDVPIAYLHAPVKSGGLNIPCLQYWIPLLRVNRVNKITESQRSVLAAVGKTALLTSTVYKCNQSLATLGGNPTMLAYRTYWEKELYAKVDGKDLQNARDDKASTRWNGMLHSDISGEDYLNYHKLRTNSVPTKVRTARGRPQKETSCRGGCKSTETLQHVVQQCHRTHGGRTLRHDRIVGLLQHELRRDYNVLAKQELKTGIGLRKPDLVLIKDDTAHIVDVQVARCSKLNESHVRKRSKYDKKEIEVEVKSRYRVSKVMYEACTISYKGIWDKQSVMSMRRLGVSEYCLFKIVTSTLRGTWLCWKRFNMITSVRS

SEQ ID NO: 1494 - protein, 1455 aa, synthetic construct
  source 1..1455: note = Description of Artificial Sequence: Synthetic polypeptide
  VARIANT 916: note = Any amino acid
  VARIANT 1141: note = Any amino acid
MAGHKITMSEGKLLEVAVRYGGVRNVSYECPVPDCTKTFSQANNLIRHLNNFGNTKHRAHNFTYFFTCEKCKIQIHSNTKHNISNHYKQCCATGGGPSCETGQYFCPACEQAGLGNLESALRHFQSSHPEFNLPPRSQFSKSHPNSYTLSLKPKDHLMKILYSGPLTPGQLVCPIKICLRSSAARLFHDVSKLRKHMLVDHNRTLVYETTCGKCLRPVDTSKNMRKTTSHFEKCSGESFISSPSPIPQKTYKLDLPSTSTPPPRKSPKLQPYKPIRTFKNPLTKSSQSKSDNPPKPTPFFSPRTLERSASWPALSEVVDPLPKLKEKHPSLPCALDKCPPSPRIKPSTLVPPCHTANNSPKPTSPESPSTLKPLPRPIRPSKPLEDWLTVRSVGPDREIVLNIGPRPRPGPAAGSRTTSPPSTAPAKRVAANPIAAPLSGEPGATLDCGQTGRKVQPPKKRPTESAGSLPPPAEPATDLLTGREGLARLVEEYHLSGDFGAFCRDLERWTALSSTNRRPKPRRGRYNRGAAARATRNRGRDDRQDPQDRDDQGGPGPVTCGRPQRYKRAAALRSAFGRDMKATVRRIIDGERGDARCEIDPKTIEGRFRDELSPPVREGPECSLPPWMAEAQAGEHAPSNDSQPGDAYDGPITALEVEMVLSTLNVGSAPGSDGLSYGFWRALDPKGLVLSELFEVCRIERRVPGPWKSSRVTLICKDAEGDLDDLGNWRPISICQTVYKIYAAVLARRLQSWALDGGVISRSQKGFMPFEGVYEHVFLLDSVVADARATRRSLAVCWLDLRNAFGSVDHTTIVEALSRFGAPAGLVEMISDIYTGGSCRIRTRAGFTPDIPVGRGVRQGCPLSGIIFNLVMEVLLRGVEANNACGYRLSCAGGASVRVLAYADDVALVGSSRAEXKIQLGVCERFAAWAGFSFNNKKCAAMVLKHQRGGRRLLDSAPLRLCGEEVAILGPDSFYKYLGAHTGYGRQTGGQLVDRVERQVVRLFTSFLTPTQKLSALKRIVLPAMSFHLRVRPCAEGHLRRLDNTVRRCVKTALRLPKGSCRAFFHTSPDAGGLGITSVVAECDILTVTQAFKMLSSPDHLVSLVAKGRLGMHAARMGRSETASACAMADYLSGDSVMGHXSWKTGYRMPADLWTATRAASRRLSLRFSPQPQGEFGLESGTFKIAPRERRSLTRRLHHRQNLWWRNQWAALPNQGKTVAAHSAYAASNNWVKGPSSLAPQALFFGLKARLNQMPTRSVKACYSRAPNYDKSCRRCGAEVETLPHVLNHCPKSMKSILERHDSVLAEVLAAIPRGTFASVDVDRTSREHFRRVGEALRPDIVARRHDGSVVVADVTCPFESCASALDTAAARKIEKYDQLCANLRQLYRKPVESHALVVGSLGSWGRTNNTALAALGIRGAVRSRLAKQLVNLSVEGSHNIWLRWSGGIPKDLVR

SEQ ID NO: 1495 - protein, 1196 aa, synthetic construct
  source 1..1196: note = Description of Artificial Sequence: Synthetic polypeptide
MLRRGRIFLPASTKAGKTRGRMKWSREVNLFIMRTYYYVTKLETDLTIYRKKLHEHFSLKYPNVIISQQRISDQKRAIERNKLLSQETLDRLKEEVRKQLEDEQTNNVENEKLNSETYSHEYTTLTPQTILTKKTQQHTNIISSTQTSHSSTQTESITLLLENEVDILNTNPTEGATQTQEVKDKFETNLTMYSGMDPKARPPLPKLKYSSKLNELIRLFNNDILVDYISPDTQLSDVHTLTYCTAVTISEQLKYKIIAIEGNARHKKNFKPPWQQRLEKDIAKLRADIGKLTQYINNNRSKKVVQSVEQIFKNTKIHTSHENGNKKSQEFLDTLKQKLALKAHRLKRYNNSQKRKNENTIFLTNEKLFYRNLIKPKTDRDNSNIDIPTAEQLEMYWARLWENSAKHNDKANWITEEKERWDTIEEMQFDDVTEEEITTITARLHNWKSPGIDKIHNFWFKKLICLHKTIAKNLTDIISGNQSIPEFIATGITYMIPKGDFSIEASQYRPITCLPTIYKILTTVITKKINSHIEHNNILAEEQKGCRRGHMGCKEQLIIDSTIMKHATTKNRNLHCTYIDYKKAFDSIPHSWLIQVLEIYKINPIIISFLRNIMTHWQTTLKLKNPPNFVTTRQIAIKKGIYQGDSLSPLWFCLALNPLSHQLHNDRAGYRIKQQDNTETIISHLIYMDDIKLYAKNDKEMKKLIDTTTIFSNDISMQFGLDKCKTVHIIKGKVQPGDYTIDDTNTITAMEPSDLYKYLGFQQLKGLDHITIKQSLTSEYKKRINAICKTKLSGKHLIKALNTYAIPILTYSFGIIKWSKTDIEQIERITRTTLTKHNNLHPKSAIERLTIKRQDGGRGMIDIWHLWRKQIHSLKTFFYIKSDLSEIHRAIAQNDNNYTPLNLKQKELIDNTENLRNRNPQKDMEENWKKKALHGRHPHDLSQSHIDSKASNMWLKTGSLFPETEGFLIAIQDQVINTKNYRKYIIKDPTIRDDKCRKCNTQPETIQHITGACSTLTQTDYTHRHNQLANIIHQQLALKHKLIQNTNTPYYNYKPQTVLENDSCKLYYDRAILTDRTIHYNRPDITLQDKNNKVTYIIDIAVPNTHNIQKTFTEKMTKYTELKEEIVRIWKQKKAYIVPIIISTTGVVPNHIHNSLKLLDLKDNIFISLQKAAILNTCRIVRKFMQLEENQTYYTQ

SEQ ID NO: 1496 - protein, 1209 aa, synthetic construct
  source 1..1209: note = Description of Artificial Sequence: Synthetic polypeptide
METRSMRKRTTRLPEEGAPTGAGPGTGDRASIQRLEDEMVQERSFSQRALPVPRTQNRNGSPINHQGNAASANVAVADRQQSLILAGGRRQRIMWTREMNHYVIRCYYVYTRMETDMPGRVKMLGMFNDRFPRFAHQLDLSKLYIRQRAIILPEELEFIKLEVRREFGEEEAGWRESSRISARLNTIDQNTSRASEDRDLDEPTAPGLSVDIQHQMATAVTQFHGTDPLSRHRLPKLHYSYRLKTAVSIINQDVLPQYLDSVGSIEDLQLIVYSAAVAVVRTLWLRTYPQGDSEGRPCSKAEKPAWMRRLENRINATRTKIGRMQEYQRGNSSMKVVRQIAEMVKPKELRDLTDANITEVLDIHLQRLSALAKRLRRYAECSKRKEQNRMFNINEREFYNWIRNDKPNFREGLPDIGDFTQFWANLCEKPVQHNSEGMRLAEDERFSDGIEDMPVLVVNAQDIREATQYTRNGAAPGPDFVYNFWYKKLITIHEQIAACFNTVLEDSRKLPKFITGGVTYFLPKDQNTKNPAKYRPLTCLSNLNKVLSSVITQKVKDHCDTNNVMTEEQTGRRKNTQGCKDQVIIDAVIVGQAAKKQRNLDMAYIDYKKAYDSVPHSYLLKVLQLYKVDGNVIKLMQHAMGMWSTSLHVTDGKVVLRSRSLNIRRGIFQGDTFSTLWFCLAMNPLSRTLNQQCNFGYLLKSEEISTRITHTFFMDDLKLFAETVQKMHHLLKNVQGFSNDIKMEFGIGKCRSIHLHRGQVLDADSFRANEQEEIRHMVQGETYKFLGFLQLRGIHYAVIKKELQDKFLHRVSCILKSFLSVGNKVKAINTFAVALLTYSFGVMKWSNTDLEALERTIRVVSTKHQMRHPKASVERVILPRKIGGVGIIDIQALCISQIHQLRSYFVESQNRHELYRTVYKADHGLSALHLAQQDYQLNCNIKTVDGKGATWKQKELHGTHTHQLNLEHIDKVSSSTWLVRCDLFCETEGFMVAIQDRVIATWNYRRCILREDVEDRCRKCNSGGESIEHVIAGCPVLAGSAYLDRHNDVAKIVHQQLALRHKLVERFLPCYRYLPDPVQENDCIKLYWDREIITDILIRANRPDILVYEKRKKRATIDIDIAVTLDHNVQTTFSTKVMKYHDLAEELKQTWYLEDIRIVPVIISATGIVPMALLRSLDELELQRELPRIQKAVILRTCSTLRRFLNPYN

SEQ ID NO: 1497 - protein, 1281 aa, synthetic construct
  source 1..1281: note = Description of Artificial Sequence: Synthetic polypeptide
MTCNNAVVFPPADGNPAGTADRNFAIRFPSSEPPGPSGIRPSEPLDGRTGIGDVEHAQAGNGGFLVDVLEYKEAHRYGSKCEFCYVQTKGTVCSKPRTDAWLKCEILFLLHHAYTANQNKSIELAESAFRRAGITRRSKATIAKRWSLIQRGKGTDYKEYWDEYFEKFRYECNPTPIVRRKRNRLAAGLQSPSSVPNGYEFERKRTCETPLDTKASSLPLICNLLTGIVGVENVEENMSVECTEPKELSGTANSSVPGLAEGVYERRHNNVNEPAAGCPQDVPVANNLIDSPTTNDRLEAEFKAQLDRAERSYMRRRLPRLKNLSPDERMWIGTTVERLRLETVSEPVCEQWRLANAGLYAAIRSIAVMRPLDAAREAHKTWLLNMKMTERKLRQQIGWVETTRRTKNEARTERQEIVYRKVAKLRRERFPEMDLDSVSVHLKRKLELLKGRIQVRTAERLRRDTREAAGPYGKTALRGQGFAPNVKDATQYWSGLAQPSGQKCSENSAILSDWKELVECNLSSLPDQMEPLVVQGISRASPWKSPGPDGIFNYYWRQDFIVDWLKQLMLDSLRTGHYPWKLSSGRTVLLYKDGDPTKAENYRPITCLNGCFKMINSVVSEVILKRVENTIALPIEQMALRRKVWACVESQIWDQIKQRKLSDRTQKCKVAWVDFSKAYDSLNHDAIKFVIGVLKLPTGINNYLLDSMQNWSTHLELKSSGKVVRGPSYPIKRGVLQGDSLSPTLFVVVTSIIVRHIKTIESSDIQMYMDDIKLYGKDQETLTRLIKELQTVSNKLGLCMNLKKCAILGDDLPEEINGIEHLKESYKYLGVPQREITQVRATMAALEKKILTEVDTSLGAAELSYRQRISRVNSKIAPLVRFVVQSMLVTPRDVLKVYNRLGGIDVEIRRRLVKYEIRYKKSNVARLYLDRKVGGIGFVNLCRIMVEAVAARAVYCRLAPSFNEFQDFLAEQNTSPITAAQTILDKCGINIELSTSTLGDVKKIVRNHYHELWLTAWKNTGLYKRWENDHVDIKRSSLWINRGNLSANNARIGIGIQDNSIFCRGFVGNKCDTKYCRLCGDGIESVSHIVTGCPTHRTNLYIERHDCVARNVYAYLAIRYGIPVPHYTQRVKTIEKNGDQSVELYWNYKFPCTRALEACRPDIVLIDKVSKRTHIIEVAVSWRGRLQEMVDRKVYKYTVNGEYEADGSSRGWNIVRELNDQYGFPVEVYTLVIGAGGEILPCTVKDVERLTGGAATDNLIERMERSAVLGSCRIIKRHLAL

SEQ ID NO: 1498 - protein, 1354 aa, synthetic construct
  source 1..1354: note = Description of Artificial Sequence: Synthetic polypeptide
  VARIANT 69: note = Any amino acid
  VARIANT 444: note = Any amino acid
  VARIANT 854: note = Any amino acid
  VARIANT 907: note = Any amino acid
MISCDLERETLTQMALFRARSDKTPTHAGIPAPDEVREGGCGQNRTNPAAPRGKAAAIQRQNGITIPIXACAQSGLVRTQRVQQWSAVEESALKDVVVRNTDDRGLINWAKGVLPEWQRLCQLNPTMYMARSSPSLSNKWASLRRTHVGPGCPSKEGSGPSQDLSDVKIQPARLAHDTVAELPQRTVPCGTDGHGVIDSDETETALAEVSRSSPFGEREPLDLGATERITRKRLRNAVRDVVPPRKRRVPSTPSRKEQDLVPEVDGPAPTDVLTHPPTESEPEPMLDPLSLVQLVRPQLGRAMGWAAEEMELGNVVMDVELKREFNREVRRVGRTPPDQMYKRGAGPPLPQKREPERVALLEQLIAARVERGINRGLDWFLELNVAVFAAARVLSRRERVETLADRLHINDSATLSEVSRRRAKAERKLRCAREQPWMSRRIRXLGVRVERLKQLADLVRQRIAGRGNRSSYEGPRRRFRLRPSLRSVTEAPVNPPLNGNEVYTFWHSLWAQSLRANTDDCQLREFKNQLSAARHTDLTSVGTSSLVQMFSAALRKMKKGKAPGPDGIRAAWWGVFRRIAPYVATWVVRVIRGAEPVANWICNGLTVLLPKSSDNADPSNYRPITCLNTCYKLFTAVIAQITASYVDVLGGLPRQQVALRKGVWGTSVSLMIDALTVADARRAKRPLGVCWFDFKKAFDSVPHNLIRWILRVIGLPPVILSVIVSVMDQWATRLKIGGKVMPKTIPVRTGVFQGDTLSPLLFCLSVWPISFALDQFPQYQFRCANHLQQGFSVGHVFYMDDLKCYCPDREVLTAVIQQVQKSASALGLTIHYKKSAWLDQDGGKSGKAVLGVPXLVGTYKYLGMHERFMIVSKDSLESVRGKFMGRLKTLWTSKLTFGQAMLGTKSXCMPVVRYVLQNLFLPKSEFNQTRLVLREWDRQIRDLLDECNIRQVFRSKTELYVSREEGGWGLPSMEDALEEEVVTKLAILVARQETEPLFRVCEALERKRCPTPLSLGLQILKDWGVGVELQGRTLLLNGNTVGPSQATRKLTGELVLRREAERLSRWRSKVKPGCGMTGGAWRDVPGIDVHLSNRWLVKGALSPTVVSNSLAIRANTVILRGSGGGYTKGTLLRCRGCGNTGETRRHIVSACSLGRQKGAASRRHDNVCRILVRAICHKLNIEPPNSANFPHVVVLEGSGAKMWIDFPFVVPHKIRHTRPDIVVLFEWNGVRRLSVIEVAVSDVANMQTQHIRKSHRYGTNSTEPFVAGVTPTYRNDCLAAQLRAKFKAQQVDVIPIIVGTTGETLDGEFGRIRKGLPMLTKLQMPRLWSEIQRAVILGSYRILVEHLALPKGGA

SEQ ID NO: 1499 - protein, 1284 aa, synthetic construct
  source 1..1284: note = Description of Artificial Sequence: Synthetic polypeptide
MKMSHNRDTPSNGVKGTSVRLGTSLVRSPVGEAGAVRERGTHPSESVSQDSDASVNATGEGSVREQAPLSPPGAEEATVPTQRRTRHKWSREDRVVLWECFVASKREGPGYLKRLKQLWDERGIPGNFPQASLSGQIRQICSKNLLSEEERLQIAARMEAQVASPSADEPARQVPTRPVTPPRSPPVEPARRPSIPSEETPDLGAVPSEIDSADPNRSPSRGPRHLPAHNMSQSESEDDVTDPDVSDQQRSDSLEPRDLLRNSSVESTPGHPNQELSDTLLSNYVPSEIDSDDPNQSPRRGPRHLPAHDMSLSDSMDEETEPDLSDQQRSDLLELRDLLRNSSVETTPKGHPSLRHLPEPKIRAAAFRVNSVIGKIHTNNITETNALIKAGADLAVRILEVQPRPQRTQRKKDPPWKHRLEKNIAEIRKHLSWISEWRRGNLHDEEKKTLLESRYRCLEVGLTNLEDTLKQRLSAKRSKVRRFEARVAGFHQNQLFNTNQKRLYQTLRGEETSSDSPNAEESIRFWSDIWSKEVRHNNTAEWLHDVKEKNVAADPDLTITSQQLKKQLSKTKNWKAPGPDMVQGYWIKTFTSLHSRIAAQLNHCLQRGTVPTWMTTGKTVLIQKDKAKGTEVSNYRPITCLPLMWKVLTGIIYERVYQHLDSKKLLPDEQKGCRRNTRGTKDHLLVDKLLTKDARSKKKNLSMAWVDYKKAFDMVPHSWILECLDIYGIAGNIRNLIATTMPNWKTQLTSANKHLGEVSIKRGIFQGDSLSPLLFVLTMIPLSETLNKAGQGYNYSRTMKLNHLLYMDDLKLYAKSKDQVEQLLNIVHQYSQDIKMQFGVSKCGVLNIERGEVTASEGITIEEGTIKDIEEAGYKYLGVMEYNTILHRTMKDSIRKEYLTRLRLILKSHLNGGNTIKAINTWAVPVVRYSAGIINWTKKDCTDMDIKTRKLMTIYRALHPRSCVDRLYINRREGGRGLISVEDCVEAEKRALSQHFRESDDPWARCLVEAKLLKETETADQFKERRRLDRTNKWKSMKMSGQYLEAVQDKIVPDSWNWLLRGELKRETEGTILAAQEQALRTRYIQNKIDKRNVPSTCRICRSSDETINHVISECGVLAQKEYKRRHDKVARHLHWTLLRIHNFPVSERWYEHEPAPVVENEAVQIYWDKRMETDRVLHANRPDIVVKDKQEKSAKLIDISIPFDSRIVDKEAEKKEKYRDLAIELQRLWQMKVDVVPVVIGALGAMSKNLKTALRELKCGHLHPGTLQKSALLGTAHIIRKVL

SEQ ID NO: 1500 - protein, 1261 aa, synthetic construct
  source 1..1261: note = Description of Artificial Sequence: Synthetic polypeptide
MVFNNCKPKHLCPAIRPTGQQETNGGSEGTAEPTAGPSRPAVSEDAAQPVPLFEEGEYIRAHRDKTCPYCEVLWIGARSSKARSDSWPLCQILYLMKRNDDLRGQRTRYPLLESSLRAAGIARTKFAIIKCIRNVLRDRYVPNGPYSEHWKIYRANSGEVPQGATITKGKRSARVAGLPSPSQSGHHTKRIQAGTGIETETTVTETNTTPEVSHEHRDPCGEPETSAANVDKVTELTEDGSETRGTANVANGGVSVSDPGRKRQSSSQNRGNIETTNPELVGMWEDMFGVQLDGAMRTTERPRLPKLKHLSEPERLWIRAKLEQAWLQCVSYDVEQQWLNANAVLYAAIRSVAASRPCKEAREAQKTWLDNKKKDEAKLRRLIGRISSVHSMPKGDRTPREKKLVKNITKLKNTHYPDMDWGGLLNHFKVKLSQLKEKISVRVAEHKRKVNRNAAGQYGKSVAGSAGLAPDVVSATAYWSGLAQPGPKKFKASSPIFQTWKDDVAKNLNTEPVLLYPIIKECIRKPSPWKAPGPDGIYNYYWQQEFVAQWIQTLVKRTLDIGRFPTALMCGRTVLLFKSGDKSMPQNYRPITCLNGCFKITNAVLTKVILQRVQDTCALPREQMALKPKVWSCMEAQLRDQALQSEIGDDCKTAWIDFSKAYDSLDHDALRFVIQTIALPAGMEEYLLKSLDSWRTQLVLSDAGKVVSGKPYPIKRGVLQGDSLSPALFVLTTSPIVAHLQRTCPTGRIQLYMDDIKLYGKTESDLCMLIKETQRVANKLGLNINLKKCALFGKSIKQSIAGFDPLGDRTYKYLGIPQRDVADIKQAYDELKAKTVQTIGETMACDYLTTRQVINRLNSKIPPVVRFVTQSALCSAPMTRGLYNKITELDNVSRAELRKVLIYKATNVSRFYLATKEGGFGYASLQQVFVEAVVSRAIYCLRAPSLCDIREFILSKFDPVKVARIALARSKIDMDIERMDMASATRTIRQHYQAKWKTLFQQSKLYQKWVQHKIDIPNSSRWLQRGEISPRNCRIAVAVQDNTLLCRGFVGSKDPNKQCRLCNAGIETASHIVTECSTHRVHMYIERHDSVARNIYAVLAKNCGFWIPHYSQKIPTVKITKSYELYWNYKFPCTQALEACRPDIVLIDRAKKRILVVEVAVSYVTRLEQMTQRKLYKYGVNGEYQADGETRGWNICRELVQKYNMRIDLCIVVIGACGEILPCMVKEIEKISKVSGRQLLERCQRSAVLGTVRTVRRHLAN

SEQ ID NO: 1501 - protein, 1360 aa, synthetic construct
  source 1..1360: note = Description of Artificial Sequence: Synthetic polypeptide
MRKSFLQHIPELSSHIAMSVPARNYPKMCSLAQGSSGTLSHNGKGVAMHRCPSDDCAGKDPPQRGSQKGNLRSVRWTPSEEKAVFEYWSRLEQHAMLNGSEARGTCAITRSQFLIHWDGERESRSLSDGVPEYPMRTERAYYERVRLLRQRGWQWDCANECLVIGQCAEPCRKPNVVAIKADKGMKRSLVKGKLLSLPHVMGEINQVSVQVEVPLPSVPASVPQVEGVESKGFTETEPSNKPSLEGNPAEEGLRKPERVNVPVHGIISDSERKDLKDRFWSAYKTAKRSVGFRPALKIEPNRVNRAQWEVLDSCVVEVLKKRETSNGYRGCVLRHLNVAVYAAGYVLAEGNKERRQVIRRQSAEWLLRQKSEINNIRRHIGWITDELTRRRTGKNPTSRQLSNFAWLQRRYQVLGKPVRETRDLEVQRERLVSRLRLAQDRINSSMDREERVRKRMLPLRRKLEEPLGDSKLDTKQARTFWASLIGERKEFGKIPELENWAEEVRSKVTDGQGFASDHVDQTVWKKILGKARPLKAPGPDGIPNLLWKRLPSANQALFKWLMGIKRKQLSVPSWLTKGRVVLLPKGGDPVDPANYRPIACLNTQYKLVTGMVTAWVSEHLTTYSILPIEQRAMVSGTWGCTHAMVIDRAITSYAEATGLPLYVGFVDFAKAFDSVSQPWIRYALKVAGVHKRIRCLIGILMKCWSVRYEVFKSGRVLRSAPLAVKNGVLQGDTLSPLLFCLSVAVVSSAVGSLFDFEVTIPGRGVMQQQNHLFYMDDFKGFAPSEASLTRMLVTLERTASALGLKINKRKCALVHPRERENEETGSDIPVLGLRDTYKYLGIEERFGIVFEDAWDRVRTKMFERMRTLLCTEHTFGELRAAFASTIAPVARYLFLNVIVGGPSWSETLTKAKDMDLRIRRLLWERRDNEPGWRFKHCSADRLYLRVQYGGLGFVSVEDTLSESIIYCWAYVQCRPELELARELFGTLNRSARSGIKQSIAKGARKVFRSYALLSKNSAQRVSDLDGDASPGFRVGEMIFMEPTRGARAIVKILRKENDSRRLAAWKGRPMGGRVVSLPELDQVHSYHWLIRARIGRRSFRDCIAAQEGQLKARELMCPHINAKAKWCRRCGDGRVETEQHILSGCAWSRTGTMLDRHNGVVRQVHTALCRKYGLPVSSHVVPLHAVIENEHAKILYDVALHTSPAGVLPREDGSTSYTGLRSTRPDMVIFDKKARTILIVEISVPWRENLVKQELIKWRKYAINSMIEPLELAEAEIPGPNLKHALGLAYGTSFPTVKVVPIVVGSCGEVLPNITKRLSELGIPKRGIPSLLESIQRAAIIGSGHVIRAHLSVPRSESET

SEQ ID NO: 1502 - protein, 1000 aa, synthetic construct
  source 1..1000: note = Description of Artificial Sequence: Synthetic polypeptide
MQKFSVPKDSSQIFLVDSILNKHICSTKNKVKDVIKRRSIIKTLICAAGLTLRKLVCGKLGNNKYNSKINQLWKKERKIINCIEDLKHLIETNKRRHNFGKRLRNAKVSPSEMLKDYYNKLRYIKNEITACLDEHKKAILRTKFKLTPSIKIISNIQNHNDEEAELPKEEEFVKYYKELFTNKDGDDKETPHLDNWLKKFSKTLIVDWTINDKEILEALKYCGNFKAPGSDMVMKVCYKWFKSAQNYLIRWIKSTWYGEYTINKKDTNAVTFMIWKRDGKPKNDVKSYRPISCLNCDFKLLNKLIANKIYESIEKILPINQMAVIKNKHGTCEALLLYKSLVQSMKFRRTKDVKEIWCSWIDFSKCYDSISHKCLKKMIQSIKAPPIIHKLILDGIDSWNISICNGKNISKTKIPVKSGILQGKVASSLYFVLLTGEISYALNKEEQVPIETITPSNTLKINHISFIDDYQLYATSQKKVEKLTIKLREIAEEMNLKLNPQKCGIYGTDDLGKRLMLKESSLNFPYTSEYKYLGLVENSLDLKDINIQLFKDKILSKYSTIFESRLTTHQKRKVFNSTISPCAAYYLGNLITNKCSIQELLNECKKFDQMVRNQLVNQNIKKLQVSNSRIYLPKEYNSLGLNEIEIEVAANIIRKACYIKKRETLRGVDKLYIAMSKNGHRNTLSDALYITKKYSNFQINWNIMGMVKDQNNILLDAKKIIENIKEKRRNLWLEHWKKGNMTYANEAIKKEFHLPDLNIDSKYLMLCYAGSEEQIIYNGHVSLVNQSSPSSRLCRKCNKLEETSYHVASVCEFHKKNLHLMRHNSAVYHIITELCRIMKVKCTLRYPEASGIIKSGNMKIAAGVKYTFGTAKIYHNKPDLVWYTPEVIYVIEVSISSLKNAKSQMKMKTARYAVNSTKKLENFAALNNLKKGENFVEILSHKANFKRVHFMPLVFCTFGEIPKETMKYLEKLNFSNEKIKTIASPIARYTGRTLKAHFTN

SEQ ID NO: 1503 - protein, 1292 aa, synthetic construct
  source 1..1292: note = Description of Artificial Sequence: Synthetic polypeptide
MISRSQADRPVEGQPVTAMSFHNLEPNNLYPENLRPTGSQDANRGVADIAEEVTGPSGLVTNEEAARAPPLFVEGEYKRAHCGGGKCHYCRVLWIGARSSKARTDSWNLCEILFLINKCMELGNVRRIYSPLESSLKEAGINRTRHAIVKCRLAVMRDRFVDNAPYSEHWRLYNACAENRAVVVPMDSATTVKKRTARQAGLESPSQIGVAGKRVHEAETGTDRINAVIETNTTPLEDIDLSPETPEGLAELPSTVEIMELTEDGSRSRGTANDADGGVSISDPLRNRPSSSQESRNVPEQVDPDGELVWESLYGAQLRGAMRTTDRPRLPKLTKFSAAEQLWIKSKVEKARLECVSYGIEQQWLRASAVLYATIKTVAACRPYNKAREAHKVWLENKRAEEKRVRRIIGRIETVRTMPKGKRTDKQIRLARKINRLKRVSFPEMDWHGFLNHFKAKLDLLKKLISVRVAEHERKISRKIAGTYGKSVSGQSGFTPDVVAATTFWSGLAQPGPKKFKKNSLIFQTWKDSVVENMNTEPVLLHPLIIECMNKPSPFKATGPDGIFNSYWRQGFIANWVKSLIQRTIQTGEFPASLMCGRTVLLYKNGDTAKPENYRPITCLNGCFKMTNAVITKVIVQRVQDTCALPGEQMALKPKVWACMEAQLRDQALQSEIGNDCKTAWIDFSKAYDSLDHDAIRFVIETLALPDGMEKYLLKSLESWKTKLVLSNRGKVATGRPYKIKRGVLQGDSLSPALFVIATSPIVSHLKRVCPSGRIQLYMDDIKLYGKSETELRMLIKEVQKVANKLGLQMNLKKCSTYGAGLTESIAGFDPLGDRAYKYLGVPQRSVADTNLAFGELEGKVIRSIEETMACEYLTMRQVVTRLNSVIGPLVRFVAQSVLTSQAKVSWIYNKISDLDSKIRAKLAQTGLRYKKSNVARLYLSKSKNGIGLVNVQQVLVEALVSRAIYCLRAPSLVEIREHILTAEFDPVGAARTVLRRSRIQLEIERVEMASAISAIKTNYQARWMTKFTQSKLYQKWVHHDIDLANSNLWLERGEISPQNARIAVAAQDNTLLCRGFVGNRESEKQCRMCNMGIETCSHILTECSYHRAHMYIERHDSVARNIYAVLAKDHGLWIPHYSQPVSSVTKTPTCELYWNYKFPCTRALEACRPDIVLIDRAKRTILIVEVAVSYVTRLKQMVSRKVYKYGVNGEKGADGESRGWNMIRELSEVYNMKVNLCAVVIGASGEVLPCTVKAIQSISSKTSSRQLLERCQRSAVLGSTRVVKRHLAEFH

SEQ ID NO: 1504 - protein, 1177 aa, synthetic construct
  source 1..1177: note = Description of Artificial Sequence: Synthetic polypeptide
MEILWEDLRLKIEDRYGVTLPQRSASSLKNQYPKVILRGLPDSGLPWAGVQVNDTGQVVVVDHAEAATLRGSSPAAVDGEAEEPVVPPLPAAEVVESAADAAVPDPQSEIVADQGVETRPVENPPANSRETETEPVEVEPYLEGQYKFFVSKILGKSMWRKPIKYPRRVPETLWRQANELIERSIRQGEVSIQSLNCMVYAAGCAVKSSLDKKDQEAKRRESEWYACRKAEIKALERYLNFIDLELKRRSASRPLTSRQRQNLGVLITKYGRARVRSGVRLSELQAMLRDALVGIRKCMAKRSADKKRKQGKFVPIQRYLEPSSAEPRLSPDTVRAYWNDIVGSSQQSTSDSTIQDWSSNLSVPSQELNASKIMGWWRAAVSKSKPNKAAGPDGIPGVLWKRFRSASEWVCTWLYRLLQKRRIITPRWLSVGRVVLLPKKGPLEDPANYRPIACLNTVYKLITSVVEMAVREQIQACPGLVPYEQIANRKGVWGCTHASIVDRMITGASREGKGGGFPDLRVLFYDCKKAFDSVNRDHMFAVLRVANVNVKVVHLLHTLSQQWCVRYELRRNNRVERSSPLRVKRGLLQGDTLSPTWFCLCMAPISASIKTLNPGPTLRPNMGNGRNRGQVAIQVSHVFYMDDLKVYCPRVADQRRMEQNIPQLFGEIGLSINASKSAAAAAVGRYVESELPVLGTKDEYKYLGIESGFVVNEVAALDRMQAVLLNRVEAILSVKEHTVGQRRDAIRAKAIPGGAYILGHIILSDLDPRGAAERMRRLDIEIRRLVKSAGILHDKCSTARIHLSCEQGGLAWPSMERAYYVAVAYSASYLLTSQDETISRARDYFVSGRLSNKFTVYKHLTSIVDSLGLSVELPDPNGLPTGQPSVLARTIARAIDAKLEAQWKETLLTYQRAGRVERADPTVVDHANSYHWLRKAWINEKAYQHAVSVMEGTLLEGVNPHGVLTMCRACKAPSASIAHIITGCAELRKSHMKVRHDGVTRWLYNALTEVDGSLPKFHYTQQIPAEMRGERLTVRYDSDIVTPNKPRHNRPDLVVFDSTRKVIYIVEVSVTWLSVLQKQYDNKLNRYAVNSNHEFSESIPYPPGVNLANEIRVLYPQFTGGVKVFPMIISPTGEVHMQFVPHLAELLENPNIPRILEKIQRSVVLGTDYIIRSYFAM

SEQ ID NO: 1505 - protein, 1353 aa, synthetic construct
  source 1..1353: note = Description of Artificial Sequence: Synthetic polypeptide
MPCSTNSFFERGTPEPHREPISGTDSSESLGMGTHRSPRLNDDEVINGPKGHESDPVHVVRAPRTLHPRRLELPIGVNNLGEASQLRQDSAIAEEAQLESTENHDGRRPPLRGGRKLWSEKEIATLRRLCEAYGNRQVCWKEVQRKFADFHEERTVAALATKWGALKRPRAPMVGAPPTPDHDPERGPAGEGDGGTTSQENVPTDDPIPANGPTEGKESDVRPAVACRCTEPEEQLMESDVRPPAVVRLADPEQHTMKSGVKPVALDGSADLEERPKEKDIEQMGVDFEGEPRFRAFRKAFYGYFRWAVNSFDREPVKRVRRDCPKVFYAYADYLIATGSSKALGPNQSRIGRLNGLVYAAARTIHQFWREEVGHRQQGEKGWYTKTKATREDLQMLISMMESELARRKEKRKPGAKELENIHKLVARLGTRSTSGIVRRLEMTRQRLKLLEDRISLHEQEKRRKRLRKQFAETPSLKLLTKGAKDRGDTMVTMKSVMDFWRPIIGRRVTSNPDQLQVLRDWRDEQKKAYPADLDLEKADLEEKYEGAIRRIQPWKAPGPDGLHAHWWKALPSAKRLLGELVVDWLTTGKVTTGWMCRGRTILIPKKGDRGDPSNYRPITCLNTCYKVLTSVMNSVILSHLSRGEALPMNQRAMRKREWGCTHAMVLDRAMVMDAMAQKKHSLSVAWLDYRKAYDSVSHEYIRWAINSVNIPRSVQLTLKRLMSDWETRFESTQCRPKLRSDKMKVLNGIFQGDSLSPTLFVLCIAPISYALNKGVGQCQSSSGWSAGYGFEIGHQFYMDDLKLYARTPAMLDSQIQVVSEVSEAMGLHLNLSKCAKAHYAPHGAGGAQEAVEGAEGSRKGEIPILGLRSTYKYLGVEQRLLPMEVALKEFEDKFMDRAETIFASELTWGQMATAYNTIAIAGLRYVYSNTNGASPKLLEALKRAATLDTRIRDLLRRHKCRFRNSFVERLYIPRECGGYGLKSVEDTLRESILATWSYIATNPHLAGQQYFFERLAARGKRTPMADGVKILLDLGVEPQVDLKRRTVTVDGIVFEDPTKLHRYLVGKLLKARTEARIRRWKEASLAGRLVNDTSIDMRLSCLWMKKGFVSARNLRDALAVQEGSLLTRACPALKGKGGQEVCRCCHAAPETAEHITSACRYWLPSLYVERHDSVARNLYYVICCRYGITPVHYSNRVSPLSENSQCRVLWNMDMQTRTPMKHRKPDIVVFDLKREKILMFEVSIAHASGLLKQREIKINRYTVNSEELPDETITPYPPGPNLAADLAATYGWQVEFAPVVVGTCGEHVPAVKEDLQRTLDLKPHQVEALLERISRSAVIGTARVVRAHLACS

SEQ ID NO: 1506 - protein, 1368 aa, synthetic construct
  source 1..1368: note = Description of Artificial Sequence: Synthetic polypeptide
  VARIANT 435: note = Any amino acid
  VARIANT 572: note = Any amino acid
  VARIANT 607: note = Any amino acid
  VARIANT 611: note = Any amino acid
  VARIANT 757: note = Any amino acid
  VARIANT 1272: note = Any amino acid
ITYTANMALVTLFMENMENKRYNLRPLPGGRRGASGANAGCHSMRTVGDGGLSRRVPLEKNVTAEQSSSPLTSSSSHSPVSSIPSPSSTRTLLNSPNSSPTSSHSSLVIRSADVVQEALANYPAPTAGSIRARKKWTDIMNRYIWRTYLIITKCETTLLNNYLEPLHQEFSSKFPEMQVTRQRIGDQRRAIIRNKLLSDDTLAQILIEVKELLQIGDQPLTQNNIHSTQLSHSNTRIKWSNELNEEIVKCYFEVTLLEVNKTSYRKNLYSLFISRNPHLSHLTEQRIADQRRLIFMNKSVHNDRIIELKREVEIKLANSNSLTKNITESNSPSSQTNEINDSAYVQSNLQPVEPLDQHCINRHNLIEKHYVEQEFNNALIQFNNTNPETRPYIPRQKSSRKFSQIVSFLNSEVLPKHLNNELDFNALHNIIYTAXYTASLCNGTKFSFIDNYRPRNSKPSWQRRLESRIDKYRLQIGRLTQYISGNRNRKILKTVEEIKTQYKIHSHHEEPNTELPHFLDTLKQKLNATSNRLRRYLTCTKRKQQNNTFVNNEKHFYRTLSSTNQNTTTQLXEHPTENNLQQYWANIWETSIEHNADAEWLNKIPDXEINXMKFKDISIETFNQIIQRTHNWKAPGTDNIHNYWYKKLTCTHSLLLKHINQFIQSPCTLPLFITNGITYMLPKGLDPTNPANYRPITCLQTIYKIITACITDIIYKHIDQNNILAEQQKGCRKNSQGCKEQLTIDAIVMKQAHNKNXNTMYIDYRKAFDSVPHSWLLYILKKYKIHPILITFLSSVMLSWKTRLKLINNNETLITDWIKIQRGIFQGDALSPLWFCLALNPLSELLNNTNTGFKLKHNNTYHIISHLMYMDDIKLYASNNKELKILADLTQSFSTDIRMEFGIEKCKVHSIKRGKSQQNTYILNTGEQIESMDENSTYKYLGFQQAKQIQQKQTKIELTNKFKFRLNQILRSQLNSRNIIKAINTYAIPILTYSFAIINWSQTDLSNLQRIINTHMTTHRKHHPKSCIQRLTISRLDGGRGLIDIRNLHNNLVTKFRNYFYAKAEISELHKFIVNIDNKYTPLNLNDRNIQLNQTLITKQQKIEAWSLKSLHGRHLADLSQTHVDKVASNEWLRRGDLFPETEAFMMAIQDQVIDTRNYQKHIIKRPNMVNDLCRRCYSSPETIQHITGACKTIVQTDYKHRHDQVAAIIHQHLAFKHSLITQAQKTPYYKYSPQAILESTNFKLYWDRTIITDKTVHYNRPDILLHDKVKXSVYLIDIAIPNTHNLASTFSNKIDKYTDLTIELKSQWKVQSVTTVPIVLSTTGVVPHTLHTSLETLGIHRLSYILLQKAAILNTCRIVRKFLSSNN

SEQ ID NO: 1507 - protein, 1136 aa, synthetic construct
  source 1..1136: note = Description of Artificial Sequence: Synthetic polypeptide
  VARIANT 5: note = Any amino acid
  VARIANT 131: note = Any amino acid
  VARIANT 269: note = Any amino acid
  VARIANT 354: note = Any amino acid
MSGTXTDRVIPARTSPGSTRSASGVGEPGPPDVKLATGTRHSWSRAENVVLMECYYGSNPSERGYMQRMWEKWVLRNPTSSLTKKQLLAQCSNIRNKKLLSQLEIDEARRCASPTVQICYGKGEPGRQVSXGVISSSPPNIEIGYKAPMTDGLGTRAADLRERIMKSWGNSTTSLPRLTHKVPDQSLLEDMNTALSTIPTTTITETNQLMYAAATVILQMLGYKMKSMNSQKEQMAPWRRRLEAKIMATRREVSLLTELSRGVNLRTEXPKKYNKLSTTEALETAKQRLTALATRLKRYTREVEARRINKVFSTNPAKVYSQWQGNKMTTDPPRAETEQYWKSIWEKEATHNTXAQWLQDLQTEHSQLPEQDPVVITLADIQTRVSKMKSWTAPGPDKIHAYWLKKLTALHERLAAQMNQLLTSGNHPEWLTQGRTVLIMKDPQKGTIPSNYRPITCLSTTWKLLSGIIAAKISRHMDQYMSRAQKGIGNNTRGAKHQLLVDRAIAQDCRTRHTNLCTAWIDYKKAYDSMPHTWILECLKLYNINRTLREFIQNSMKLWNTTLEANSKPIARVSIRCGIYQGDALSPLLFCIGLNPLSQIITKSGYGYQFRSGTTVSHLLYMDDIKLYAKNERDIDSLIHLTRIYSKDIGMSFGLDKCGRMISRRGKVIATDGVELPEGNITDVQDSYKYLGIPQANGNHEEAARRSATAKYLQRLRQVLKSQLNGKNKIQAINTYALPVIRYPAGIIPWPLEEIQATDIKTRKLNGKHKIQAINTYALPVIRYPAGIIPWPLEEIQATDIKTRKLLTMHGGFHPKSSVLRLYTKRKEGGRGLVSVRTTVQEETTSLREYIKKMAPTDRLLSECLRQQKPTKEEEPEGLSWKDKPLHGMYHRQIEEVADIEKTYQWLEKAGLKDSTEALLMAAQEQALSTRAIEARVYHTRQDPRCRLCGDAPETVQHITAGCKMLAGKAYMERHNQVAGIVYRNICTEYGLEVPGSRWETPPKVLENKQAKILWDFQIQTDKMVVANQPDIVVVDKHQKTVVVIDVAIPSDSNIRKKEHEKLEKYQGLKEEMERMWGMKATVVPVVIGTLGAVTPKLSRWLQQIPGTTSEISVQKSAVLGTAKILRRTLRLPGLW

SEQ ID NO: 1508-1529 - skipped (22 entries)

SEQ ID NO: 1530 - protein, 25 aa, synthetic construct
  source 1..25: note = Description of Artificial Sequence: Synthetic peptide
KRASSQALGTIPKRRSSSRFIKRKK

SEQ ID NO: 1531 - protein, 7 aa, synthetic construct
  source 1..7: note = Description of Artificial Sequence: Synthetic peptide
RKKRKKK

SEQ ID NO: 1532-1533 - skipped (2 entries)

SEQ ID NO: 1534 - protein, 5 aa, synthetic construct
  source 1..5: note = Description of Artificial Sequence: Synthetic peptide
EAAAK

SEQ ID NO: 1535 - protein, 5 aa, synthetic construct
  source 1..5: note = Description of Artificial Sequence: Synthetic peptide
GGGGS

SEQ ID NO: 1536 - protein, 4 aa, synthetic construct
  source 1..4: note = Description of Artificial Sequence: Synthetic peptide
  REGION 1..4: note = See specification as filed for detailed description ofsubstitutions and preferred embodiments
GGGS

SEQ ID NO: 1537 - protein, 5 aa, unidentified
  source 1..5: note = Description of Unknown:Thrombin-sensitive sequence
CPRSC

SEQ ID NO: 1538 - DNA, 16 bp, synthetic construct
  source 1..16: mol_type = other DNA; note = Description of Artificial Sequence: Synthetic oligonucleotide
gcgcgctcgctcgctc

SEQ ID NO: 1539 - protein, 4 aa, unidentified
  source 1..4: note = Description of Unknown:RT domain motif sequence
YADD

SEQ ID NO: 1540 - protein, 4 aa, unidentified
  source 1..4: note = Description of Unknown:RT domain motif sequence
YMDD

SEQ ID NO: 1541 - protein, 4 aa, synthetic construct
  source 1..4: note = Description of Artificial Sequence: Synthetic peptide
YVDD

SEQ ID NO: 1542 - protein, 427 aa, unidentified
  source 1..427: note = Description of Unknown:[Eubacterium] rectale M104/1 sequence
MDTSNLMEQILSSDNLNRAYLQVVRNKGAEGVDGMKYTELKEHLAKNGETIKGQLRTRKYKPQPARRVEIPKPDGGVRNLGVPTVTDRFIQQAIAQVLTPIYEEQFHDHSYGFRPNRCAQQAILTALNIMNDGNDWIVDIDLEKFFDTVNHDKLMTLIGRTIKDGDVISIVRKYLVSGIMIDDEYEDSIVGTPQGGNLSPLLANIMLNELDKEMEKRGLNFVRYADDCIIMVGSEMSANRVMRNISRFIEEKLGLKVNMTKSKVDRPSGLKYLGFGFYFDPRAHQFKAKPHAKSVAKFKKRMKELTCRSWGVSNSYKVEKLNQLIRGWINYFKIGSMKTLCKELDSRIRYRLRMCIWKQWKTPQNQEKNLVKLGIDRNTARRVAYTGKRIAYVCNKGAVNVAISNKRLASFGLISMLDYYIEKCVTC

SEQ ID NO: 1543 - protein, 420 aa, Geobacillus stearothermophilus
MALLERILADRNLITALKRVEANQGAPGIGDVSTDQLRDIYRAHWSTIRAQLLAGTYRPAPVRRVGIPKGPGGTRQLGITPVVDRLIQQIALQELTPIFDPDFSPSSFGFRPGRNAHDAVRQAQGYIQEYGRYVVDMDLKEFFDRVNHDLIMSRVARKVDKKRVLKLIRYALQAGVMIEGVKVQTEEGTQPGGPLSPLLANILLDDLDKELEKRGLKFCYRADDCNIYVSKLRAGQRVKQSIQRFLEKTLKLKVNEEKSVADRPWKRAFGLFSFTPERKARIRLAPRSIQRLKQRIRQLTNPNWSISMPREIHRVNQYVGMWIGYFRLVTEPSVLQTIEGWIRRRLRLCWQLQWKRVRTRIRELRALGLKETAVMEIANRTKGAWRTTKPQTLHQALGKYTWTAQGLKTSLQRYFELRQG

SEQ ID NO: 1544 - protein, 599 aa, Lactococcus lactis
MKPTMAILERISKNSQENIDEVFTRLYRYLLRPDIYYVAYQNLYSNKGASTKGILDDTADGFSEEKIKKIIQSLKDGTYYPQPVRRMYIAKKNSKKMRPLGIPTFTDKLIQEAVRIILESIYEPVFEDVSHGFRPQRSCHTALKTIKREFGGARWFVEGDIKGCFDNIDHVTLIGLINLKIKDMKMSQLIYKFLKAGYLENWQYHKTYSGTPQGGILSPLLANIYLHELDKFVLQLKMKFDRESPERITPEYRELHNEIKRISHRLKKLEGEEKAKVLLEYQEKRKRLPTLPCTSQTNKVLKYVRYADDFIISVKGSKEDCQWIKEQLKLFIHNKLKMELSEEKTLITHSSQPARFLGYDIRVRRSGTIKRSGKVKKRTLNGSVELLIPLQDKIRQFIFDKKIAIQKKDSSWFPVHRKYLIRSTDLEIITIYNSELRGICNYYGLASNFNQLNYFAYLMEYSCLKTIASKHKGTLSKTISMFKDGSGSWGIPYEIKQGKQRRYFANFSECKSPYQFTDEISQAPVLYGYARNTLENRLKAKCCELCGTSDENTSYEIHHVNKVKNLKGKEKWEMAMIAKQRKTLVVCFHCHRHVIHKHK

SEQ ID NO: 1545 - protein, 1114 aa, Bombyx mori
MMASTALSLMGRCNPDGCTRGKHVTAAPMDGPRGPSSLAGTFGWGLAIPAGEPCGRVCSPATVGFFPVAKKSNKENRPEASGLPLESERTGDNPTVRGSAGADPVGQDAPGWTCQFCERTFSTNRGLGVHKRRAHPVETNTDAAPMMVKRRWHGEEIDLLARTEARLLAERGQCSGGDLFGALPGFGRTLEAIKGQRRREPYRALVQAHLARFGSQPGPSSGGCSAEPDFRRASGAEEAGEERCAEDAAAYDPSAVGQMSPDAARVLSELLEGAGRRRACRAMRPKTAGRRNDLHDDRTASAHKTSRQKRRAEYARVQELYKKCRSRAAAEVIDGACGGVGHSLEEMETYWRPILERVSDAPGPTPEALHALGRAEWHGGNRDYTQLWKPISVEEIKASRFDWRTSPGPDGIRSGQWRAVPVHLKAEMFNAWMARGEIPEILRQCRTVFVPKVERPGGPGEYRPISIASIPLRHFHSILARRLLACCPPDARQRGFICADGTLENSAVLDAVLGDSRKKLRECHVAVLDFAKAFDTVSHEALVELLRLRGMPEQFCGYIAHLYDTASTTLAVNNEMSSPVKVGRGVRQGDPLSPILFNVVMDLILASLPERVGYRLEMELVSALAYADDLVLLAGSKVGMQESISAVDCVGRQMGLRLNCRKSAVLSMIPDGHRKKHHYLTERTFNIGGKPLRQVSCVERWRYLGVDFEASGCVTLEHSISSALNNISRAPLKPQQRLEILRAHLIPRFQHGFVLGNISDDRLRMLDVQIRKAVGQWLRLPADVPKAYYHAAVQDGGLAIPSVRATIPDLIVRRFGGLDSSPWSVARAAAKSDKIRKKLRWAWKQLRRFSRVDSTTQRPSVRLFWREHLHASVDGRELRESTRTPTSTKWIRERCAQITGRDFVQFVHTHINALPSRIRGSRGRRGGGESSLTCRAGCKVRETTAHILQQCHRTHGGRILRHNKIVSFVAKAMEENKWTVELEPRLRTSVGLRKPDIIASRDGVGVIVDVQVVSGQRSLDELHREKRNKYGNHGELVELVAGRLGLPKAECVRATSCTISWRGVWSLTSYKELRSIIGLREPTLQIVPILALRGSHMNWTRFNQMTSVMGGGVG

SEQ ID NO: 1546 - protein, 1275 aa, Homo sapiens
MTGSNSHITILTLNVNGLNSPIKRHRLASWIKSQDPSVCCIQETHLTCRDTHRLKIKGWRKIYQANGKQKKAGVAILVSDKTDFKPTKIKRDKEGHYIMVKGSIQQEELTILNIYAPNTGAPRFIKQVLSDLQRDLDSHTLIMGDFNTPLSILDRSTRQKVNKDTQELNSALHQTDLIDIYRTLHPKSTEYTFFSAPHHTYSKIDHIVGSKALLSKCKRTEIITNYLSDHSAIKLELRIKNLTQSRSTTWKLNNLLLNDYWVHNEMKAEIKMFFETNENKDTTYQNLWDAFKAVCRGKFIALNAYKRKQERSKIDTLTSQLKELEKQEQTHSKASRRQEITKIRAELKEIETQKTLQKINESRSWFFERINKIDRPLARLIKKKREKNQIDTIKNDKGDITTDPTEIQTTIREYYKHLYANKLENLEEMDTFLDTYTLPRLNQEEVESLNRPITGSEIVAIINSLPTKKSPGPDGFTAEFYQRYKEELVPFLLKLFQSIEKEGILPNSFYEASIILIPKPGRDTTKKENFRPISLMNIDAKILNKILANRIQQHIKKLIHHDQVGFIPGMQGWFNIRKSINVIQHINRAKDKNHVIISIDAEKAFDKIQQPFMLKTLNKLGIDGMYLKIIRAIYDKPTANIILNGQKLEAFPLKTGTRQGCPLSPLLFNIVLEVLARAIRQEKEIKGIQLGKEEVKLSLFADDMIVYLENPIVSAQNLLKLISNFSKVSGYKINVQKSQAFLYNNNRQTESQIMGELPFTIASKRIKYLGIQLTRDVKDLFKENYKPLLKEIKEDTNKWKNIPCSWVGRINIVKMAILPKVIYRFNAIPIKLPMTFFTELEKTTLKFIWNQKRARIAKSILSQKNKAGGITLPDFKLYYKATVTKTAWYWYQNRDIDQWNRTEPSEIMPHIYNYLIFDKPEKNKQWGKDSLLNKWCWENWLAICRKLKLDPFLTPYTKINSRWIKDLNVKPKTIKTLEENLGITIQDIGVGKDFMSKTPKAMATKDKIDKWDLIKLKSFCTAKETTIRVNRQPTTWEKIFATYSSDKGLISRIYNELKQIYKKKTNNPIKKWAKDMNRHFSKEDIYAAKKHMKKCSSSLAIREMQIKTTMRYHLTPVRMAIIKKSGNNRCWRGCGEIGTLVHCWWDCKLVQPLWKSVWRFLRDLELEIPFDPAIPLLGIYPKDYKSCCYKDTCTRMFIAALFTIAKTWNQPNCPTMIDWIKKMWHIYTMEYYAAIKNDEFISFVGTWMKLETIILSKLSQEQKTKHRIFSLIGGN

SEQ ID NO: 1547 - protein, 857 aa, Drosophila virilis
MERSPEPSININGRHAVCTATNMSYAKIKTKYKDSKRTINKFQLTLVKLTKLKSSLKFLLKCRKSNLIPNFIKNLTQHLTILTTDNKTHPDITRTLTRHTHFYHTKILNLLIKHKHNLLQEQTKHMQKAKTNIEQLMTTDDAKAFFESERNIENKITTTLKKRQETKHDKLRDQRNLALADNNTQREWFVNKTKIEFPPNVVALLAKGPKFALPISKRDFPLLKYIADGEELVQTIKEKETQESARTKFSLLVKEHKTKNNQNSRDRAILDTVEQTRKLLKENINIKILSSDKGNKTVAMDEDEYKNKMTNILDDLCAYRTLRLDPTSRLQTKNNTFVAQLFKMGLISKDERNKMTTTTAVPPRIYGLPKIHKEGTPLRPICSSIGSPSYGLCKYIIQILKNLTMDSRYNIKNAVDFKDRVNNSQIREEETLVSFDVVSLFPSIPIELALDTIRQKWTKLEEHTNIPKQLFMDIVRFCIEENRYFKYEDKIYTQLKGMPMGSPASPVIADILMEELLDKITDKLKIKPRLLTKYVDDLFAITNKIDVENILKELNSFHKQIKFTMELEKDGKLPFLDSIVSRMDNTLKIKWYRKPIASGRILNFNSNHPKSMIINTALGCMNRMMKISDTIYHKEIEHEIKELLTKNDFPPNIIKTLLKRRQIERKKPTEPAKIYKSLIYVPRLSERLTNSDCYNKQDIKVAHKPTNTLQKFFNKIKSKIPMIEKSNVVYQIPCGGDNNNKCNSVYIGTTKSKLKTRISQHKSDFKLRHQNNIQKTALMTHCIRSNHTPNFDETTILQQEQHYNKRHTLEMLHIINTPTYKRLNYKTDTENCAHLYRHLLNSQTTSVTISTSKSADV

SEQ ID NO: 1548 - protein, 671 aa, synthetic construct
  source 1..671: note = Description of Artificial Sequence: Synthetic polypeptide
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLL

SEQ ID NO: 1549 - protein, 859 aa, Rous sarcoma virus
TVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLCMLHYMDDLLLAASSHDGLEAAGEEVISTLERAGFTISPDKVQREPGVQYLGYKLGSTYVAPVGLVAEPRIATLWDVQKLVGSLQWLRPALGIPPRLMGPFYEQLRGSDPNEAREWNLDMKMAWREIVRLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALKGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAVQHHWATAIAVLGRPKAIKTDNGSCFTSKSTREWLARWGIAHTTGIPGNSQGQAMVERANRLLKDRIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDITQKDEVTKKDEASPLFAG

SEQ ID NO: 1550 - protein, 572 aa, Avian myeloblastosis virus
TVALHLAIPLKWKPNHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLIVGQILEPLRLKHPSLRMLHYMDDLLLAASSHDGLEAAGEEVISTLERAGFTISPDKVQREPGVQYLGYKLGSTYVAPVGLVAEPRIATLWDVQKLVGSLQWLRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAY

SEQ ID NO: 1551 - protein, 560 aa, Human immunodeficiency virus 1
PISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDEDFRKYTAFTIPSINNETPGIRYQYNVLPQGWKGSPAIFQSSMTKILEPFRKQNPDIVIYQYMDDLYVGSDLEIGQHRTKIEELRQHLLRWGLTTPDKKHQKEPPFLWMGYELHPDKWTVQPIVLPEKDSWTVNDIQKLVGKLNWASQIYPGIKVRQLCKLLRGTKALTEVIPLTEEAELELAENREILKEPVHGVYYDPSKDLIAEIQKQGQGQWTYQIYQEPFKNLKTGKYARMRGAHTNDVKQLTEAVQKITTESIVIWGKTPKFKLPIQKETWETWWTEYWQATWIPEWEFVNTPPLVKLWYQLEKEPIVGAETFYVDGAANRETKLGKAGYVTNRGRQKVVTLTDTTNQKTELQAIYLALQDSGLEVNIVTDSQYALGIIQAQPDQSESELVNQIIEQLIKKEKVYLAWVPAHKGIGGNEQVDKLVSAGIRKVL

SEQ ID NO: 1552 - protein, 538 aa, Saccharomyces cerevisiae
AVKAVKSIKPIRTTLRYDEAITYNKDIKEKEKYIEAYHKEVNQLLKMKTWDTDEYYDRKEIDPKRVINSMFIFNKKRDGTHKARFVARGDIQHPDTYDSGMQSNTVHHYALMTSLSLALDNNYYITQLDISSAYLYADIKEELYIRPPPHLGMNDKLIRLKKSLYGLKQSGANWYETIKSYLIQQCGMEEVRGWSCVFKNSQVTICLFVDDMVLFSKNLNSNKRIIEKLKMQYDTKIINLGESDEEIQYDILGLEIKYQRGKYMKLGMENSLTEKIPKLNVPLNPKGRKLSAPGQPGLYIDQDELEIDEDEYKEKVHEMQKLIGLASYVGYKFRFDLLYYINTLAQHILFPSRQVLDMTYELIQFMWDTRDKQLIWHKNKPTEPDNKLVAISDASYGNQPYYKSQIGNIYLLNGKVIGGKSTKASLTCTSTTEAEIHAISESVPLLNNLSYLIQELNKKPIIKGLLTDSRSTISIIKSTNEEKFRNRFFGTKAMRLRDEVSGNNLYVYYIETKKNIADVMTKPLPIKTFKLLTNKWIH

SEQ ID NO: 1553 - protein, 328 aa, Bordetella virus BPP1
MGKRHRNLIDQITTWENLLDAYRKTSHGKRRTWGYLEFKEYDLANLLALQAELKAGNYERGPYREFLVYEPKPRLISALEFKDRLVQHALCNIVAPIFEAGLLPYTYACRPDKGTHAGVCHVQAELRRTRATHFLKSDFSKFFPSIDRAALYAMIDKKIHCAATRRLLRVVLPDEGVGIPIGSLTSQLFANVYGGAVDRLLHDELKQRHWARYMDDIVVLGDDPEELRAVFYRLRDFASERLGLKISHWQVAPVSRGINFLGYRIWPTHKLLRKSSVKRAKRKVANFIKHGEDESLQRFLASWSGHAQWADTHNLFTWMEEQYGIACH

SEQ ID NO: 1554 - protein, 320 aa, Escherichia coli
MKSAEYLNTFRLRNLGLPVMNNLHDMSKATRISVETLRLLIYTADFRYRIYTVEKKGPEKRMRTIYQPSRELKALQGWVLRNILDKLSSSPFSIGFEKHQSILNNATPHIGANFILNIDLEDFFPSLTANKVFGVFHSLGYNRLISSVLTKICCYKNLLPQGAPSSPKLANLICSKLDYRIQGYAGSRGLIYTRYADDLTLSAQSMKKVVKARDFLFSIIPSEGLVINSKKTCISGPRSQRKVTGLVISQEKVGIGREKYKEIRAKIHHIFCGKSSEIEHVRGWLSFILSVDSKSHRRLITYISKLEKKYGKNPLNKAKT

SEQ ID NO: 1555 - protein, 1132 aa, Homo sapiens
MPRAPRCRAVRSLLRSHYREVLPLATFVRRLGPQGWRLVQRGDPAAFRALVAQCLVCVPWDARPPPAAPSFRQVSCLKELVARVLQRLCERGAKNVLAFGFALLDGARGGPPEAFTTSVRSYLPNTVTDALRGSGAWGLLLRRVGDDVLVHLLARCALFVLVAPSCAYQVCGPPLYQLGAATQARPPPHASGPRRRLGCERAWNHSVREAGVPLGLPAPGARRRGGSASRSLPLPKRPRRGAAPEPERTPVGQGSWAHPGRTRGPSDRGFCVVSPARPAEEATSLEGALSGTRHSHPSVGRQHHAGPPSTSRPPRPWDTPCPPVYAETKHFLYSSGDKEQLRPSFLLSSLRPSLTGARRLVETIFLGSRPWMPGTPRRLPRLPQRYWQMRPLFLELLGNHAQCPYGVLLKTHCPLRAAVTPAAGVCAREKPQGSVAAPEEEDTDPRRLVQLLRQHSSPWQVYGFVRACLRRLVPPGLWGSRHNERRFLRNTKKFISLGKHAKLSLQELTWKMSVRDCAWLRRSPGVGCVPAAEHRLREEILAKFLHWLMSVYVVELLRSFFYVTETTFQKNRLFFYRKSVWSKLQSIGIRQHLKRVQLRELSEAEVRQHREARPALLTSRLRFIPKPDGLRPIVNMDYVVGARTFRREKRAERLTSRVKALFSVLNYERARRPGLLGASVLGLDDIHRAWRTFVLRVRAQDPPPELYFVKVDVTGAYDTIPQDRLTEVIASIIKPQNTYCVRRYAVVQKAAHGHVRKAFKSHVSTLTDLQPYMRQFVAHLQETSPLRDAVVIEQSSSLNEASSGLFDVFLRFMCHHAVRIRGKSYVQCQGIPQGSILSTLLCSLCYGDMENKLFAGIRRDGLLLRLVDDFLLVTPHLTHAKTFLRTLVRGVPEYGCVVNLRKTVVNFPVEDEALGGTAFVQMPAHGLFPWCGLLLDTRTLEVQSDYSSYARTSIRASLTFNRGFKAGRNMRRKLFGVLRLKCHSLFLDLQVNSLQTVCTNIYKILLLQAYRFHACVLQLPFHQQVWKNPTFFLRVISDTASLCYSILKAKNAGMSLGAKGAAGPLPSEAVQWLCHQAFLLKLTRHRVTYVPLLGSLRTAQTQLSRKLPGTTLTALEAAANPALPSDFKTILD

SEQ ID NO: 1556 - protein, 710 aa, Neurospora crassa
MPNHRLPNCVSYLGENHELSWLHGMFGLLKRSNPQTGGILGWLNTGPNGFVKYMMNLMGHARDKGDAKEYWRLGRSLMKNEAFQVQAFNHVCKHWYLDYKPHKIAKLLKEVREMVEIQPVCIDYKRVYIPKANGKQRPLGVPTVPWRVYLHMWNVLLVWYRIPEQDNQHAYFPKRGVFTAWRALWPKLDSQNIYEFDLKNFFPSVDLAYLKDKLMESGIPQDISEYLTVLNRSLVVLTSEDKIPEPHRDVIFNSDGTPNPNLPKDVQGRILKDPDFVEILRRRGFTDIATNGVPQGASTSCGLATYNVKELFKRYDELIMYADDGILCRQDPSTPDFSVEEAGVVQEPAKSGWIKQNGEFKKSVKFLGLEFIPANIPPLGEGEVKDYPRLRGATRNGSKMELSTELQFLCYLSYKLRIKVLRDLYIQVLGYLPSVPLLRYRSLAEAINELSPKRITIGQFITSSFEEFTAWSPLKRMGFFFSSPAGPTILSSIFNNSTNLQEPSDSRLLYRKGSWVNIRFAAYLYSKLSEEKHGLVPKFLEKLREINFALDKVDVTEIDSKLSRLMKFSVSAAYDEVGTLALKSLFKFRNSERESIKASFKQLRENGKIAEFSEARRLWFEILKLIRLDLFNASSLACDDLLSHLQDRRSIKKWGSSDVLYLKSQRLMRTNKKQLQLDFEKKKNSLKKKLIKRRAKELRDTFKGKENKEA

SEQ ID NO: 1557 - protein, 785 aa, synthetic construct
  source 1..785: note = Description of Artificial Sequence: Synthetic polypeptide
MILDTDYITEDGKPVIRIFKKENGEFKIEYDRTFEPYLYALLKDDSAIEEVKKITAERHGTVVTVKRVEKVQKKFLGRPVEVWKLYFTHPQDVPAIMDKIREHPAVIDIYEYDIPFAIRYLIDKGLVPMEGDEELKLLAFDIETLYHEGEEFAEGPILMISYADEEGARVITWKNVDLPYVDVVSTEREMIKRFLRVVKEKDPDVLITYNGDNFDFAYLKKRCEKLGINFALGRDGSEPKIQRMGDRFAVEVKGRIHFDLYPVIRRTINLPTYTLEAVYEAVFGQPKEKVYAEEITTAWETGENLERVARYSMEDAKVTYELGKEFLPMEAQLSRLIGQSLWDVSRSSTGNLVEWFLLRKAYERNELAPNKPDEKELARRHQSHEGGYIKEPERGLWENIVYLDFRSLYPSIIITHNVSPDTLNREGCKEYDVAPQVGHRFCKDFPGFIPSLLGDLLEERQKIKKRMKATIDPIERKLLDYRQRAIKILANSLYGYYGYARARWYCKECAESVIAWGREYLTMTIKEIEEKYGFKVIYSDTDGFFATIPGADAETVKKKAMEFLKYINAKLPGALELEYEGFYKRGLFVTKKKYAVIDEEGKITTRGLEIVRRDWSEIAKETQARVLEALLKDGDVEKAVRIVKEVTEKLSKYEVPPEKLVIHKQITRDLKDYKATGPHVAVAKRLAARGVKIRPGTVISYIVLKGSGRIVDRAIPFDEFDPTKHKYDAEYYIEKQVLPAVERILRAFGYRKEDLRYQKTRQVGLSARLKPKGTLEGSSHHHHHH

SEQ ID NO: 1558 - protein, 4 aa, unidentified
  source 1..4: note = Description of Unknown:Polymerase family B motif sequence
DTDS

SEQ ID NO: 1559 - protein, 1145 aa, unidentified
  source 1..1145: note = Description of Unknown:Porcine endogenous retrovirus sequence
MGATGQQQYPWTTRRTVDLGVGRVTHSFLVIPECPAPLLGRDLLTKMGAQISFEQGKPEVSANNKPITVLTLQLDDEYRLYSPLVKPDQNIQFWLEQFPQAWAETAGMGLAKQVPPQVIQLKASATPVSVRQYPLSKEAQEGIRPHVQRLIQQGILVPVQSPWNTPLLPVRKPGTNDYRPVQDLREVNKRVQDIHPTVPNPYNLLCALPPQRSWYTVLDLKDAFFCLRLHPTSQPLFAFEWRDPGTGRTGQLTWTRLPQGFKNSPTIFDEALHRDLANFRIQHPQVTLLQYVDDLLLAGATKQDCLEGTKALLLELSDLGYRASAKKAQICRREVTYLGYSLRDGQRWLTEARKKTVVQIPAPTTAKQVREFLGTAGFCRLWIPGFATLAAPLYPLTKEKGEFSWAPEHQKAFDAIKKALLSAPALALPDVTKPFTLYVDERKGVARGVLTQTLGPWRRPVAYLSKKLDPVASGWPVCLKAIAAVAILVKDADKLTLGQNITVIAPHALENIVRQPPDRWMTNARMTHYQSLLLTERVTFAPPAALNPATLLPEETDEPVTHDCHQLLIEETGVRKDLTDIPLTGEVLTWFTDGSSYVVEGKRMAGAAVVDGTRTIWASSLPEGTSAQKAELMALTQALRLAEGKSINIYTDSRYAFATAHVHGAIYKQRGLLTSAGREIKNKEEILSLLEALHLPKRLAIIHCPGHQKAKDPISRGNQMADRVAKQAAQGVNLLPMIETPKAPEPGRQYTLEDWQEIKKIDQFSETPEGTCYTSDGKEILPHKEGLEYVQQIHRLTHLGTKHLQQLVRTSPYHVLRLPGVADSVVKHCVPCQLVNANPSRIPPGKRLRGSHPGAHWEVDFTEVKPAKYGNKYLLVFVDTFSGWVEAYPTKKETSTVVAKKILEEIFPRFGIPKVIGSDNGPAFVAQVSQGLAKILGIDWKLHCAYRPQSSGQVERMNRTIKETLTKLTAETGVNDWIALLPFVLFRVRNTPGQFGLTPYELLYGGPPPLVEIASVHSADVLLSQPLFSRLKALEWVRQRAWRQLREAYSGGGDLQIPHRFQVGDSVYVRRHRAGNLETRWKGPYHVLLTTPTAVKVEGISTWIHASHVKPAPPPDSGWKAEKTENPLKLRLHRVVPYSVNNFSS

SEQ ID NO: 1560 - protein, 1149 aa, Cynomolgus macaque simian foamy virus
MDPLQLLQPLEAEIKGTKLKAHWDSGATITCVPEAFLEDERPIQTMLIKTIHGEKQQDVYYLTFKVQGRKVEAEVLASPYDYILLNPSDVPWLMKKPLQLTVLVPLHEYQERLLQQTALPKEQKELLQKLFLKYDALWQHWENQVGHRRIKPHNIATGTLAPRPQKQYPINPKAKPSIQIVIDDLLKQGVLIQQNSTMNTPVYPVPKPDGKWRMVLDYREVNKTIPLIAAQNQHSAGILSSIYRGKYKTTLDLTNGFWAHPITPESYWLTAFTWQGKQYCWTRLPQGFLNSPALFTADVVDLLKEIPNVQAYVDDIYISHDDPQEHLEQLEKIFSILLNAGYVVSLKKSEIAQREVEFLGFNITKEGRGLTDTFKQKLLNITPPKDLKQLQSILGLLNFARNFIPNYSELVKPLYTIVANANGKFISWTEDNSNQLQHIISVLNQADNLEERNPETRLIIKVNSSPSAGYIRYYNEGSKRPIMYVNYIFSKAEAKFTQTEKLLTTMHKGLIKAMDLAMGQEILVYSPIVSMTKIQRTPLPERKALPVRWITWMTYLEDPRIQFHYDKSLPELQQIPNVTEDVIAKTKHPSEFAMVFYTDGSAIKHPDVNKSHSAGMGIAQVQFIPEYKIVHQWSIPLGDHTAQLAEIAAVEFACKKALKISGPVLIVTDSFYVAESANKELPYWKSNGFLNNKKKPLRHVSKWKSIAECLQLKPDIIIMHEKGHQQPMTTLHTEGNNLADKLATQGSYVVHCNTTPSLDAELDQLLQGHYPPGYPKQYKYTLEENKLIVERPNGIRIVPPKADREKIISTAHNIAHTGRDATFLKVSSKYWWPNLRKDVVKSIRQCKQCLVTNATNLTSPPILRPVKPLKPFDKFYIDYIGPLPPSNGYLHVLVVVDSMTGFVWLYPTKAPSTSATVKALNMLTSIAIPKVLHSDQGAAFTSSTFADWAKEKGIQLEFSTPYHPQSSGKVERKNSDIKRLLTKLLIGRPAKWYDLLPVVQLALNNSYSPSSKYTPHQLLFGVDSNTPFANSDTLDLSREEELSLLQEIRSSLHQPTSPPASSRSWSPSVGQLVQERVARPASLRPRWHKPTAILEVVNPRTVIILDHLGNRRTVSVDNLKLTAYQDNGTSNDSGTMALMEEDESSTSST

SEQ ID NO: 1561 - protein, 1771 aa, Mason-Pfizer monkey virus
MGQELSQHERYVEQLKQALKTRGVKVKYADLLKFFDFVKDTCPWFPQEGTIDIKRWRRVGDCFQDYYNTFGPEKVPVTAFSYWNLIKELIDKKEVNPQVMAAVAQTEEILKSNSQTDLTKTSQNPDLDLISLDSDDEGAKSSSLQDKGLSSTKKPKRFPVLLTAQTSKDPEDPNPSEVDWDGLEDEAAKYHNPDWPPFLTRPPPYNKATPSAPTVMAVVNPKEELKEKIAQLEEQIKLEELHQALISKLQKLKTGNETVTHPDTAGGLSRTPHWPGQHIPKGKCCASREKEEQIPKDIFPVTETVDGQGQAWRHHNGFDFAVIKELKTAASQYGATAPYTLAIVESVADNWLTPTDWNTLVRAVLSGGDHLLWKSEFFENCRDTAKRNQQAGNGWDFDMLTGSGNYSSTDAQMQYDPGLFAQIQAAATKAWRKLPVKGDPGASLTGVKQGPDEPFADFVHRLITTAGRIFGSAEAGVDYVKQLAYENANPACQAAIRPYRKKTDLTGYIRLCSDIGPSYQQGLAMAAAFSGQTVKDFLNNKNKEKGGCCFKCGKKGHFAKNCHEHAHNNAEPKVPGLCPRCKRGKHWANECKSKTDNQGNPIPPHQGNRVEGPAPGPETSLWGSQLCSSQQKQPISKLTRATPGSAGLDLCSTSHTVLTPEMGPQALSTGIYGPLPPNTFGLILGRSSITMKGLQVYPGVIDNDYTGEIKIMAKAVNNIVTVSQGNRIAQLILLPLIETDNKVQQPYRGQGSFGSSDIYWVQPITCQKPSLTLWLDDKMFTGLIDTGADVTIIKLEDWPPNWPITDTLTNLRGIGQSNNPKQSSKYLTWRDKENNSGLIKPFVIPNLPVNLWGRDLLSQMKIMMCSPNDIVTAQMLAQGYSPGKGLGKKENGILHPIPNQGQSNKKGFGNFLTAAIDILAPQQCAEPITWKSDEPVWVDQWPLTNDKLAAAQQLVQEQLEAGHITESSSPWNTPIFVIKKKSGKWRLLQDLRAVNATMVLMGALQPGLPSPVAIPQGYLKIIIDLKDCFFSIPLHPSDQKRFAFSLPSTNFKEPMQRFQWKVLPQGMANSPTLCQKYVATAIHKVRHAWKQMYIIHYMDDILIAGKDGQQVLQCFDQLKQELTAAGLHIAPEKVQLQDPYTYLGFELNGPKITNQKAVIRKDKLQTLNDFQKLLGDINWLRPYLKLTTGDLKPLFDTLKGDSDPNSHRSLSKEALASLEKVETAIAEQFVTHINYSLPLIFLIFNTALTPTGLFWQDNPIMWIHLPASPKKVLLPYYDAIADLIILGRDHSKKYFGIEPSTIIQPYSKSQIDWLMQNTEMWPIACASFVGILDNHYPPNKLIQFCKLHTFVFPQIISKTPLNNALLVFTDGSSTGMAAYTLTDTTIKFQTNLNSAQLVELQALIAVLSAFPNQPLNIYTDSAYLAHSIPLLETVAQIKHISETAKLFLQCQQLIYNRSIPFYIGHVRAHSGLPGPIAQGNQRADLATKIVASNINTNLESAQNAHTLHHLNAQTLRLMFNIPREQARQIVKQCPICVTYLPVPHLGVNPRGLFPNMIWQMDVTHYSEFGNLKYIHVSIDTFSGFLLATLQTGETTKHVITHLLHCFSIIGLPKQIKTDNGPGYTSKNFQEFCSTLQIKHITGIPYNPQGQGIVERAHLSLKTTIEKIKKGEWYPRKGTPRNILNHALFILNFLNLDDQNKSAADRFWHNNPKKQFAMVKWKDPLDNTWHGPDPVLIWGRGSVCVYSQTYDAARWLPERLVRQVSNNNQSRE

SEQ ID NO: 1562 - protein, 1755 aa, Mouse mammary tumor virus
MGVSGSKGQKLFVSVLQRLLSERGLHVKESSAIEFYQFLIKVSPWFPEEGGLNLQDWKRVGREMKRYAAEHGTDSIPKQAYPIWLQLREILTEQSDLVLLSAEAKSVTEEELEEGLTGLLSTSSQEKTYGTRGTAYAEIDTEVDKLSEHIYDEPYEEKEKADKNEEKDHVRKIKKVVQRKENSEGKRKEKDSKAFLATDWNDDDLSPEDWDDLEEQAAHYHDDDELILPVKRKVVKKKPQALRRKPLPPVGFAGAMAEAREKGDLTFTFPVVFMGESDEDDTPVWEPLPLKTLKELQSAVRTMGPSAPYTLQVVDMVASQWLTPSDWHQTARATLSPGDYVLWRTEYEEKSKEMVQKAAGKRKGKVSLDMLLGTGQFLSPSSQIKLSKDVLKDVTTNAVLAWRAIPPPGVKKTVLAGLKQGNEESYETFISRLEEAVYRMMPRGEGSDILIKQLAWENANSLCQDLIRPIRKTGTIQDYIRACLDASPAVVQGMAYAAAMRGQKYSTFVKQTYGGGKGGQGAEGPVCFSCGKTGHIRKDCKDEKGSKRAPPGLCPRCKKGYHWKSECKSKFDKDGNPLPPLETNAENSKNLVKGQSPSPAQKGDGVKGSGLNPEAPPFTIHDLPRGTPGSAGLDLSSQKDLILSLEDGVSLVPTLVKGTLPEGTTGLIIGRSSNYKKGLEVLPGVIDSDFQGEIKVMVKAAKNAVIIHKGERIAQLLLLPYLKLPNPVIKEERGSEGFGSTSHVHWVQEISDSRPMLHIYLNGRRFLGLLDTGADKTCIAGRDWPANWPIHQTESSLQGLGMACGVARSSQPLRWQHEDKSGIIHPFVIPTLPFTLWGRDIMKDIKVRLMTDSPDDSQDLMIGAIESNLFADQISWKSDQPVWLNQWPLKQEKLQALQQLVTEQLQLGHLEESNSPWNTPVFVIKKKSGKWRLLQDLRAVNATMHDMGALQPGLPSPVAVPKGWEIIIIDLQDCFFNIKLHPEDCKRFAFSVPSPNFKRPYQRFQWKVLPQGMKNSPTLCQKFVDKAILTVRDKYQDSYIVHYMDDILLAHPSRSIVDEILTSMIQALNKHGLVVSTEKIQKYDNLKYLGTHIQGDSVSYQKLQIRTDKLRTLNDFQKLLGNINWIRPFLKLTTGELKPLFEILNGDSNPISTRKLTPEACKALQLMNERLSTARVKRLDLSQPWSLCILKTEYTPTACLWQDGVVEWIHLPHISPKVITPYDIFCTQLIIKGRHRSKELFSKDPDYIVVPYTKVQFDLLLQEKEDWPISLLGFLGEVHFHLPKDPLLTFTLQTAIIFPHMTSTTPLEKGIVIFTDGSANGRSVTYIQGREPIIKENTQNTAQQAEIVAVITAFEEVSQPFNLYTDSKYVTGLFPEIETATLSPRTKIYTELKHLQRLIHKRQEKFYIGHIRGHTGLPGPLAQGNAYADSLTRILTALESAQESHALHHQNAAALRFQFHITREQAREIVKLCPNCPDWGHAPQLGVNPRGLKPRVLWQMDVTHVSEFGKLKYVHVTVDTYSHFTFATARTGEATKDVLQHLAQSFAYMGIPQKIKTDNAPAYVSRSIQEFLARWKISHVTGIPYNPQGQAIVERTHQNIKAQLNKLQKAGKYYTPHHLLAHALFVLNHVNMDNQGHTAAERHWGPISADPKPMVMWKDLLTGSWKGPDVLITAGRGYACVFPQDAETPIWVPDRFIRPFTERKEATPTPGTAEKTPPRDEKDQQESPKNESSPHQREDGLATSAGVDLRSGGGP

SEQ ID NO: 1563 - protein, 1738 aa, Murine leukemia virus
MGQTVTTPLSLTLGHWKDVERIAHNQSVDVKKRRWVTFCSAEWPTFNVGWPRDGTFNRDLITQVKIKVFSPGPHGHPDQVPYIVTWEALAFDPPPWVKPFVHPKPPPPLPPSAPSLPLEPPRSTPPRSSLYPALTPSLGAKPKPQVLSDSGGPLIDLLTEDPPPYRDPRPPPSDRDGNGGEATPAGEAPDPSPMASRLRGRREPPVADSTTSQAFPLRAGGNGQLQYWPFSSSDLYNWKNNNPSFSEDPGKLTALIESVLITHQPTWDDCQQLLGTLLTGEEKQRVLLEARKAVRGDDGRPTQLPNEVDAAFPLERPDWDYTTQAGRNHLVHYRQLLLAGLQNAGRSPTNLAKVKGITQGPNESPSAFLERLKEAYRRYTPYDPEDPGQETNVSMSFIWQSAPDIGRKLERLEDLKNKTLGDLVREAEKIFNKRETPEEREERIRRETEEKEERRRTEDEQKEKERDRRRHREMSKLLATVVSGQKQDRQGGERRRSQLDRDQCAYCKEKGHWAKDCPKKPRGPRGPRPQTSLLTLDDQGGQGQEPPPEPRITLKVGGQPVTFLVDTGAQHSVLTQNPGPLSDKSAWVQGATGGKRYRWTTDRKVHLATGKVTHSFLHVPDCPYPLLGRDLLTKLKAQIHFEGSGAQVMGPMGQPLQVLTLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLIENSSPYTSEHFHYTVTDIKDLTKLGAIYDKTKKYWVYQGKPVMPDQFTFELLDFLHQLTHLSFSKMKALLERSHSPYYMLNRDRTLKNITETCKACAQVNASKSAVKQGTRVRGHRPGTHWEIDFTEIKPGLYGYKYLLVFIDTFSGWIEAFPTKKETAKVVTKKLLEEIFPRFGMPQVLGTDNGPAFVSKVSQTVADLLGIDWKLHCAYRPQSSGQVERMNRTIKETLTKLTLATGSRDWVLLLPLALYRARNTPGPHGLTPYEILYGAPPPLVNFPDPDMTRVTNSPSLQAHLQALYLVQHEVWRPLAAAYQEQLDRPVVPHPYRVGDTVWVRRHQTKNLEPRWKGPYTVLLTTPTALKVDGIAAWIHAAHVKAADPGGGPSSRLTWRVQRSQNPLKIRLTREAP

SEQ ID NO: 1564 - protein, 1462 aa, unidentified
  source 1..1462: note = Description of Unknown:Human T-cell leukemia virus 1 sequence
MGQIFSRSASPIPRPPRGLAAHHWLNFLQAAYRLEPGPSSYDFHQLKKFLKIALETPARICPINYSLLASLLPKGYPGRVNEILHILIQTQAQIPSRPAPPPPSSPTHDPPDSDPQIPPPYVEPTAPQVLPVMHPHGAPPNHRPWQMKDLQAIKQEVSQAAPGSPQFMQTIRLAVQQFDPTAKDLQDLLQYLCSSLVASLHHQQLDSLISEAETRGITGYNPLAGPLRVQANNPQQQGLRREYQQLWLAAFAALPGSAKDPSWASILQGLEEPYHAFVERLNIALDNGLPEGTPKDPILRSLAYSNANKECQKLLQARGHTNSPLGDMLRACQTWTPKDKTKVLVVQPKKPPPNQPCFRCGKAGHWSRDCTQPRPPPGPCPLCQDPTHWKRDCPRLKPTIPEPEPEEDALLLDLPADIPHPKNLHRGGGLTSPPTLQQVLPNQDPASILPVIPLDPARRPVIKAQVDTQTSHPKTIEALLDTGADMTVLPIALFSSNTPLKNTSVLGAGGQTQDHFKLTSLPVLIRLPFRTTPIVLTSCLVDTKNNWAIIGRDALQQCQGVLYLPEAKRPPVILPIQAPAVLGLEHLPRPPQISQFPLNPERLQALQHLVRKALEAGHIEPYTGPGNNPVFPVKKANGTWRFIHDLRATNSLTIDLSSSSPGPPDLSSLPTTLAHLQTIDLRDAFFQIPLPKQFQPYFAFTVPQQCNYGPGTRYAWKVLPQGFKNSPTLFEMQLAHILQPIRQAFPQCTILQYMDDILLASPSHEDLLLLSEATMASLISHGLPVSENKTQQTPGTIKFLGQIISPNHLTYDAVPTVPIRSRWALPELQALLGEIQWVSKGTPTLRQPLHSLYCALQRHTDPRDQIYLNPSQVQSLVQLRQALSQNCRSRLVQTLPLLGAIMLTLTGTTTVVFQSKEQWPLVWLHAPLPHTSQCPWGQLLASAVLLLDKYTLQSYGLLCQTIHHNISTQTFNQFIQTSDHPSVPILLHHSHRFKNLGAQTGELWNTFLKTAAPLAPVKALMPVFTLSPVIINTAPCLFSDGSTSRAAYILWDKQILSQRSFPLPPPHKSAQRAELLGLLHGLSSARSWRCLNIFLDSKYLYHYLRTLALGTFQGRSSQAPFQALLPRLLSRKVVYLHHVRSHTNLPDPISRLNALTDALLITPVLQLSPAELHSFTHCGQTALTLQGATTTEASNILRSCHACRGGNPQHQMPRGHIRRGLLPNHIWQGDITHFKYKNTLYRLHVWVDTFSGAISATQKRKETSSEAISSLLQAIAHLGKPSYINTDNGPAYISQDFLNMCTSLAIRHTTHVPYNPTSSGLVERSNGILKTLLYKYFTDKPDLPMDNALSIALWTINHLNVLTNCHKTRWQLHHSPRLQPIPETRSLSNKQTHWYYFKLPGLNSRQWKGPQEALQEAAGAALIPVSASSAQWIPWRLLKRAACPRPVGGPADPKEKDLQHHG

SEQ ID NO: 1565 - protein, 1143 aa, unidentified
  source 1..1143: note = Description of Unknown:Human spumaretrovirus sequence
MNPLQLLQPLPAEIKGTKLLAHWDSGATITCIPESFLEDEQPIKKTLIKTIHGEKQQNVYYVTFKVKGRKVEAEVIASPYEYILLSPTDVPWLTQQPLQLTILVPLQEYQEKILSKTALPEDQKQQLKTLFVKYDNLWQHWENQVGHRKIRPHNIATGDYPPRPQKQYPINPKAKPSIQIVIDDLLKQGVLTPQNSTMNTPVYPVPKPDGRWRMVLDYREVNKTIPLTAAQNQHSAGILATIVRQKYKTTLDLANGFWAHPITPESYWLTAFTWQGKQYCWTRLPQGFLNSPALFTADVVDLLKEIPNVQVYVDDIYLSHDDPKEHVQQLEKVFQILLQAGYVVSLKKSEIGQKTVEFLGFNITKEGRGLTDTFKTKLLNITPPKDLKQLQSILGLLNFARNFIPNFAELVQPLYNLIASAKGKYIEWSEENTKQLNMVIEALNTASNLEERLPEQRLVIKVNTSPSAGYVRYYNETGKKPIMYLNYVFSKAELKFSMLEKLLTTMHKALIKAMDLAMGQEILVYSPIVSMTKIQKTPLPERKALPIRWITWMTYLEDPRIQFHYDKTLPELKHIPDVYTSSQSPVKHPSQYEGVFYTDGSAIKSPDPTKSNNAGMGIVHATYKPEYQVLNQWSIPLGNHTAQMAEIAAVEFACKKALKIPGPVLVITDSFYVAESANKELPYWKSNGFVNNKKKPLKHISKWKSIAECLSMKPDITIQHEKGISLQIPVFILKGNALADKLATQGSYVVNCNTKKPNLDAELDQLLQGHYIKGYPKQYTYFLEDGKVKVSRPEGVKIIPPQSDRQKIVLQAHNLAHTGREATLLKIANLYWWPNMRKDVVKQLGRCQQCLITNASNKASGPILRPDRPQKPFDKFFIDYIGPLPPSQGYLYVLVVVDGMTGFTWLYPTKAPSTSATVKSLNVLTSIAIPKVIHSDQGAAFTSSTFAEWAKERGIHLEFSTPYHPQSGSKVERKNSDIKRLLTKLLVGRPTKWYDLLPVVQLALNNTYSPVLKYTPHQLLFGIDSNTPFANQDTLDLTREEELSLLQEIRTSLYHPSTPPASSRSWSPVVGQLVQERVARPASLRPRWHKPSTVLKVLNPRTVVILDHLGNNRTVSIDNLKPTSHQNGTTNDTATMDHLEKNE

SEQ ID NO: 1566 - protein, 1416 aa, Bovine leukemia virus
MGNSPSYNPPAGISPSDWLNLLQSAQRLNPRPSPSDFTDLKNYIHWFHKTQKKPWTFTSGGPTSCPPGRFGRVPLVLATLNEVLSNEGGAPGASAPEEQPPPYDPPAILPIISEGNRNRHRAWALRELQDIKKEIENKAPGSQVWIQTLRLAILQADPTPADLEQLCQYIASPVDQTAHMTSLTAAIAAAEAANTLQGFNPKTGTLTQQSAQPNAGDLRSQYQNLWLQAGKNLPTRPSAPWSTIVQGPAESSVEFVNRLQISLADNLPDGVPKEPIIDSLSYANANRECQQILQGRGPVAAVGQKLQACAQWAPKNKQPALLVHTPGPKMPGPRQPAPKRPPPGPCYRCLKEGHWARDCPTKATGPPPGPCPICKDPSHWKRDCPTLKSKNKLIEGGLSAPQTITPITDSLSEAELECLLSIPLARSRPSVAVYLSGPWLQPSQNQALMLVDTGAENTVLPQNWLVRDYPRIPAAVLGAGGVSRNRYNWLQGPLTLALKPEGPFITIPKILVDTSDKWQILGRDVPSRLQASISIPEEVRPPVVGVLDTPPSHIGLEHLPPPPEVPQFPLNLERLQALQDLVHRSLEAGYISPWDGPGNNPVFPVRKPNGAWRFVHDLRATNALTKPIPALSPGPPDLTAIPTHPPHIICLDLKDAFFQIPVEDRFRFYLSFTLPSPGGLQPHRRFAWRVLPQGFINSPALFERALQEPLRQVSAAFSQSLLVSYMDDILYASPTEEQRSQCYQALAARLRDLGFQVASEKTSQTPSPVPFLGQMVHEQIVTYQSLPTLQISSPISLHQLQAVLGDLQWVSRGTPTTRRPLQLLYSSLKRHHDPRAIIQLSPEQLQGIAELRQALSHNARSRYNEQEPLLAYVHLTRAGSTLVLFQKGAQFPLAYFQTPLTDNQASPWGLLLLLGCQYLQTQALSSYAKPILKYYHNLPKTSLDNWIQSSEDPRVQELLQLWPQISSQGIQPPGPWKTLITRAEVFLTPQFSPDPIPAALCLFSDGATGRGAYCLWKDHLLDFQAVPAPESAQKGELAGLLAGLAAAPPEPVNIWVDSKYLYSLLRTLVLGAWLQPDPVPSYALLYKSLLRHPAIVVGHVRSHSSASHPIASLNNYVDQLLPLETPEQWHKLTHCNSRALSRWPNPRISAWDPRSPATLCETCQKLNPTGGGKMRTIQRGWAPNHIWQADITHYKYKQFTYALHVFVDTYSGATHASAKRGLTTQTTIEGLLEAIVHLGRPKKLNTDQGANYTSKTFVRFCQQFGVSLSHHVPYNPTSSGLDERTNGLLKLLLSKYHLDEPHLPMTQALSRALWTHNQINLLPILKTRWELHHSPPLAVISEGGETPKGSDKLFLYLLPGQNNRRWLGPLPALVEASGGALLATDPPVWVPWRLLKAFKCLKNDGPEDAHNRSSDG

SEQ ID NO: 1567 - protein, 1220 aa, Bovine foamy virus
MPALRPLQVEIKGNHLKGYWDSGAEITCVPAIYIIEEQPVGKKLITTIHNEKEHDVYYVEMKIEKRKVQCEVIATALDYVLVAPVDIPWYKPGPLELTIKIDVESQKHTLITESTLSPQGQMRLKKLLDQYQALWQCWENQVGHRRIEPHKIATGALKPRPQKQYHINPRAKADIQIVIDDLLRQGVLRQQNSEMNTPVYPVPKADGRWRMVLDYREVNKVTPLVATQNCHSASILNTLYRGPYKSTLDLANGFWAHPIKPEDYWITAFTWGGKTYCWTVLPQGFLNSPALFTADVVDILKDIPNVQVYVDDVYVSSATEQEHLDILETIFNRLSTAGYIVSLKKSKLAKETVEFLGFSISQNGRGLTDSYKQKLMDLQPPTTLRQLQSILGLINFARNFLPNFAELVAPLYQLIPKAKGQCIPWTMDHTTQLKTIIQALNSTENLEERRPDVDLIMKVHISNTAGYIRFYNHGGQKPIAYNNALFTSTELKFTPTEKIMATIHKGLLKALDLSLGKEIHVYSAIASMTKLQKTPLSERKALSIRWLKWQTYFEDPRIKFHHDATLPDLQNLPVPQQDTGKEMTILPLLHYEAIFYTDGSAIRSPKPNKTHSAGMGIIQAKFEPDFRIVHLWSFPLGDHTAQYAEIAAFEFAIRRATGIRGPVLIVTDSNYVAKSYNEELPYWESNGFVNNKKKTLKHISKWKAIAECKNLKADIHVIHEPGHQPAEASPHAQGNALADKQAVSGSYKVFSNELKPSLDAELEQVLSTGRPNPQGYPNKYEYKLVNGLCYVDRRGEEGLKIIPPKADRVKLCQLAHDGPGSAHLGRSALLLKLQQKYWWPRMHIDASRIVLNCTVCAQTNSTNQKPRPPLVIPHDTKPFQVWYMDYIGPLPPSNGYQHALVIVDAGTGFTWIYPTKAQTANATVKALTHLTGTAVPKVLHSDQGPAFTSSILADWAKDRGIQLEHSAPYHPQSSGKVERKNSEIKRLLTKLLAGRPTKWYPLIPIVQLALNNTPNTRQKYTPHQLMYGADCNLPFENLDTLDLTREEQLAVLKEVRDGLLDLYPSPSQTTARSWTPSPGLLVQERVARPAQLRPKWRKPTPIKKVLNERTVIIDHLGQDKVVSIDNLKPAAHQKLAQTPDSAEICPSATPCPPNTSLWYDLDTGTWTCQRCGYQCPDKYHQPQCTWSCEDRCGHRWKECGNCIPQDGSSDDASAVAAVEI

SEQ ID NO: 1568 - protein, 900 aa, Avian myeloblastosis virus
RATVLTVALHLAIPLKWKPNHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLIVGQILEPLRLKHPSLRMLHYMDDLLLAASSHDGLEAAGEEVISTLERAGFTISPDKVQREPGVQYLGYKLGSTYVAPVGLVAEPRIATLWDVQKLVGSLQSVRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAAQHHWATAIAVLGRPKAIKTDNGSCFTSKSTREWLARWGIAHTTGIPGNSQGQAMVERANRLLKDKIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDITQKDEVTKKDEASPLFAGISDWAPWEGEQEGLQEETASNKQERPGEDTPAANES

SEQ ID NO: 1569 - protein, 1448 aa, Simian immunodeficiency virus
MGARNSVLSGKKADELEKIRLRPGGKKKYMLKHVVWAANELDRFGLAESLLENKEGCQKILSVLAPLVPTGSENLKSLYNTVCVIWCIHAEEKVKHTEEAKQIVQRHLVMETGTAETMPKTSRPTAPFSGRGGNYPVQQIGGNYTHLPLSPRTLNAWVKLIEEKKFGAEVVSGFQALSEGCLPYDINQMLNCVGDHQAAMQIIRDIINEEAADWDLQHPQQAPQQGQLREPSGSDIAGTTSTVEEQIQWMYRQQNPIPVGNIYRRWIQLGLQKCVRMYNPTNILDVKQGPKEPFQSYVDRFYKSLRAEQTDPAVKNWMTQTLLIQNANPDCKLVLKGLGTNPTLEEMLTACQGVGGPGQKARLMAEALKEALAPAPIPFAAAQQKGPRKPIKCWNCGKEGHSARQCRAPRRQGCWKCGKMDHVMAKCPNRQAGFFRPWPLGKEAPQFPHGSSASGADANCSPRRTSCGSAKELHALGQAAERKQREALQGGDRGFAAPQFSLWRRPVVTAHIEGQPVEVLLDTGADDSIVTGIELGPHYTPKIVGGIGGFINTKEYKNVEIEVLGKRIKGTIMTGDTPINIFGRNLLTALGMSLNLPIAKVEPVKSPLKPGKDGPKLKQWPLSKEKIVALREICEKMEKDGQLEEAPPTNPYNTPTFAIKKKDKNKWRMLIDFRELNRVTQDFTEVQLGIPHPAGLAKRKRITVLDIGDAYFSIPLDEEFRQYTAFTLPSVNNAEPGKRYIYKVLPQGWKGSPAIFQYTMRHVLEPFRKANPDVTLVQYMDDILIASDRTDLEHDRVVLQLKELLNSIGFSSPEEKFQKDPPFQWMGYELWPTKWKLQKIELPQRETWTVNDIQKLVGVLNWAAQIYPGIKTKHLCRLIRGKMTLTEEVQWTEMAEAEYEENKIILSQEQEGCYYQESKPLEATVIKSQDNQWSYKIHQEDKILKVGKFAKIKNTHTNGVRLLAHVIQKIGKEAIVIWGQVPKFHLPVEKDVWEQWWTDYWQVTWIPEWDFISTPPLVRLVFNLVKDPIEGEETYYVDGSCSKQSKEGKAGYITDRGKDKVKVLEQTTNQQAELEAFLMALTDSGPKANIIVDSQYVMGIITGCPTESESRLVNQIIEEMIKKTEIYVAWVPAHKGIGGNQEIDHLVSQGIRQVLFLEKIEPAQEEHSKYHSNIKELVFKFGLPRLVAKQIVDTCDKCHQKGEAIHGQVNSDLGTWQMDCTHLEGKIVIVAVHVASGFIEAEVIPQETGRQTALFLLKLASRWPITHLHTDNGANFASQEVKMVAWWAGIEHTFGVPYNPQSQGVVEAMNHHLKNQIDRIREQANSVETIVLMAVHCMNFKRRGGIGDMTPAERLINMITTEQEIQFQQSKNSKFKNFRVYYREGRDQLWKGPGELLWKGEGAVILKVGTDIKVVPRRKAKIIKDYGGGKEMDSSSHMEDTGEAREVA

SEQ ID NO: 1570 - protein, 1603 aa, Rous sarcoma virus
MEAVIKVISSACKTYCGKTSPSKKEIGAMLSLLQKEGLLMSPSDLYSPGSWDPITAALSQRAMILGKSGELKTWGLVLGALKAAREEQVTSEQAKFWLGLGGGRVSPPGPECIEKPATERRIDKGEEVGETTVQRDAKMAPEETATPKTVGTSCYHCGTAIGCNCATASAPPPPYVGSGLYPSLAGVGEQQGQGGDTPPGAEQSRAEPGHAGQAPGPALTDWARVREELASTGPPVVAMPVVIKTEGPAWTPLEPKLITRLADTVRTKGLRSPITMAEVEALMSSPLLPHDVTNLMRVILGPAPYALWMDAWGVQLQTVIAAATRDPRHPANGQGRGERTNLNRLKGLADGMVGNPQGQAALLRPGELVAITASALQAFREVARLAEPAGPWADIMQGPSESFVDFANRLIKAVEGSDLPPSARAPVIIDCFRQKSQPDIQQLIRTAPSTLTTPGEIIKYVLDRQKTAPLTDQGIAAAMSSAIQPLIMAVVNRERDGQTGSGGRARGLCYTCGSPGHYQAQCPKKRKSGNSRERCQLCNGMGHNAKQCRKRDGNQGQRPGKGLSSGPWPGPEPPAVSLAMTMEHKDRPLVRVILTNTGSHPVKQRSVYITALLDSGADITIISEEDWPTDWPVMEAANPQIHGIGGGIPMRKSRDMIELGVINRDGSLERPLLLFPAVAMVRGSILGRDCLQGLGLRLTNLIGRATVLTVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLCMLHYMDDLLLAASSHDGLEAAGEEVISTLERAGFTISPDKVQREPGVQYLGYKLGSTYVAPVGLVAEPRIATLWDVQKLVGSLQWLRPALGIPPRLMGPFYEQLRGSDPNEAREWNLDMKMAWREIVRLSTTAALERWDPALPLEGAVARCEQGAIGVLGQGLSTHPRPCLWLFSTQPTKAFTAWLEVLTLLITKLRASAVRTFGKEVDILLLPACFREDLPLPEGILLALKGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVDTASSAIVVTQHGRVTSVAVQHHWATAIAVLGRPKAIKTDNGSCFTSKSTREWLARWGIAHTTGIPGNSQGQAMVERANRLLKDRIRVLAEGDGFMKRIPTSKQGELLAKAMYALNHFERGENTKTPIQKHWRPTVLTEGPPVKIRIETGEWEKGWNVLVWGRGYAAVKNRDTDKVIWVPSRKVKPDITQKDEVTKKDEASPLFAGISDWIPWEDEQEGLQGETASNKQERPGEDTLAANES

SEQ ID NO: 1571 - protein, 1465 aa, Human immunodeficiency virus 2
MGARGSVLSGKKTDELEKVRLRPGGKKKYMLKHVVWAVNELDRFGLAESLLESKEGCQKILKVLAPLVPTGSENLKSLFNIVCVIFCLHAEEKVKDTEEAKKIAQRHLAADTEKMPATNKPTAPPSGGNYPVQQLAGNYVHLPLSPRTLNAWVKLVEEKKFGAEVVPGFQALSEGCTPYDINQMLNCVGEHQAAMQIIREIINEEAADWDQQHPSPGPMPAGQLRDPRGSDIAGTTSTVEEQIQWMYRAQNPVPVGNIYRRWIQLGLQKCVRMYNPTNILDIKQGPKEPFQSYVDRFYKSLRAEQTDPAVKNWMTQTLLIQNANPDCKLVLKGLGMNPTLEEMLTACQGIGGPGQKARLMAEALKEALTPAPIPFAAVQQKAGKRGTVTCWNCGKQGHTARQCRAPRRQGCWKCGKTGHIMSKCPERQAGFLRVRTLGKEASQLPHDPSASGSDTICTPDEPSRGHDTSGGDTICAPCRSSSGDAEKLHADGETTEREPRETLQGGDRGFAAPQFSLWRRPVVKACIEGQSVEVLLDTGVDDSIVAGIELGSNYTPKIVGGIGGFINTKEYKDVEIEVVGKRVRATIMTGDTPINIFGRNILNTLGMTLNFPVAKVEPVKVELKPGKDGPKIRQWPLSREKILALKEICEKMEKEGQLEEAPPTNPYNTPTFAIKKKDKNKWRMLIDFRELNKVTQDFTEVNWVFPTRQVAEKRRITVIDVGDAYFSIPLDPNFRQYTAFTLPSVNNAEPGKRYIYKVLPQGWKGSQSICQYSMRKVLDPFRKANSDVIIIQYMDDILIASDRSDLEHDRVVSQLKELLNDMGFSTPEEKFQKDPPFKWMGYELWPKKWKLQKIQLPEKEVWTVNAIQKLVGVLNWAAQLFPGIKTRHICKLIRGKMTLTEEVQWTELAEAELQENKIILEQEQEGSYYKERVPLEATVQKNLANQWTYKIHQGNKVLKVGKYAKVKNTHTNGVRLLAHVVQKIGKEALVIWGEIPVFHLPVERETWDQWWTDYWQVTWIPEWDFVSTPPLIRLAYNLVKDPLEGRETYYTDGSCNRTSKEGKAGYVTDRGKDKVKVLEQTTNQQAELEAFALALTDSEPQVNIIVDSQYVMGIIAAQPTETESPIVAKIIEEMIKKEAVYVGWVPAHKGLGGNQEVDHLVSQGIRQVLFLEKIEPAQEEHEKYHGNVKELVHKFGIPQLVAKQIVNSCDKCQQKGEAIHGQVNADLGTWQMDCTHLEGKIIIVAVHVASGFIEAEVIPQETGRQTALFLLKLASRWPITHLHTDNGANFTSPSVKMVAWWVGIEQTFGVPYNPQSQGVVEAMNHHLKNQIDRLRDQAVSIETVVLMATHCMNFKRRGGIGDMTPAERLVNMITTEQEIQFFQAKNLKFQNFQVYYREGRDQLWKGPGELLWKGEGAVIIKVGTEIKVVPRRKAKIIRHYGGGKGLDCSADMEDTRQAREMAQSD

SEQ ID NO: 1572 - protein, 1437 aa, Human immunodeficiency virus 1
MGARASVLSGGELDKWEKIRLRPGGKKKYKLKHIVWASRELERFAVNPGLLETSEGCRQILGQLQPSLQTGSEELRSLYNTVATLYCVHQRIDVKDTKEALEKIEEEQNKSKKKAQQAAAAAGTGNSSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQDVKNWMTETLLVQNANPDCKTILKALGPAATLEEMMTACQGVGGPGHKARVLAEAMSQVTNPANIMMQRGNFRNQRKTVKCFNCGKEGHIAKNCRAPRKKGCWRCGREGHQMKDCTERQANFLREDLAFLQGKAREFSSEQTRANSPTRRELQVWGGENNSLSEAGADRQGTVSFNFPQITLWQRPLVTIRIGGQLKEALLDTGADDTVLEEMNLPGKWKPKMIGGIGGFIKVRQYDQIPVEICGHKAIGTVLVGPTPVNIIGRNLLTQIGCTLNFPISPIETVPVKLKPGMDGPKVKQWPLTEEKIKALVEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSINNETPGIRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIMLPEKDSWTVNDIQKLVGKLNWASQIYAGIKVKQLCKLLRGTKALTEVIPLTEEAELELAENREILKEPVHEVYYDPSKDLVAEIQKQGQGQWTYQIYQEPFKNLKTGKYARMRGAHTNDVKQLTEAVQKVSTESIVIWGKIPKFKLPIQKETWEAWWMEYWQATWIPEWEFVNTPPLVKLWYQLEKEPIVGAETFYVDGAANRETKLGKAGYVTDRGRQKVVSIADTTNQKTELQAIHLALQDSGLEVNIVTDSQYALGIIQAQPDKSESELVSQIIEQLIKKEKVYLAWVPAHKGIGGNEQVDKLVSAGIRKVLFLNGIDKAQEEHEKYHSNWRAMASDFNLPPVVAKEIVASCDKCQLKGEAMHGQVDCSPGIWQLDCTHLEGKIILVAVHVASGYIEAEVIPAETGQETAYFLLKLAGRWPVKTIHTDNGSNFTSTTVKAACWWAGIKQEFGIPYNPQSQGVVESMNNELKKIIGQVRDQAEHLKTAVQMAVFIHNFKRKGGIGGYSAGERIVDIIATDIQTKELQKQITKIQNFRVYYRDNKDPLWKGPAKLLWKGEGAVVIQDNSDIKVVPRRKAKIIRDYGKQMAGDDCVASRQDED

SEQ ID NO: 1573 - protein, 1124 aa, Feline immunodeficiency virus
KEFGKLEGGASCSPSESNAASSNAICTSNGGETIGFVNYNKVGTTTTLEKRPEILIFVNGYPIKFLLDTGADITILNRRDFQVKNSIENGRQNMIGVGGGKRGTNYINVHLEIRDENYKTQCIFGNVCVLEDNSLIQPLLGRDNMIKFNIRLVMAQISDKIPVVKVKMKDPNKGPQIKQWPLTNEKIEALTEIVERLEKEGKVKRADSNNPWNTPVFAIKKKSGKWRMLIDFRELNKLTEKGAEVQLGLPHPAGLQIKKQVTVLDIGDAYFTIPLDPDYAPYTAFTLPRKNNAGPGRRFVWCSLPQGWILSPLIYQSTLDNIIQPFIRQNPQLDIYQYMDDIYIGSNLSKKEHKEKVEELRKLLLWWGFETPEDKLQEEPPYTWMGYELHPLTWTIQQKQLDIPEQPTLNELQKLAGKINWASQAIPDLSIKALTNMMRGNQNLNSTRQWTKEARLEVQKAKKAIEEQVQLGYYDPSKELYAKLSLVGPHQISYQVYQKDPEKILWYGKMSRQKKKAENTCDIALRACYKIREESIIRIGKEPRYEIPTSREAWESNLINSPYLKAPPPEVEYIHAALNIKRALSMIKDAPIPGAETWYIDGGRKLGKAAKAAYWTDTGKWRVMDLEGSNQKAEIQALLLALKAGSEEMNIITDSQYVINIILQQPDMMEGIWQEVLEELEKKTAIFIDWVPGHKGIPGNEEVDKLCQTMMIIEGDGILDKRSEDAGYDLLAAKEIHLLPGEVKVIPTGVKLMLPKGYWGLIIGKSSIGSKGLDVLGGVIDEGYRGEIGVIMINVSRKSITLMERQKIAQLIILPCKHEVLEQGKVVMDSERGDNGYGSTGVFSSWVDRIEEAEINHEKFHSDPQYLRTEFNLPKMVAEEIRRKCPVCRIIGEQVGGQLKIGPGIWQMDCTHFDGKIILVGIHVESGYIWAQIISQETADCTVKAVLQLLSAHNVTELQTDNGPNFKNQKMEGVLNYMGVKHKFGIPGNPQSQALVENVNHTLKVWIQKFLPETTSLDNALSLAVHSLNFKRRGRIGGMAPYELLAQQESLRIQDYFSAIPQKLQAQWIYYKDQKDKKWKGPMRVEYWGQGSVLLKDEEKGYFLIPRRHIRRVPEPCALPEGDE

SEQ ID NO: 1574 - protein, 1145 aa, Equine infectious anemia virus
TAWTFLKAMQKCSKKREARGSREAPETNFPDTTEESAQQICCTRDSSDSKSVPRSERNKKGIQCQGEGSSRGSQPGQFVGVTYNLEKRPTTIVLINDTPLNVLLDTGADTSVLTTAHYNRLKYRGRKYQGTGIIGVGGNVETFSTPVTIKKKGRHIKTRMLVADIPVTILGRDILQDLGAKLVLAQLSKEIKFRKIELKEGTMGPKIPQWPLTKEKLEGAKETVQRLLSEGKISEASDNNPYNSPIFVIKKRSGKWRLLQDLRELNKTVQVGTEISRGLPHPGGLIKCKHMTVLDIGDAYFTIPLDPEFRPYTAFTIPSINHQEPDKRYVWKCLPQGFVLSPYIYQKTLQEILQPFRERYPEVQLYQYMDDLFVGSNGSKKQHKELIIELRAILQKGFETPDDKLQEVPPYSWLGYQLCPENWKVQKMQLDMVKNPTLNDVQKLMGNITWMSSGVPGLTVKHIAATTKGCLELNQKVIWTEEAQKELEENNEKIKNAQGLQYYNPEEEMLCEVEITKNYEATYVIKQSQGILWAGKKIMKANKGWSTVKNLMLLLQHVATESITRVGKCPTFKVPFTKEQVMWEMQKGWYYSWLPEIVYTHQVVHDDWRMKLVEEPTSGITIYTDGGKQNGEGIAAYVTSNGRTKQKRLGPVTHQVAERMAIQMALEDTRDKQVNIVTDSYYCWKNITEGLGLEGPQNPWWPIIQNIREKEIVYFAWVPGHKGIYGNQLADEAAKIKEEIMLAYQGTQIKEKRDEDAGFDLCVPYDIMIPVSDTKIIPTDVKIQVPPNSFGWVTGKSSMAKQGLLINGGIIDEGYTGEIQVICTNIGKSNIKLIEGQKFAQLIILQHHSNSRQPWDENKISQRGDKGFGSTGVFWVENIQEAQDEHENWHTSPKILARNYKIPLTVAKQITQECPHCTKQGSGPAGCVMRSPNHWQADCTHLDNKIILHFVESNSGYIHATLLSKENALCTSLAILEWARLFSPKSLHTDNGTNFVAEPVVNLLKFLKIAHTTGIPYHPESQGIVERANRTLKEKIQSHRDNTQTLEAALQLALITCNKGRESMGGQTPWEVFITNQAQVIHEKLLLQQAQSSKKFCFYKIPGEHDWKGPTRVLWKGDGAVVVNDEGKGIIAVPLTRTKLLIKPN

SEQ ID NO: 1575 - protein, 1475 aa, Bovine immunodeficiency virus
MKRRELEKKLRKVRVTPQQDKYYTIGNLQWAIRMINLMGIKCVCDEECSAAEVALIITQFSALDLENSPIRGKEEVAIKNTLKVFWSLLAGYKPESTETALGYWEAFTYREREARADKEGEIKSIYPSLTQNTQNKKQTSNQTNTQSLPAITTQDGTPRFDPDLMKQLKIWSDATERNGVDLHAVNILGVITANLVQEEIKLLLNSTPKWRLDVQLIESKVREKENAHRTWKQHHPEAPKTDEIIGKGLSSAEQATLISVECRETFRQWVLQAAMEVAQAKHATPGPINIHQGPKEPYTDFINRLVAALEGMAAPETTKEYLLQHLSIDHANEDCQSILRPLGPNTPMEKKLEACRVVGSQKSKMQFLVAAMKEMGIQSPIPAVLPHTPEAYASQTSGPEDGRRCYGCGKTGHLKRNCKQQKCYHCGKPGHQARNCRSKNREVLLCPLWAEEPTTEQFSPEQHEFCDPICTPSYIRLDKQPFIKVFIGGRWVKGLVDTGADEVVLKNIHWDRIKGYPGTPIKQIGVNGVNVAKRKTHVEWRFKDKTGIIDVLFSDTPVNLFGRSLLRSIVTCFTLLVHTEKIEPLPVKVRGPGPKVPQWPLTKEKYQALKEIVKDLLAEGKISEAAWDNPYNTPVFVIKKKGTGRWRMLMDFRELNKITVKGQEFSTGLPYPPGIKECEHLTAIDIKDAYFTIPLHEDFRPFTAFSVVPVNREGPIERFQWNVLPQGWVCSPAIYQTTTQKIIENIKKSHPDVMLYQYMDDLLIGSNRDDHKQIVQEIRDKLGSYGFKTPDEKVQEERVKWIGFELTPKKWRFQPRQLKIKNPLTVNELQQLVGNCVWVQPEVKIPLYPLTDLLRDKTNLQEKIQLTPEAIKCVEEFNLKLKDPEWKDRIREGAELVIKIQMVPRGIVFDLLQDGNPIWGGVKGLNYDHSNKIKKILRTMNELNRTVVIMTGREASFLLPGSSEDWEAALQKEESLTQIFPVKFYRHSCRWTSICGPVRENLTTYYTDGGKKGKTAAAVYWCEGRTKSKVFPGTNQQAELKAICMALLDGPPKMNIITDSRYAYEGMREEPETWAREGIWLEIAKILPFKQYVGVGWVPAHKGIGGNTEADEGVKKALEQMAPCSPPEAILLKPGEKQNLETGIYMQGLRPQSFLPRADLPVAITGTMVDSELQLQLLNIGTEHIRIQKDEVFMTCFLENIPSATEDHERWHTSPDILVRQFHLPKRIAKEIVARCQECKRTTTSPVRGTNPRGRFLWQMDNTHWNKTIIWVAVETNSGLVEAQVIPEETALQVALCILQLIQRYTVLHLHSDNGPCFTAHRIENLCKYLGITKTTGIPYNPQSQGVVERAHRDLKDRLAAYQGDCETVEAALSLALVSLNKKRGGIGGHTPYEIYLESEHTKYQDQLEQQFSKQKIEKWCYVRNRRKEWKGPYKVLWDGDGAAVIEEEGKTALYPHRHMRFIPPPDSDIQDGSS

SEQ ID NO: 1576 - protein, 873 aa, unidentified
  source 1..873: note = Description of Unknown:Avian leukosis and sarcoma virus sequence
TVALHLAIPLKWKPDHTPVWIDQWPLPEGKLVALTQLVEKELQLGHIEPSLSCWNTPVFVIRKASGSYRLLHDLRAVNAKLVPFGAVQQGAPVLSALPRGWPLMVLDLKDCFFSIPLAEQDREAFAFTLPSVNNQAPARRFQWKVLPQGMTCSPTICQLVVGQVLEPLRLKHPSLRMLHYMDDLLLAASSHDGLEAAGEEVISTLERAGFTISPDKIQREPGVQYLGYKLGSTYVAPVGLVAEPRIATLWDVQKLVGSLQWLRPALGIPPRLMGPFYEQLRGSDPNEAREWNLDMKMAWREIVQLSTTAALERWDPALPLEGAVARCEQGAIGVLGQGLSTHPRPCLWLFSTQPTKAFTAWLEVLTLLITKLRASAVRTFGKEVDVLLLPACFREDLPLPEGILLALRGFAGKIRSSDTPSIFDIARPLHVSLKVRVTDHPVPGPTVFTDASSSTHKGVVVWREGPRWEIKEIADLGASVQQLEARAVAMALLLWPTTPTNVVTDSAFVAKMLLKMGQEGVPSTAAAFILEDALSQRSAMAAVLHVRSHSEVPGFFTEGNDVADSQATFQAYPLREAKDLHTALHIGPRALSKACNISMQQAREVVQTCPHCNSAPALEAGVNPRGLGPLQIWQTDFTLEPRMAPRSWLAVTVATASSAIVVTQHGRVTSVAARHHWATAIAVLGRPKAIKTDNGSCFTSKSTREWLARWGIAHTTGIPGNSQGQAMVERANRLLKDKIRVLAEGDGFMKRIPTGKQGELLAKAMYALNHFERGENTKTPIQKHWRPTVLTEGPPVKIRIETGEWEKGWNVLVWGRGYAAVKNRDTDKIIWVPSRKVKPDITQKDELTKKDEASPLFAGISDWAPWKGEQEGL

SEQ ID NO: 1577 - protein, 9 aa, unidentified
  source 1..9: note = Description of Unknown:LAGLIDADG family peptide sequence
LAGLIDADG

SEQ ID NO: 1578-1582 - skipped (5 entries)

SEQ ID NO: 1583 - protein, 4 aa, synthetic construct
  source 1..4: note = Description of Artificial Sequence: Synthetic peptide
SGGS

SEQ ID NO: 1584 - protein, 4 aa, synthetic construct
  source 1..4: note = Description of Artificial Sequence: Synthetic peptide
GGGS

SEQ ID NO: 1585 - protein, 1367 aa, synthetic construct
  source 1..1367: note = Description of Artificial Sequence: Synthetic polypeptide
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1586 - protein, 672 aa, Murine leukemia virus
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAAITETPDTSTLLI

SEQ ID NO: 1587 - protein, 660 aa, Murine leukemia virus
TLNIEDEHRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFDEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGTAGFCRLWIPGFAEMAAPLYPLTKTGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGLLTSEGKEIKNKDEILALLKALFLPKRLSIIHCPGHQKGHSAEARGNRMADQAARKAA

SEQ ID NO: 1588 - protein, 672 aa, Murine leukemia virus
TLNIEDEYRLHETSKEPDVSLGSTWLSDFPQAWAETGGMGLAVRQAPLIIPLKATSTPVSIKQYPMSQEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPEMGISGQLTWTRLPQGFKNSPTLFNEALHRDLADFRIQHPDLILLQYVDDLLLAATSELDCQQGTRALLQTLGNLGYRASAKKAQICQKQVKYLGYLLKEGQRWLTEARKETVMGQPTPKTPRQLREFLGKAGFCRLFIPGFAEMAAPLYPLTKPGTLFNWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQALLLDTDRVQFGPVVALNPATLLPLPEEGLQHNCLDILAEAHGTRPDLTDQPLPDADHTWYTDGSSLLQEGQRKAGAAVTTETEVIWAKALPAGTSAQRAELIALTQALKMAEGKKLNVYTDSRYAFATAHIHGEIYRRRGWLTSEGKEIKNKDEILALLKALFLPKRLSIIHCPGHQKGHSAEARGNRMADQAARKAAITETPDTSTLLI

SEQ ID NO: 1589 - protein, 33 aa, synthetic construct
  source 1..33: note = Description of Artificial Sequence: Synthetic polypeptide
SGGSSGGSSGSETPGTSESATPESSGGSSGGSS

SEQ ID NO: 1590 - protein, 1369 aa, synthetic construct
  source 1..1369: note = Description of Artificial Sequence: Synthetic polypeptide
SMDKKYSIGLAIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1591 - DNA, 76 bp, synthetic construct
  source 1..76: mol_type = other DNA; note = Description of Artificial Sequence: Synthetic oligonucleotide
gttttagagctagaaatagcaagttaaaataaggctagtccgttatcaacttgaaaaagtgggaccgagtcggtcc

SEQ ID NO: 1592 - protein, 30 aa, synthetic construct
  source 1..30: note = Description of Artificial Sequence: Synthetic polypeptide
MDSLLMNRRKFLYQFKNVRWAKGRRETYLC

SEQ ID NO: 1593 - protein, 28 aa, synthetic construct
  source 1..28: note = Description of Artificial Sequence: Synthetic peptide
PKKRKVEGADKRTADGSEFESPKKKRKV

SEQ ID NO: 1594 - protein, 22 aa, synthetic construct
  source 1..22: note = Description of Artificial Sequence: Synthetic peptide
RKSGKIAAIWKRPRKPKKKRKV

SEQ ID NO: 1595 - protein, 18 aa, synthetic construct
  source 1..18: note = Description of Artificial Sequence: Synthetic peptide
KRTADGSEFESPKKKRKV

SEQ ID NO: 1596 - protein, 17 aa, synthetic construct
  source 1..17: note = Description of Artificial Sequence: Synthetic peptide
KKTELQTTNAENKTKKL

SEQ ID NO: 1597 - protein, 19 aa, synthetic construct
  source 1..19: note = Description of Artificial Sequence: Synthetic peptide
KRGINDRNFWRGENGRKTR

SEQ ID NO: 1598 - protein, 16 aa, synthetic construct
  source 1..16: note = Description of Artificial Sequence: Synthetic peptide
KRPAATKKAGQAKKKK

SEQ ID NO: 1599 - DNA, 50 bp, synthetic construct
  source 1..50: mol_type = other DNA; note = Description of Artificial Sequence: Synthetic oligonucleotide
  misc_difference 1: note = a, c, t, g, unknown or other
  misc_difference 2: note = a, c, t, g, unknown or other
  misc_difference 3: note = a, c, t, g, unknown or other
  misc_difference 4: note = a, c, t, g, unknown or other
  misc_difference 5: note = a, c, t, g, unknown or other
  misc_difference 6: note = a, c, t, g, unknown or other
  misc_difference 7: note = a, c, t, g, unknown or other
  misc_difference 44: note = a, c, t, g, unknown or other
  misc_difference 45: note = a, c, t, g, unknown or other
  misc_difference 46: note = a, c, t, g, unknown or other
  misc_difference 47: note = a, c, t, g, unknown or other
  misc_difference 48: note = a, c, t, g, unknown or other
  misc_difference 49: note = a, c, t, g, unknown or other
  misc_difference 50: note = a, c, t, g, unknown or other
nnnnnnnatgatgatgatgatgatgatgatgatgatgatgatgnnnnnnn

SEQ ID NO: 1600 - protein, 29 aa, synthetic construct
  source 1..29: note = Description of Artificial Sequence: Synthetic peptide
PKKKRKVEGADKRTADGSEFESPKKKRKV

SEQ ID NO: 1601 - DNA, 26 bp, Homo sapiens
  source 1..26: mol_type = unassigned DNA
ctgacccttctctctctcccccagag

SEQ ID NO: 1602 - DNA, 15 bp, Homo sapiens
  source 1..15: mol_type = unassigned DNA
tttctctcccacaag

SEQ ID NO: 1603 - RNA, 47 nt, synthetic construct
  source 1..47: mol_type = other RNA; note = Description of Artificial Sequence: Synthetic oligonucleotide
gggaaataagagagaaaagaagagtaagaagaaatataagagccacc

SEQ ID NO: 1604 - RNA, 110 nt, synthetic construct
  source 1..110: mol_type = other RNA; note = Description of Artificial Sequence: Synthetic polynucleotide
tgataataggctggagcctcggtggccatgcttcttgccccttgggcctccccccagcccctcctccccttcctgcacccgtacccccgtggtctttgaataaagtctga

SEQ ID NO: 1605 - DNA, 12 bp, Homo sapiens
  source 1..12: mol_type = unassigned DNA
ctggggctgggg

SEQ ID NO: 1606 - DNA, 12 bp, unidentified
  source 1..12: mol_type = unassigned DNA; note = Description of Unknown:Myoclonic epilepsy of Unverricht and Lundborg repeat sequence
ccccgccccgcg

SEQ ID NO: 1607 - DNA, 133 bp, synthetic construct
  source 1..133: mol_type = other DNA; note = Description of Artificial Sequence: Synthetic polynucleotide
tcccctccaggccgtgcatagttttagagctagaaatagcaagttaaaataaggctagtccgttatcaacttgaaaaagtgggaccgagtcggtcctcgtcgatggtcagcacagccttatgcacggcctgga

SEQ ID NO: 1608 - DNA, 20 bp, synthetic construct
  source 1..20: mol_type = other DNA; note = Description of Artificial Sequence: Synthetic oligonucleotide
tttgttgaacttgacctcgg

SEQ ID NO: 1609 - DNA, 118 bp, synthetic construct
  source 1..118: mol_type = other DNA; note = Description of Artificial Sequence: Synthetic polynucleotide
accattaaagaaaatatcatgttttagagctagaaatagcaagttaaaataaggctagtccgttatcaacttgaaaaagtgggaccgagtcggtccaccaaagatgatattttcttta

SEQ ID NO: 1610 - DNA, 20 bp, synthetic construct
  source 1..20: mol_type = other DNA; note = Description of Artificial Sequence: Synthetic oligonucleotide
aaagatgatattttctttaa

SEQ ID NO: 1611 - DNA, 118 bp, synthetic construct
  source 1..118: mol_type = other DNA; note = Description of Artificial Sequence: Synthetic polynucleotide
gtaacggcagacttctccacgttttagagctagaaatagcaagttaaaataaggctagtccgttatcaacttgaaaaagtgggaccgagtcggtccgactcctgaggagaagtctgcc

SEQ ID NO: 1612 - DNA, 20 bp, synthetic construct
  source 1..20: mol_type = other DNA; note = Description of Artificial Sequence: Synthetic oligonucleotide
tggtgaggccctgggcaggt

SEQ ID NO: 1613 - DNA, 118 bp, synthetic construct
  source 1..118: mol_type = other DNA; note = Description of Artificial Sequence: Synthetic polynucleotide
ttggtgactgccacgcccaagttttagagctagaaatagcaagttaaaataaggctagtccgttatcaacttgaaaaagtgggaccgagtcggtccacaccccttgggcgtggcagtc

SEQ ID NO: 1614 - DNA, 20 bp, synthetic construct
  source 1..20: mol_type = other DNA; note = Description of Artificial Sequence: Synthetic oligonucleotide
ggccagcagtgaacacccct

SEQ ID NO: 1615 - DNA, 118 bp, synthetic construct
  source 1..118: mol_type = other DNA; note = Description of Artificial Sequence: Synthetic polynucleotide
actcaggaacactgctggttgttttagagctagaaatagcaagttaaaataaggctagtccgttatcaacttgaaaaagtgggaccgagtcggtccttcactgaaccagcagtgttcc

SEQ ID NO: 1616 - DNA, 20 bp, synthetic construct
  source 1..20: mol_type = other DNA; note = Description of Artificial Sequence: Synthetic oligonucleotide
ttggttgaaaatgattttgt

SEQ ID NO: 1617 - DNA, 129 bp, synthetic construct
  source 1..129: mol_type = other DNA; note = Description of Artificial Sequence: Synthetic polynucleotide
ccagggaaaacgcacccacggttttagagctagaaatagcaagttaaaataaggctagtccgttatcaacttgaaaaagtgggaccgagtcggtcctcccagcggtaggtgccccgtgggtgcgttttc

SEQ ID NO: 1618 - DNA, 20 bp, synthetic construct
  source 1..20: mol_type = other DNA; note = Description of Artificial Sequence: Synthetic oligonucleotide
ctccttctttgcgctcccag

SEQ ID NO: 1619 - DNA, 118 bp, synthetic construct
  source 1..118: mol_type = other DNA; note = Description of Artificial Sequence: Synthetic polynucleotide
gccctccccttctctgcccagttttagagctagaaatagcaagttaaaataaggctagtccgttatcaacttgaaaaagtgggaccgagtcggtccggtactgtgggcagagaagggg

SEQ ID NO: 1620 - DNA, 20 bp, synthetic construct
  source 1..20: mol_type = other DNA; note = Description of Artificial Sequence: Synthetic oligonucleotide
tcaggcaacgccaggtactg

SEQ ID NO: 1621 - DNA, 188 bp, synthetic construct
  source 1..188: mol_type = other DNA; note = Description of Artificial Sequence: Synthetic polynucleotide
ctcgaagggtccttgtagccgttttagagctagaaatagcaagttaaaataaggctagtccgttatcaacttgaaaaagtgggaccgagtcggtccgtgatccccccagcagcagcagcagcagcagcagcagcagcagcagcagcagcagcagcagcagcagcagcattcccggctacaaggaccct

SEQ ID NO: 1622 - DNA, 20 bp, synthetic construct
  source 1..20: mol_type = other DNA; note = Description of Artificial Sequence: Synthetic oligonucleotide
atcacaggactggagctggg

SEQ ID NO: 1623 - DNA, 252 bp, synthetic construct
  source 1..252: mol_type = other DNA; note = Description of Artificial Sequence: Synthetic polynucleotide
accactgcactccagcctaggttttagagctagaaatagcaagttaaaataaggctagtccgttatcaacttgaaaaagtgggaccgagtcggtccgtgtctgtctgtctgtctgtctgtctgtctgtctgtctgtctgcctgcctgcctgcctgcctgcctgcctgcctggctgcctgtctgcctgtctgcctgcctgcctgcctgcctgcctgcctgtctgtctcactttgtcccctaggctggagtgca

SEQ ID NO: 1624 - DNA, 20 bp, synthetic construct
  source 1..20: mol_type = other DNA; note = Description of Artificial Sequence: Synthetic oligonucleotide
gcctcagcctcctgagtagc

SEQ ID NO: 1625 - DNA, 188 bp, synthetic construct
  source 1..188: mol_type = other DNA; note = Description of Artificial Sequence: Synthetic polynucleotide
gggggcgtgcggcagcgcgggttttagagctagaaatagcaagttaaaataaggctagtccgttatcaacttgaaaaagtgggaccgagtcggtcctgcgggcgctcgaggcccagccgccgccgccgccgccgccgccgccgcctccgccgccgccgccgccgccgccgccgccgcgctgccgcacg

SEQ ID NO: 1626 - DNA, 20 bp, synthetic construct
  source 1..20: mol_type = other DNA; note = Description of Artificial Sequence: Synthetic oligonucleotide
gctcagaggcggccctccac

SEQ ID NO: 1627 - DNA, 188 bp, synthetic construct
  source 1..188: mol_type = other DNA; note = Description of Artificial Sequence: Synthetic polynucleotide
caggcgcgcgacaccacgccgttttagagctagaaatagcaagttaaaataaggctagtccgttatcaacttgaaaaagtgggaccgagtcggtccaacccagtatctactaaaaaatacaaaaaaaaaaaaaaaagaagaagaagaagaagaaaataaagaaaagttagccgggcgtggtgtcgcgc

SEQ ID NO: 1628 - DNA, 20 bp, synthetic construct
  source 1..20: mol_type = other DNA; note = Description of Artificial Sequence: Synthetic oligonucleotide
cgcttgagcccgggaggcag

SEQ ID NO: 1629 - DNA, 221 bp, synthetic construct
  source 1..221: mol_type = other DNA; note = Description of Artificial Sequence: Synthetic polynucleotide
ggcggctgaggaagctgagggttttagagctagaaatagcaagttaaaataaggctagtccgttatcaacttgaaaaagtgggaccgagtcggtccagtccctcaagtccttccagcagcagcagcagcagcagcagcagcagcagcagcagcagcagcagcagcagcagcaacagccgccaccgccgccgccgccgccgccgcctcctcagcttcctcag

SEQ ID NO: 1630 - DNA, 20 bp, synthetic construct
  source 1..20: mol_type = other DNA; note = Description of Artificial Sequence: Synthetic oligonucleotide
cgctgcaccgaccgtgagtt

SEQ ID NO: 1631 - DNA, 214 bp, synthetic construct
  source 1..214: mol_type = other DNA; note = Description of Artificial Sequence: Synthetic polynucleotide
tgagccccggagccctgctggttttagagctagaaatagcaagttaaaataaggctagtccgttatcaacttgaaaaagtgggaccgagtcggtccacaaggctgagcagcagcagcagcagcagcagcagcagcagcagcagcatcagcatcagcagcagcagcagcagcagcagcagcagcagcagcagcagcacctcagcagggctccggg

SEQ ID NO: 1632 - DNA, 20 bp, synthetic construct
  source 1..20: mol_type = other DNA; note = Description of Artificial Sequence: Synthetic oligonucleotide
tccagttctccgcagaacac

SEQ ID NO: 1633 - DNA, 62 bp, synthetic construct
  source 1..62: mol_type = other DNA; note = Description of Artificial Sequence: Synthetic oligonucleotide
cactcctccccatcctctccctctgtccctctgtccctctgaccctgcactgtcccagcacc

SEQ ID NO: 1634 - DNA, 122 bp, synthetic construct
  source 1..122: mol_type = other DNA; note = Description of Artificial Sequence: Synthetic polynucleotide
caggacacagccttggatcaggacagagacttgggggccatcctgcccctccaacccgacatgtgtacctcagctttttccctcacttgcatcaataaagcttctgtgtttggaacagctaa

SEQ ID NO: 1635 - DNA, 43 bp, synthetic construct
  source 1..43: mol_type = other DNA; note = Description of Artificial Sequence: Synthetic oligonucleotide
  misc_difference 37: note = a, c, t, g, unknown or other
  misc_difference 38: note = a, c, t, g, unknown or other
  misc_difference 39: note = a, c, t, g, unknown or other
  misc_difference 40: note = a, c, t, g, unknown or other
  misc_difference 41: note = a, c, t, g, unknown or other
  misc_difference 42: note = a, c, t, g, unknown or other
  misc_difference 43: note = a, c, t, g, unknown or other
atgatgatgatgatgatgatgatgatgatgatgatgnnnnnnn

SEQ ID NO: 1636 - DNA, 22 bp, synthetic construct
  source 1..22: mol_type = other DNA; note = Description of Artificial Sequence: Synthetic oligonucleotide
  misc_difference 1: note = a, c, t, g, unknown or other
  misc_difference 2: note = a, c, t, g, unknown or other
  misc_difference 3: note = a, c, t, g, unknown or other
  misc_difference 4: note = a, c, t, g, unknown or other
  misc_difference 5: note = a, c, t, g, unknown or other
  misc_difference 6: note = a, c, t, g, unknown or other
  misc_difference 7: note = a, c, t, g, unknown or other
  misc_difference 20: note = a, c, t, g, unknown or other
  misc_difference 21: note = a, c, t, g, unknown or other
  misc_difference 22: note = a, c, t, g, unknown or other
nnnnnnncatcatcatcatnnn

SEQ ID NO: 1637 - DNA, 306 bp, synthetic construct
  source 1..306: mol_type = other DNA; note = Description of Artificial Sequence: Synthetic polynucleotide
tgcctgtcatacgaaaccgagatactgacagtagaatatggccttctgccaatcgggaagattgtggagaaacggatagaatgcacagtttactctgtcgataacaatggtaacatttatactcagccagttgcccagtggcacgaccggggagagcaggaagtattcgaatactgtctggaggatggaagtctcattagggccactaaggaccacaaatttatgacagtcgatggccagatgctgcctatagacgaaatctttgagcgagagttggacctcatgcgagttgacaaccttcctaat

SEQ ID NO: 1638 - protein, 102 aa, synthetic construct
  source 1..102: note = Description of Artificial Sequence: Synthetic polypeptide
CLSYETEILTVEYGLLPIGKIVEKRIECTVYSVDNNGNIYTQPVAQWHDRGEQEVFEYCLEDGSLIRATKDHKFMTVDGQMLPIDEIFERELDLMRVDNLPN

SEQ ID NO: 1639 - DNA, 108 bp, synthetic construct
  source 1..108: mol_type = other DNA; note = Description of Artificial Sequence: Synthetic polynucleotide
atgatcaagatagctacaaggaagtatcttggcaaacaaaacgtttatgatattggagtcgaaagagatcacaactttgctctgaagaacggattcatagcttctaat

SEQ ID NO: 1640 - protein, 36 aa, synthetic construct
  source 1..36: note = Description of Artificial Sequence: Synthetic polypeptide
MIKIATRKYLGKQNVYDIGVERDHNFALKNGFIASN

SEQ ID NO: 1641 - DNA, 303 bp, synthetic construct
  source 1..303: mol_type = other DNA; note = Description of Artificial Sequence: Synthetic polynucleotide
tgcctgtcttatgataccgagatacttaccgttgaatatggcttcttgcctattggaaagattgtcgaagagagaattgaatgcacagtatatactgtagacaagaatggtttcgtttacacacagcccattgctcaatggcacaatcgcggcgaacaagaagtatttgagtactgtctcgaggatggaagcatcatacgagcaactaaagatcataaattcatgaccactgacgggcagatgttgccaatagatgagatattcgagcggggcttggatctcaaacaagtggatggattgcca

SEQ ID NO: 1642 - protein, 101 aa, synthetic construct
  source 1..101: note = Description of Artificial Sequence: Synthetic polypeptide
CLSYDTEILTVEYGFLPIGKIVEERIECTVYTVDKNGFVYTQPIAQWHNRGEQEVFEYCLEDGSIIRATKDHKFMTTDGQMLPIDEIFERGLDLKQVDGLP

SEQ ID NO: 1643 - DNA, 159 bp, synthetic construct
  source 1..159: mol_type = other DNA; note = Description of Artificial Sequence: Synthetic polynucleotide
atgaagaggactgccgatggatcagagtttgaatctcccaagaagaagaggaaagtaaagataatatctcgaaaaagtcttggtacccaaaatgtctatgatattggagtggagaaagatcacaacttccttctcaagaacggtctcgtagccagcaac

SEQ ID NO: 1644 - protein, 53 aa, synthetic construct
  source 1..53: note = Description of Artificial Sequence: Synthetic polypeptide
MKRTADGSEFESPKKKRKVKIISRKSLGTQNVYDIGVEKDHNFLLKNGLVASN

SEQ ID NO: 1645 - DNA, 50 bp, synthetic construct
  source 1..50: mol_type = other DNA; note = Description of Artificial Sequence: Synthetic oligonucleotide
  misc_difference 1: note = a, c, t, g, unknown or other
  misc_difference 2: note = a, c, t, g, unknown or other
  misc_difference 3: note = a, c, t, g, unknown or other
  misc_difference 4: note = a, c, t, g, unknown or other
  misc_difference 5: note = a, c, t, g, unknown or other
  misc_difference 6: note = a, c, t, g, unknown or other
  misc_difference 7: note = a, c, t, g, unknown or other
  misc_difference 44: note = a, c, t, g, unknown or other
  misc_difference 45: note = a, c, t, g, unknown or other
  misc_difference 46: note = a, c, t, g, unknown or other
  misc_difference 47: note = a, c, t, g, unknown or other
  misc_difference 48: note = a, c, t, g, unknown or other
  misc_difference 49: note = a, c, t, g, unknown or other
  misc_difference 50: note = a, c, t, g, unknown or other
nnnnnnncatcatcatcatcatcatcatcatcatcatcatcatnnnnnnn

SEQ ID NO: 1646 - protein, 1288 aa, synthetic construct
  source 1..1288: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAGGGSCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1647 - protein, 1276 aa, synthetic construct
  source 1..1276: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAGGGSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1648 - protein, 1300 aa, synthetic construct
  source 1..1300: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAASGSETPGTSESATPESCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1649 - protein, 1288 aa, synthetic construct
  source 1..1288: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAASGSETPGTSESATPESTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1650 - protein, 1265 aa, synthetic construct
  source 1..1265: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLGGGSCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1651 - protein, 1253 aa, synthetic construct
  source 1..1253: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLGGGSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1652 - protein, 1277 aa, synthetic construct
  source 1..1277: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLSGSETPGTSESATPESCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1653 - protein, 1265 aa, synthetic construct
  source 1..1265: note = Description of Artificial Sequence: Synthetic polypeptide
MASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLSGSETPGTSESATPESTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1654 - DNA, 320 bp, unidentified
  source 1..320: mol_type = unassigned DNA; note = Description of Unknown:R2Tg landing pad sequence
gctcacacaggaaacagctatgaccatgattacgccaagctgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaaattcactggccgtcgttttacaacgtcgtgactgggaaaaccctggcgttacccaacttaatcgccttgcagcacatcc

SEQ ID NO: 1655 - DNA, 320 bp, synthetic construct
  source 1..320: mol_type = other DNA; note = Description of Artificial Sequence: Synthetic polynucleotide
gctcacacaggaaacagctatgaccatgattacgccaagctgttgacgcgatgtgatttctgcccagtgctctgaatgtcaaagtgaagaaattcaatgaagcgcgggtaaacggcgggagtaactatgactctctttccaatatgatttgcctcgtcatctaattagtgacgcgcatgaatggatgaacgagattcccactgtccctacctactatccagcgaaaccacagccaagggaaattcactggccgtcgttttacaacgtcgtgactgggaaaaccctggcgttacccaacttaatcgccttgcagcacatcc

SEQ ID NO: 1656 - DNA, 320 bp, synthetic construct
  source 1..320: mol_type = other DNA; note = Description of Artificial Sequence: Synthetic polynucleotide
gctcacacaggaaacagctatgaccatgattacgccaagctgttgacgcgatgtgatttctgcccagtgctctgaatgtcaaagtgaagaaattcaatgaagcgcgggtaaacggcgggagtaactatgactctctttccaatatgattccacccatggcaaattccatggcaccgtcaaggctgagaacgggaagcttgtcatcaatggaaactatccagcgaaaccacagccaagggaaattcactggccgtcgttttacaacgtcgtgactgggaaaaccctggcgttacccaacttaatcgccttgcagcacatcc

SEQ ID NO: 1657 - DNA, 13 bp, synthetic construct
  source 1..13: mol_type = other DNA; note = Description of Artificial Sequence: Synthetic oligonucleotide
taaggtagccaaa

SEQ ID NO: 1658 - protein, 991 aa, synthetic construct
  source 1..991: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSGGGSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1659 - protein, 1003 aa, synthetic construct
  source 1..1003: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1660 - protein, 1003 aa, synthetic construct
  source 1..1003: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSGGGSCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1661 - protein, 1015 aa, synthetic construct
  source 1..1015: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1662 - protein, 991 aa, synthetic construct
  source 1..991: note = Description of Artificial Sequence: Synthetic polypeptide
MGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSGGGSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1663 - protein, 1003 aa, synthetic construct
  source 1..1003: note = Description of Artificial Sequence: Synthetic polypeptide
MGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1664 - protein, 1003 aa, synthetic construct
  source 1..1003: note = Description of Artificial Sequence: Synthetic polypeptide
MGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSGGGSCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1665 - protein, 1015 aa, synthetic construct
  source 1..1015: note = Description of Artificial Sequence: Synthetic polypeptide
MGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1666 - protein, 1132 aa, synthetic construct
  source 1..1132: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSGGGSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1667 - protein, 1144 aa, synthetic construct
  source 1..1144: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1668 - protein, 1531 aa, synthetic construct
  source 1..1531: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1669 - protein, 1531 aa, synthetic construct
  source 1..1531: note = Description of Artificial Sequence: Synthetic polypeptide
MGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1670 - protein, 1672 aa, synthetic construct
  source 1..1672: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1671 - protein, 1531 aa, synthetic construct
  source 1..1531: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPSPSSGTRVNSVLNLIEHLKVSHGKRGVCFRCAKCGKENSNYHSVVCHFPKCRGPETEKAPAGEWISEVSNRDFTTKIGLGQHKRLAHPAVRNQERIVASQPKETSNRGAHKACATKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1672 - protein, 1531 aa, synthetic construct
  source 1..1531: note = Description of Artificial Sequence: Synthetic polypeptide
MGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPSPSSGTRVNSVLNLIEHLKVSHGKRGVCFRCAKCGKENSNYHSVVCHFPKCRGPETEKAPAGEWISEVSNRDFTTKIGLGQHKRLAHPAVRNQERIVASQPKETSNRGAHKACATKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1673 - protein, 1672 aa, synthetic construct
  source 1..1672: note = Description of Artificial Sequence: Synthetic polypeptide
MGIHGVPAAMAERPFQCRICMRNFSYNWHLQRHIRTHTGEKPFACDICGRKFARSDHLTTHTKIHTGSQKPFQCRICMRNFSHNYARDCHIRTHTGEKPFACDICGRKFAQNSTRIGHTKIHLRGSSGSETPGTSESATPESGIHGVPAAMAERPFQCRICMRNFSQSSNLARHIRTHTGEKPFACDICGRKFARTDYLVDHTKIHTGSQKPFQCRICMRNFSYNTHLTRHIRTHTGEKPFACDICGRKFAQGYNLAGHTKIHLRGSSGSETPGTSESATPESASCPKPGPPVSAGAMSLESGLTTHSVLAIERGPNSLANSGSDFGGGGLGLPLRLLRVSVGTQTSRSDWVDLVSWSHPGPTSKSQQVDLVSLFPKHRVDLLSKNDQVDLVAQFLPSKFPPNLAENDLALLVNLEFYRSDLHVYECVHFAAHWEGLSGLPEVYEQLAPQPCVGETLHSSLPRDSELFVPEEGSSEKESEDAPKTSPPTPGKHGLEQTGEEKVMVTVPDKNPPSPSSGTRVNSVLNLIEHLKVSHGKRGVCFRCAKCGKENSNYHSVVCHFPKCRGPETEKAPAGEWISEVSNRDFTTKIGLGQHKRLAHPAVRNQERIVASQPKETSNRGAHKACATKEEEELLIRLEAQFEGNKNINKLIAEHITTKTAKQISDKRRLLSRKPAEEPREEPGTCHHTRRAAASLRTEPEMSHHAQAEDRDNGPGRRPLPGRAAAGGRTMDEIRRHPDKGNGQQRPTKQKSEEQLQAYYKKTLEERLSAGALNTFPRAFKQVMEGRDIKLVINQTAQDCFGCLESISQIRTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1674 - protein, 2278 aa, synthetic construct
  source 1..2278: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1675 - protein, 2278 aa, synthetic construct
  source 1..2278: note = Description of Artificial Sequence: Synthetic polypeptide
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1676 - protein, 2278 aa, synthetic construct
  source 1..2278: note = Description of Artificial Sequence: Synthetic polypeptide
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1677 - protein, 2278 aa, synthetic construct
  source 1..2278: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1678 - protein, 2278 aa, synthetic construct
  source 1..2278: note = Description of Artificial Sequence: Synthetic polypeptide
MAPKKKRKVGIHGVPAADKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPALIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1679 - protein, 2278 aa, synthetic construct
  source 1..2278: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPALIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1680 - protein, 2278 aa, synthetic construct
  source 1..2278: note = Description of Artificial Sequence: Synthetic polypeptide
MAPKKKRKVGIHGVPAADKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSSGGSSGSETPGTSESATPESSGGSSGGSSTATRDKKDTVTREKHPKKPFQKWMKDRAIKKGNYLRFQRLFYLDRGKLAKIILDDIECLSCDIPLSEIYSVFKTRWETTGSFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLKTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIVNFERDKISNHWIQYYRRIPHRKLLTALQLRANVYPTREFLARGRQDQYIKACRHCDADIESCAHIIGNCPVTQDARIKRHNYICELLLEEAKKKDWVVFKEPHIRDSNKELYKPALIFVKDARALVVDVTVRYEAAKSSLEEAAAEKVRKYKHLETEVRHLTNAKDVTFVGFPLGARGKWHQDNFKLLTELGLSKSRQVKMAETFSTVALFSSVDIVHMFASRARKSMVM

SEQ ID NO: 1681 - protein, 27 aa, unidentified
  source 1..27: note = Description of Unknown:R2Tg NoLS sequence
APTQKDKFPKPCNWRKNEFKKWTKLAS

SEQ ID NO: 1682 - protein, 27 aa, synthetic construct
  source 1..27: note = Description of Artificial Sequence: Synthetic peptide
APTQADAFPAPCNWRANEFAAWTALAS

SEQ ID NO: 1683 - RNA, 100 nt, synthetic construct
  source 1..100: mol_type = other RNA; note = Description of Artificial Sequence: Synthetic polynucleotide
  misc_difference 1..100: note = This sequence may encompass 96-100 nucleotides
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1684 - RNA, 23 nt, unidentified
  source 1..23: mol_type = unassigned RNA; note = Description of Unknown:miR-142 sequence
tgtagtgtttcctactttatgga

SEQ ID NO: 1685 - DNA, 188 bp, synthetic construct
  source 1..188: mol_type = other DNA; note = Description of Artificial Sequence: Synthetic polynucleotide
ggcggctgaggaagctgagggttttagagctagaaatagcaagttaaaataaggctagtccgttatcaacttgaaaaagtgggaccgagtcggtccagtccctcaagtccttccagcagcagcagcagcagcagcagcagcagccgccaccgccgccgccgccgccgccgcctcctcagcttcctcag

SEQ ID NO: 1686 - DNA, 26 bp, synthetic construct
  source 1..26: mol_type = other DNA; note = Description of Artificial Sequence: Synthetic oligonucleotide
  misc_difference 1: note = a, c, t, g, unknown or other
  misc_difference 2: note = a, c, t, g, unknown or other
  misc_difference 3: note = a, c, t, g, unknown or other
  misc_difference 4: note = a, c, t, g, unknown or other
  misc_difference 5: note = a, c, t, g, unknown or other
  misc_difference 6: note = a, c, t, g, unknown or other
  misc_difference 7: note = a, c, t, g, unknown or other
  misc_difference 20: note = a, c, t, g, unknown or other
  misc_difference 21: note = a, c, t, g, unknown or other
  misc_difference 22: note = a, c, t, g, unknown or other
  misc_difference 23: note = a, c, t, g, unknown or other
  misc_difference 24: note = a, c, t, g, unknown or other
  misc_difference 25: note = a, c, t, g, unknown or other
  misc_difference 26: note = a, c, t, g, unknown or other
nnnnnnnatgatgatgatgnnnnnnn

SEQ ID NO: 1687 - DNA, 26 bp, synthetic construct
  source 1..26: mol_type = other DNA; note = Description of Artificial Sequence: Synthetic oligonucleotide
  misc_difference 1: note = a, c, t, g, unknown or other
  misc_difference 2: note = a, c, t, g, unknown or other
  misc_difference 3: note = a, c, t, g, unknown or other
  misc_difference 4: note = a, c, t, g, unknown or other
  misc_difference 5: note = a, c, t, g, unknown or other
  misc_difference 6: note = a, c, t, g, unknown or other
  misc_difference 7: note = a, c, t, g, unknown or other
  misc_difference 20: note = a, c, t, g, unknown or other
  misc_difference 21: note = a, c, t, g, unknown or other
  misc_difference 22: note = a, c, t, g, unknown or other
  misc_difference 23: note = a, c, t, g, unknown or other
  misc_difference 24: note = a, c, t, g, unknown or other
  misc_difference 25: note = a, c, t, g, unknown or other
  misc_difference 26: note = a, c, t, g, unknown or other
nnnnnnncatcatcatcatnnnnnnn

SEQ ID NO: 1688 - DNA, 26 bp, synthetic construct
  source 1..26: mol_type = other DNA; note = Description of Artificial Sequence: Synthetic oligonucleotide
  misc_difference 1: note = a, c, t, g, unknown or other
  misc_difference 2: note = a, c, t, g, unknown or other
  misc_difference 3: note = a, c, t, g, unknown or other
  misc_difference 4: note = a, c, t, g, unknown or other
  misc_difference 5: note = a, c, t, g, unknown or other
  misc_difference 6: note = a, c, t, g, unknown or other
  misc_difference 7: note = a, c, t, g, unknown or other
  misc_difference 20: note = a, c, t, g, unknown or other
  misc_difference 21: note = a, c, t, g, unknown or other
  misc_difference 22: note = a, c, t, g, unknown or other
  misc_difference 23: note = a, c, t, g, unknown or other
  misc_difference 24: note = a, c, t, g, unknown or other
  misc_difference 25: note = a, c, t, g, unknown or other
  misc_difference 26: note = a, c, t, g, unknown or other
nnnnnnnatgatgatgatgnnnnnnn

SEQ ID NO: 1689 - DNA, 20 bp, synthetic construct
  source 1..20: mol_type = other DNA; note = Description of Artificial Sequence: Synthetic oligonucleotide
ggggccactagggacaggat

SEQ ID NO: 1690 - DNA, 12 bp, synthetic construct
  source 1..12: mol_type = other DNA; note = Description of Artificial Sequence: Synthetic oligonucleotide
ctgtccctagtg

SEQ ID NO: 1691 - DNA, 20 bp, synthetic construct
  source 1..20: mol_type = other DNA; note = Description of Artificial Sequence: Synthetic oligonucleotide
agagagatggctccaggaaa

SEQ ID NO: 1692 - DNA, 20 bp, synthetic construct
  source 1..20: mol_type = other DNA; note = Description of Artificial Sequence: Synthetic oligonucleotide
tcagggttctggatatctgt

SEQ ID NO: 1693 - DNA, 20 bp, synthetic construct
  source 1..20: mol_type = other DNA; note = Description of Artificial Sequence: Synthetic oligonucleotide
actccagtctttctagaaga

SEQ ID NO: 1694 - DNA, 106 bp, synthetic construct
  source 1..106: mol_type = other DNA; note = Description of Artificial Sequence: Synthetic polynucleotide
ggcccagactgagcacgtgagttttagagctagaaatagcaagttaaaataaggctagtccgttatcaacttgaaaaagtggcaccgagtcggtgctctgccatca

SEQ ID NO: 1695 - DNA, 20 bp, synthetic construct
  source 1..20: mol_type = other DNA; note = Description of Artificial Sequence: Synthetic oligonucleotide
tgggccccaaggattgaccc

SEQ ID NO: 1696 - DNA, 20 bp, synthetic construct
  source 1..20: mol_type = other DNA; note = Description of Artificial Sequence: Synthetic oligonucleotide
cccaaggattgacccaggcc

SEQ ID NO: 1697 - DNA, 20 bp, synthetic construct
  source 1..20: mol_type = other DNA; note = Description of Artificial Sequence: Synthetic oligonucleotide
ccaaggattgacccaggcca

SEQ ID NO: 1698 - DNA, 20 bp, synthetic construct
  source 1..20: mol_type = other DNA; note = Description of Artificial Sequence: Synthetic oligonucleotide
ggattgacccaggccagggc

SEQ ID NO: 1699 - DNA, 20 bp, synthetic construct
  source 1..20: mol_type = other DNA; note = Description of Artificial Sequence: Synthetic oligonucleotide
gcagaaatagactaattgca

SEQ ID NO: 1700 - DNA, 20 bp, synthetic construct
  source 1..20: mol_type = other DNA; note = Description of Artificial Sequence: Synthetic oligonucleotide
cagaaatagactaattgcat

SEQ ID NO: 1701 - DNA, 20 bp, synthetic construct
  source 1..20: mol_type = other DNA; note = Description of Artificial Sequence: Synthetic oligonucleotide
taattgcatgggcgtttccc

SEQ ID NO: 1702 - DNA, 20 bp, synthetic construct
  source 1..20: mol_type = other DNA; note = Description of Artificial Sequence: Synthetic oligonucleotide
aattgcatgggcgtttccct

SEQ ID NO: 1703 - DNA, 20 bp, synthetic construct
  source 1..20: mol_type = other DNA; note = Description of Artificial Sequence: Synthetic oligonucleotide
tccctgggatccctgtctcc

SEQ ID NO: 1704 - DNA, 20 bp, synthetic construct
  source 1..20: mol_type = other DNA; note = Description of Artificial Sequence: Synthetic oligonucleotide
tctctcatccatgcctttct

SEQ ID NO: 1705 - DNA, 20 bp, synthetic construct
  source 1..20: mol_type = other DNA; note = Description of Artificial Sequence: Synthetic oligonucleotide
cccttgcttaaaactctcca

SEQ ID NO: 1706 - DNA, 20 bp, synthetic construct
  source 1..20: mol_type = other DNA; note = Description of Artificial Sequence: Synthetic oligonucleotide
tctcatgccaagctccctgc

SEQ ID NO: 1707 - DNA, 20 bp, synthetic construct
  source 1..20: mol_type = other DNA; note = Description of Artificial Sequence: Synthetic oligonucleotide
agctccctgcaggacatccc

SEQ ID NO: 1708 - DNA, 20 bp, synthetic construct
  source 1..20: mol_type = other DNA; note = Description of Artificial Sequence: Synthetic oligonucleotide
gcaggacatcccaggccctc

SEQ ID NO: 1709 - DNA, 20 bp, synthetic construct
  source 1..20: mol_type = other DNA; note = Description of Artificial Sequence: Synthetic oligonucleotide
caggacatcccaggccctct

SEQ ID NO: 1710 - DNA, 20 bp, synthetic construct
  source 1..20: mol_type = other DNA; note = Description of Artificial Sequence: Synthetic oligonucleotide
ccctctgggacagcagctca

SEQ ID NO: 1711 - DNA, 20 bp, synthetic construct
  source 1..20: mol_type = other DNA; note = Description of Artificial Sequence: Synthetic oligonucleotide
cctctgggacagcagctcac

SEQ ID NO: 1712 - DNA, 20 bp, synthetic construct
  source 1..20: mol_type = other DNA; note = Description of Artificial Sequence: Synthetic oligonucleotide
gacgccctctggaggaagca

SEQ ID NO: 1713 - DNA, 20 bp, synthetic construct
  source 1..20: mol_type = other DNA; note = Description of Artificial Sequence: Synthetic oligonucleotide
cgacgccctctggaggaagc

SEQ ID NO: 1714 - DNA, 20 bp, synthetic construct
  source 1..20: mol_type = other DNA; note = Description of Artificial Sequence: Synthetic oligonucleotide
tgtcctgcgacgccctctgg

SEQ ID NO: 1715 - DNA, 20 bp, synthetic construct
  source 1..20: mol_type = other DNA; note = Description of Artificial Sequence: Synthetic oligonucleotide
agctgtcctgcgacgccctc

SEQ ID NO: 1716 - DNA, 20 bp, synthetic construct
  source 1..20: mol_type = other DNA; note = Description of Artificial Sequence: Synthetic oligonucleotide
gcacatactagcccctgtct

SEQ ID NO: 1717 - DNA, 20 bp, synthetic construct
  source 1..20: mol_type = other DNA; note = Description of Artificial Sequence: Synthetic oligonucleotide
gtcaaccagtatcccggtgc

SEQ ID NO: 1718 - DNA, 20 bp, synthetic construct
  source 1..20: mol_type = other DNA; note = Description of Artificial Sequence: Synthetic oligonucleotide
aaacttgtcaaccagtatcc

SEQ ID NO: 1719 - DNA, 20 bp, synthetic construct
  source 1..20: mol_type = other DNA; note = Description of Artificial Sequence: Synthetic oligonucleotide
ccagggacctccctaggtgc

SEQ ID NO: 1720 - DNA, 20 bp, synthetic construct
  source 1..20: mol_type = other DNA; note = Description of Artificial Sequence: Synthetic oligonucleotide
ccccttccagggacctccct

SEQ ID NO: 1721 - DNA, 20 bp, synthetic construct
  source 1..20: mol_type = other DNA; note = Description of Artificial Sequence: Synthetic oligonucleotide
ggtgaggctggccccttcca

SEQ ID NO: 1722 - DNA, 20 bp, synthetic construct
  source 1..20: mol_type = other DNA; note = Description of Artificial Sequence: Synthetic oligonucleotide
tggtgaggctggccccttcc

SEQ ID NO: 1723 - DNA, 20 bp, synthetic construct
  source 1..20: mol_type = other DNA; note = Description of Artificial Sequence: Synthetic oligonucleotide
ccctcctctcctggtgaggc

SEQ ID NO: 1724 - DNA, 20 bp, synthetic construct
  source 1..20: mol_type = other DNA; note = Description of Artificial Sequence: Synthetic oligonucleotide
aggtccctcctctcctggtg

SEQ ID NO: 1725 - DNA, 20 bp, synthetic construct
  source 1..20: mol_type = other DNA; note = Description of Artificial Sequence: Synthetic oligonucleotide
gggccaggtccctcctctcc

SEQ ID NO: 1726 - DNA, 20 bp, synthetic construct
  source 1..20: mol_type = other DNA; note = Description of Artificial Sequence: Synthetic oligonucleotide
gagctcgaccctgaagggcc

SEQ ID NO: 1727 - DNA, 20 bp, synthetic construct
  source 1..20: mol_type = other DNA; note = Description of Artificial Sequence: Synthetic oligonucleotide
ctgttgagctcgaccctgaa

SEQ ID NO: 1728 - DNA, 20 bp, synthetic construct
  source 1..20: mol_type = other DNA; note = Description of Artificial Sequence: Synthetic oligonucleotide
tctgttgagctcgaccctga

SEQ ID NO: 1729 - DNA, 20 bp, synthetic construct
  source 1..20: mol_type = other DNA; note = Description of Artificial Sequence: Synthetic oligonucleotide
gctgaaagccactgggctct

SEQ ID NO: 1730 - DNA, 20 bp, synthetic construct
  source 1..20: mol_type = other DNA; note = Description of Artificial Sequence: Synthetic oligonucleotide
tgctgaaagccactgggctc

SEQ ID NO: 1731 - DNA, 20 bp, synthetic construct
  source 1..20: mol_type = other DNA; note = Description of Artificial Sequence: Synthetic oligonucleotide
tgcaggtgctgaaagccact

SEQ ID NO: 1732 - DNA, 20 bp, synthetic construct
  source 1..20: mol_type = other DNA; note = Description of Artificial Sequence: Synthetic oligonucleotide
atgcaggtgctgaaagccac

SEQ ID NO: 1733 - DNA, 20 bp, synthetic construct
  source 1..20: mol_type = other DNA; note = Description of Artificial Sequence: Synthetic oligonucleotide
ttgatctctgattttcatgc

SEQ ID NO: 1734 - RNA, 114 nt, Taeniopygia guttata
  source 1..114: mol_type = unassigned RNA
ggcgggagtaactatgactctcttaagggtctagttacaactgggcatcgctgcagagatcgcacctcctcgtggtcccgctggtagcccttcgaagggtgactaagtcgatct

SEQ ID NO: 1735 - protein, 30 aa, Homo sapiens; identical to SEQ ID NO: 1592

SEQ ID NO: 1736 - protein, 6 aa, synthetic construct
  source 1..6: note = Description of Artificial Sequence: Synthetic peptide
GSSGSS

SEQ ID NO: 1737 - DNA, 152 bp, Strongylocentrotus purpuratus
  source 1..152: mol_type = unassigned DNA
aaggtggttcagttcctccgtttagaaacaggggcttaaaatttgcccatttgaatattcatagcttagttgctaagattgacgaacttagattacttctgagaaatgcatcatttgatgttattggtttaaatgaaacattttgcgactcc

SEQ ID NO: 1738 - DNA, 94 bp, Drosophila simulans
  source 1..94: mol_type = unassigned DNA
tcgagctttattgcaagaccaaccaagcagatattcttctcatatccgaaacccatttttcagacaggtcctacttcaccttaagggggtatga

SEQ ID NO: 1739 - DNA, 325 bp, Esox lucius
  source 1..325: mol_type = unassigned DNA
ctccttgaactgccaccttaacgtggtggaggggtttgagtacccgagtgaccctaggagctatgttgtctggggctatatgcccctggtagggtctcccaaggcaaacaggtcctaggcgatgggtcagactaagagcggttcaaaaccccttaatgagaaattgtgccgtgacgtcgcccggcatggcgcagccggggccccaccctggagccaggcccgaggagcgacatggggccgccctcccgtgggctcaccacccacaggagggaccataaggggccggtgcgagaggatcgggcggcagtcgaaggcgggggcctga

SEQ ID NO: 1740 - DNA, 980 bp, Aedes aegypti
  source 1..980: mol_type = unassigned DNA
catacgttgagtgactaccgttgagagcggacgtgtctgtgcttgcgtgctgttacagtggttcgagtgaaaagatcgtttttgcgattgtcgtaggaggaattgtgctggggtttttgggtttccggaagtgccgtgttggagcagttgggaggttaccgtgctgggtttccgacggattggactggatccgtgatttggccagcaactcggctgggtgaaataggcttttcggagagtagtgagaaaacgaaaaagcagctggtagtggagtgcggaggaggtagaagcctagtggaggagtgcggagggggtgaaagtgcggtgagggctgtagtcggtaaattccgcatttcagattgctgattgttagtgtcctgaagagaagactaaattcctttaattggggcagctggcgtggttaagggattgttccggggaagcggaaagggagtgtgaagtgtttggccagaggaagttggcggaaaaaaaaattggaacgccgaagaaagaaaaaagttttgaggcgagagtggcgggggggtgttgcggtcgaaagcttcaacggaagaaaacacgagtggtgtgagtgagaagaccttgatcggttttggcggtaaagctcgttgcaggagttcggaaaaaaaaaaaaagaaaattggaagcgagagtgagtgccacgtagaagcgaagtggagaaaagtggcatcgcacactgtgagaggaggaagtggagcatcgaaataggcaagcggctgagtagcgacagagagagagtaagtgagaaagcgcatctgtagcggggaggcagaaataagaagcagggctgctggtcgatccgtggcgaatgcggtggagagcacgaaggaagattccaacgcagcgagactgagtgcaccggtttcattggtggcagtattggtgagtcattcactttctcgttccaataatttttccaagtatctcgaagtttggtcctc

SEQ ID NO: 1741 - DNA, 139 bp, Solenopsis invicta
  source 1..139: mol_type = unassigned DNA
aaagatcaatgaccagctaattaaagactggttacgaaccacgggaagattcgttagggagcatcctaatattttgtttaccagagcggacaagggtaatgtaacagttgcccttgacaagaatgattatatctcgaag

SEQ ID NO: 1742 - DNA, 59 bp, unidentified
  source 1..59: mol_type = unassigned DNA; note = Description of Unknown:Virilis group sequence
ggtcgccagagccatcaataaatatcaacggaaggcacgccgtatgcacagcaaccaac

SEQ ID NO: 1743 - DNA, 144 bp, Strongylocentrotus purpuratus
  source 1..144: mol_type = unassigned DNA
ggtaaaaagtcgcctcatataactaataagtccatatcagacctattgattgtacaatggaacgcacaaggcttgacggcgcatggcgcaaactttttatcttcccttattgataacaatttgttaggtattcacccagatata

SEQ ID NO: 1744 - DNA, 1041 bp, Xenopus tropicalis
  source 1..1041: mol_type = unassigned DNA
tatccctctgctgtatactgccatataacccactatattgcagcctctttattaatggtaattctcatctgtgtatccctctgctgtatactgccatataacccactatattgcagcctctttattaatggtaattctgtcatctgtgtatccctctgctgtatactgccatataacccactatattgcagcctctttattaatggtaattctcatctgtgtatccctctgctgtatactgccatataacccactatattgcagcctctttattaatggtaattctctcatcttgtgtatctgctatgccaataactcattctattaggcctaccttgatttagtacttgccatagctgtgtcaaactcacatctgtgtccactcctcagtgccaatatttcacaagtgctaggaaaattgcagttaaacaaggcagttcatggaactaactcatatctcttctcacttctaatggtaattctcatctgtgtatccctctgctgtatactgccatataacccactatattgcagcctctttattaatggtaattgtaactcatcttgtatctgctatgccaataactttttctgttaggcctaccttgatttagtacttgtgatagctgtgtcaaactcacatctgtgtccactcctcagtgagcaagagatatttttacagccccaaaacttggttctggtgcttgtaaaagtctccccctccccacacagcctgcttactttgatccctgattgaactgattaattagtcaattagtttctggctttccccaatcagctgcatataaattcagatgcagccttggggatggcactagtgtcaggggcaggcactggtgctaccatttcctaagtgccaacatttcacaagtgctaggaagaagggaatggcagttaaacaaggcagttggacaaggcattgacaaggctacaaactatctcctatcaacactgaacaacgtggaatcgcaagaaaacaactttgcttattcatggtagtttgttatttcctatcccaaa

SEQ ID NO: 1745 - DNA, 117 bp, Vitis vinifera
  source 1..117: mol_type = unassigned DNA
ggagtgttcagtgaattattgtgggactagaaagagtgcggggttgcttcagattgctaactgaagtttgggtttgttggtccagtgaggggagaggggcttattaagatggatgtt

SEQ ID NO: 1746 - DNA, 363 bp, Schmidtea mediterranea
  source 1..363: mol_type = unassigned DNA
gtcatagggtgaactgcaattctgacacgatgaccgagctgtgtcagtttgcagctagtcgctaaagactcgatcagtccgccaagtgaggtggccgggtatctgcagcactagagccactggtatcaagagcagagatacgcgagtggaagttgagtacgactaccttcacggggtcctcctgataaccacagtggactgtgggaactaaatgtgtgctcagcgttccctactttctcgtagggtaaagggtaagataacccagagaatatcccatgggagatatccatggaaaaagcaccacgttagacaatccgatggtctaactcggctccgaggggctaactatcccaaagggcttaa

SEQ ID NO: 1747 - DNA, 102 bp, unidentified
  source 1..102: mol_type = unassigned DNA; note = Description of Unknown:Nasonia vitripennis sequence
ccattccttcgtacgggttttcgtgccggcatagccgggtgggagactcgcgcgggggaggtcatatctcaccaccatcttcgagctttttgctgcacctga

SEQ ID NO: 1748 - DNA, 209 bp, Schmidtea mediterranea
  source 1..209: mol_type = unassigned DNA
aaacgacatcatgaacgcttggccgcaacaatccagttatccctgcggtaacattgtggaactcataagacaagtactaaaagaagaattagaaaaattagaagaaaaaattgaaaataatttatttataaaatttaaaaatttaaatttaaatttaaatgaagataaaaatttatttaatccaataaataatcaagaaaatcaagaaa

SEQ ID NO: 1749 - DNA, 175 bp, Taeniopygia guttata
  source 1..175: mol_type = unassigned DNA
gtctagttacaactgggcatcgctgcagagatcgcacctcctcgtggtcccgctggtagcccttcgaagggtgactaagtcgatctctgccccaggtacggagccgttgggactcaccagtccaacgtaactcctgcctaaactcggtgaaacaaattcctcggtaaaaagcccc

SEQ ID NO: 1750 - DNA, 579 bp, Aedes aegypti
  source 1..579: mol_type = unassigned DNA
acggattaatggtgtgaatgtgaacgggaggtttcgaaagacaaatgcatgaacggagctagcgagtgataaatcgggagcggggagacgaagtgagaggttggtgcgagagagacgaagtgaaaggtgggtgatagtaaagtaggtgagatgtgtgagaggtaaatatatagacactggagtgaagtgaccattggattattagtagtagtgtaggtcaatcaagaagtggtgaaggtggtagtgacgatgacggttaggatgccatagataatatataaagcgacttggtggtgttgaagaaatgagaagggtgtagagaagagcggaaaagaaaggtgaattgaaacacaggggtgttcaactgaattgggctacgtgacaggattggagcgataagagaaaaataagtgaaaggtattaattatttaaaactaaggtaagacgactgatgactggaatgcattctaatacactgatgaattaaggtaagactagatataagcaaatatatattatgagttttctttttctttatcaattatagcataacatttataactacacaaagagtacaaa

SEQ ID NO: 1751 - DNA, 15 bp, Folsomia candida
  source 1..15: mol_type = unassigned DNA
tgcatcattgccaaa

SEQ ID NO: 1752 - DNA, 304 bp, Nematostella vectensis
  source 1..304: mol_type = unassigned DNA
aaacgggagatctaatctcatccttggcctcagtgagacgtttttggacgaatcatggacggataccgagttggctatagatggttactcgctggttagagctgatcgcacatacaactctggtgacgggctgctagttttcatacccagccatatttccttcaaaaggcgcgtggatcttgagtttgaaggtattgaagccatttggcttgagctattattccaccgatcgagcccgtgctttgcttgttttatttaccgtcgtccttcttctacctctgcatacatagctcttttggacgaa

SEQ ID NO: 1753 - DNA, 111 bp, Aedes aegypti
  source 1..111: mol_type = unassigned DNA
ggtattccaacgggaatgtcttcttacgtaaggatgaaagttctaaggcaatccatgtgagtgatgttagtgttctatcatcgattgtgtaatatttcctgattaagttaa

SEQ ID NO: 1754 - DNA, 288 bp, Caenorhabditis sp.
  source 1..288: mol_type = unassigned DNA
tttcgaagacagacgagatgcgatcaagaccctcactacattcaactcaatcaaaagccgcgtgaccggttgtcacaacgccaccattcgtcaggacatgtccaaaccggagctgtcaaaatttcgggactcgtggaagcaggccatcaagaacaacaacgaagctggacaagggatctggactgtgagaaacctcgagctggtcagaattccctacaaggacaatgaaactcctcacccttggacagtgcgaaacagaaccaagtaaagtttttctcccttgcccat

SEQ ID NO: 1755 - DNA, 516 bp, Caenorhabditis elegans
  source 1..516: mol_type = unassigned DNA
agctggttaattgcatgtaggctaatgctcgttccattgcatcgcttgaaaaacttgaatttgtccataagttcgtagcctctaatagtttagacatcttgtttgttaccgaaacatttctaagtaatgcttttactgatttctcatgctcttcacctcactatacctgcataagatctgatcggcttgagtgccatccaaaaaatgcggcggaggtactgctgtgttttttcataaaaaatgggctcttacgcctgtctcaattgcaccttccttttatctctcgcatttttgtcaaattctggcattagaccataagcaatccaaaactagatttatactgatataccgcccccatccactaccgcaagtagaaccgctgagctctttaaaaatctaaaccagcttctcgactgcccctcctatacttatgtcctcctcggtgatttcaattttgcaaacaccaagtggaattcaaattttcttcccacgggctctgagtatttctataattgg

SEQ ID NO: 1756 - DNA, 318 bp, Caenorhabditis sp.
  source 1..318: mol_type = unassigned DNA
cttcttctgtactgagcctcttcgcggcgaagaagatcaacagatgtcacacttctacaaacccggcgagttcgtcacgccgggagtgaaacatctggccaagaagtacaacgtctcacgcaggtcagaggtagcgtcgaatactctctgtgaccgggcggctttagcattggtttagcagaccatagtaaagtaatcagagacacccaaaccgctcaaaacagcaccaaaacctgcctcagtcctccgcactcggcctctgcaactgttacggtagattcagtagcacgtcgagagaggcgatctaatcccggagtt

SEQ ID NO: 1757 - DNA, 838 bp, Caenorhabditis sp.
  source 1..838: mol_type = unassigned DNA
ccaactctcatcgtattaacctacggtattcctcctagtgagtgtaataaaggttaattacgttttctcttaccaaagaaaaagaaatttcgaatcctttttgtgtaactcacaaactgacagagacctatcgaatttcttttgtttcgtatataggaatagtcactctggaccacgaagtggacagttgttggcggacttccaaagttgagagaaaaggtgtgaagagaggaggtctagaaacacttcggctgtctaggaccagttcctgagtggaaagaggaaggtctagaaacacttcggctgtctaggaccagttcgtgagatctcttgtgaagagttgaaaacagttagctgaggctactgtatttcttgatagccccgcccccaatccccctcccccccccctcgacagaattttctgtttgacctcctggaatttgcgaggagtgcgcgagaattttcgaattcttcgcgcgttttctcgaaattttccagaagattcgagcggagaatcttcgagaaagtgagccgaatttcgcgcgaatttttcgcgattttcaaattatcaatttttgtcggaaaatttattttctggcaaaatttgatttagttcacgcgggagagaaggatttggtggaaaagggtattgatttttgtggcggaggaaactcccactgaatcaataactctcaaaggagaactcatcgaacaacctcgggtgacctgaatcttgggcgaaattttcgcattgacacaagataacacaaattactgttgaaaacaaatcagaacaaactgtcaaaaagaaagacaaaaagtattgattaacaacatc

SEQ ID NO: 1758 - DNA, 90 bp, unidentified
  source 1..90: mol_type = unassigned DNA; note = Description of Unknown:Copidosoma floridanum sequence
actcctgtagccaacaacaacaatgattcaaagtggctgtttaatctttctaatgttactataccagaagaagtctataatattttgaaa

SEQ ID NO: 1759 - DNA, 932 bp, Culex quinquefasciatus
  source 1..932: mol_type = unassigned DNA
tgtgtgtgcgccgtgcacatcggtattgtttttcgtaccgttcccgcgaaagtgcaaaatttacacgaaaatacgcgttagtggggtgtgaaattcattgcatccgtgttctgaacccgtctcctggcccgggaaagtgatagtccgtgttttacgaccgcgagtgagacaaatcaatcaccagatttgaccgaatatcgcgttccgccacgggcaattgaaaaaaagtacaaagaactgctaaggcatcgtcgtcgtcgtcgcgatcgatggtcgttgtattgtgtcgcgcggcgtgtggaagtgtaccgcgaagaccatactgacgcgtgtcgtcgtcgtcctcgtcactgtgtctgttgctacgagagtcgtgtatagaagagaagccgttggtgcacggtggggtgaattgctaggaaagctacagaaaaaaaaagtgctgcaaagttttttgggtgaaattaaaaagaaggaaaaatcaagaagcgcaaccctgctgcatacacagcccccccccccccccctctagttccgtttctgggcgtctgcaccccatgttaggggcggcccaaacggactaggtggtcgattccttctatccgtgagcggctgttccccacgttaggggcggctcgaaagaagtggccgacacccccccccccccccccccacccttctttgagcgtctgttccccaggttaggggcggctcaaagaaaccggtgtcctgctctatcgtcgaggtaagcgtctgttctccaggttaggggcggcttacagcagatagagttcggaccccccaccccctccccccatcgagcgtctgttccccaggttaggggcggctcgaaacagcgtctgtaccccaggttaggggcggctgagtaaaagtccttgtgtcggcgtgggactgtaaacagtaccggcacg

SEQ ID NO: 1760 - DNA, 545 bp, Danio rerio
  source 1..545: mol_type = unassigned DNA
tgcgcaggcgcgagcttgctgcagcatgttttgactgctctgtcttgtcttagtgttttagagtttaatttgttgtctttatttttatttttttgttttagtttattagtgttagtaagcgtgccctccttaaacatgagggtagagagagccatctctgtgtttttttggttactgctctttgtttgagcttgccgcacgctgctaatgctaacacagctagcggttggtccggtttttgtttataccccggaccagctgatctcgttgaggcaggatgcttcgagcacagtgcggtctctcgggtatccccgcgggttacggagggggaagactaagagaggctgccgtggaggacaaggtgcgagggaaaagaacgaggaatgggaaattgtctgatgagcagctgagaagacggtataaacctaacctgccgtctgttgttatgggcaacgtgaggtcactggaaaataagatggacgagcttacggcacgggtcagatgcacagagaatttcgtgagtgtagtttgatgtgttttactga

SEQ ID NO: 1761 - DNA, 14 bp, Danio rerio
  source 1..14: mol_type = unassigned DNA
gacgtgtgcaaaag

SEQ ID NO: 1762 - DNA, 890 bp, Danio rerio
  source 1..890: mol_type = unassigned DNA
ggttccaaggttgtcatagccgggggcggtaatggggataagctcccactatctataaagtacccctatacggcgtgcgtctcaaatagcctctgacaaccaagtccagctcctggccttcaagtgtggtttagctaccaaacccggcggaactgttttcactgacaggagaaggggcgcaggcgggtcactggcgccttacaaccagttgcttcggggagatgatattcgttagcctgggaaggcagatcatctaggggaaggcaaccctgttttcaaacctccgctgccttgcggctatatccattcatggaaaaggcttcaggagtaaacctcgaggaaaaatccggagtcggagtccctaaggcagtttaacgctgtttgcagcctcactctggcaactcctgcgacggcgccgataccaaactgtagcagccctgctgttcctttggatttgtcgacaacgtggagaggggggacccgctacatgggcaacagcctgtcctccataatacattgccctggctagtatccgatctcgcacaccctggagaggacactccagcctcgctagcactctggcgtggatacaacacggggagcagtagtttaccggttataagccacagctcggttggcgtagagcaaggcgccagggactgctcccgacggtgggagggatcttcgggtcccactggacagtcaccgcccgcctcaagctgggcagcccccagtcaattaggtactgccccgccacagtctgctttcctcattgggtgcatggggaataggagcatttcgaacagcagactgcaaccatcgcaccagacaataaaataacacagagaaagagaccagctctaaaactgggatgctggaatgtccgtaca

SEQ ID NO: 1763 - DNA, 424 bp, Drosophila ananassae
  source 1..424: mol_type = unassigned DNA
ggggagaatgggggaggttatataaggtaaagtgtctgattgcactcaacttggtgaatgccagcatgatccttatcactgctctccccaagccgacgcactacctccacgtggttctccctggattgtcactcaacacccgttgtttgacaaactaaagcgcgcgacgagagtcctagctcttcaaactaggttgtggcgtaggacttgaaatccacccacggaaaacaaatcttcagtgaatgtagcagatgaagcctcggaacggaaccaatctaaagttgacgaccatggcacacgtaaaaaggacaatgatttgagagtatgcacttggaatgtacgcacattgtacagaccaggtgctgctcaacagctagcagataccctcaataaatgtagggctgacatcactgctatccaggaa

SEQ ID NO: 1764 - DNA, 120 bp, Drosophila persimilis
  source 1..120: mol_type = unassigned DNA
aagatatgggtctgaataatagcgtagaaggggagtcattccgtaattcgtaaatcgtaaaaatcagatcaagttgattcaagacctcctcgtggtatcttctggatgctattagactga

SEQ ID NO: 1765 - DNA, 1196 bp, Drosophila willistoni
  source 1..1196: mol_type = unassigned DNA
aatattggcttattttacttaaatatttggtctctttatgtttttccccactaaaagctaattgctctaaaacttctagcctataaagctaactcaactaaaagctgactgctctaaaacttttagcctttaaagccaagccttgctcgcaattgatgcgccaacagccaagctaaaaaactagtgttactcagacccaaaatatgggtctccctacttttttctccagtgtggaggaaaaccagttttttccccgacattaatcgccacgtttttgtagccgccttagcaccaaattcttattcgccaagtttattattaaaaaattgctacctacttgactacttatgctaaaagtaacataatcttaaatctatcatactacaaactatcttacctaaatcgctaaaaactaaatgttaatctaatgtcttattgtatattttttatttagtattaatctagttttaagataattttaatccccccgccactgctgctgtaacggccttttaaatttaaatttttgctatatacccttgtaggtgaaagggcaaaaaataaaaagcggcctcaatcgaaagactgaggccaggcggatcaaacgccttaccttaaaaagtggggtaattcaaggtcatgtaaacgcggcagaactctccttgaagtgatcggctgacaagaaactggacatcctggcgacgggtggtcctactcatttcccacacgaccggcgaaaaaatccctcagccattgactttggagtttattctggaataatcgaggacagattaacttcacaaactatatgcgaactatcctctgaccacttacctgtttatgtacacatcacgatggaccagcacccaaacttacttcctgacaatcgaagacttttgcctgtaggatctaacattaaactgttccaaaacaccctcagcgactccctccacctaaatatggaaatcgaatctggattagacattgaggacgcgattaatatcttcacaaacaatagtcaccatgctgcagccctggccactaaacctctacgaagggacctgccaaatacgaatcgtaccgaatcggaggagccatacctataaataaaaaattgcacaaattattaaaacaaaaaaattaaataaaattgatataatgcctctcacgaaactttgaacgtaaaaaaacattaa

SEQ ID NO: 1766 - DNA, 137 bp, Folsomia candida
  source 1..137: mol_type = unassigned DNA
ggtaacttacaccggagatactacttatctatcgttggaagtccctctactttcactcttgaattccgcccccgtctatatattttaagcgtggaaggaaattgccagtattgttggatacaagtcgtcagaccacg

SEQ ID NO: 1767 - DNA, 290 bp, Glycine max
  source 1..290: mol_type = unassigned DNA
gttttgggaagtaatcccaaggcccagcagagtgacaaatcaaaggagatgatgagaagtaataccaaggcccagcagactgaggaacctttcgtggactccaacccagcttctaaaggtcaccctctgtcttctttatacgaggaccctatacagctgcaatgtgacatcttgaaggaaatgggcttgtcttatgaggaagaagatagcaaggttaaggggctgctgctggatatggagaataaagatgatttgatggcagcagagaagggaattaaatctcagcaatt

SEQ ID NO: 1768 - DNA, 46 bp, Lottia gigantea
  source 1..46: mol_type = unassigned DNA
gcctcgaacggaacaggattagactcgtatctttagtactgtcgca

SEQ ID NO: 1769 - DNA, 23 bp, Nematostella vectensis
  source 1..23: mol_type = unassigned DNA
acataaactctgaaactacatct

SEQ ID NO: 1770 - DNA, 96 bp, Pelodiscus sinensis
  source 1..96: mol_type = unassigned DNA
cactacacctttttttgtcaaggaaaacatagtgatgagaaacgcctgcatggagttggttttgccattcgcaactcgctgctcaagtcaatagac

SEQ ID NO: 1771 - DNA, 291 bp, Phytophthora sp.
  source 1..291: mol_type = unassigned DNA
agacgagcaacgcgctggggcccaagacctggcatgaacgacactgcccaggctgtgaacgacgagcacgctgctaacccggcagcgcaccggcctctgggctccgctgcaccggtcaccggtgcaacacggtggggtccacgtcacggcgcgatcggggcagcggctgtagctcgcctgctcacaggcctacccacggcaccagcaccagcgacgcgccggcctgcttcggctcggcgctgcccagacccgcccgcttcccccgcggccacgacgacagcccccgatgcg

SEQ ID NO: 1772 - DNA, 150 bp, Strongylocentrotus purpuratus
  source 1..150: mol_type = unassigned DNA
ttatagtaagttgtatactaaagaagatattgatgttaaaatgcagaagattatattttttctcaaaatatttcatctctctctgacgatgaaaataaaatatgtgaaggtttattaacacacagagaatgtaaacaagctgtattcgca

SEQ ID NO: 1773 - DNA, 112 bp, Strongylocentrotus purpuratus
  source 1..112: mol_type = unassigned DNA
gggacaacggcgtctctcagaactggtgttcacatggatatattcatggtcaccacactgcggtgaggaaggcaacgggaaaccaccttcactattcttcccaagatatacc

SEQ ID NO: 1774 - DNA, 294 bp, Strongylocentrotus purpuratus
  source 1..294: mol_type = unassigned DNA
accagaaggtgttagctgcatggactcgtgatggtatgattattgcctcaattcaagcctctggtggaaaatcgacctctaaagttatacgttcagatatcgacctcgaaaacctttgatagttatgtcacgttagcgatattatgaacgatcgagctgacattttaatgacttatatttctccctggagtgagaagttttttacattttatctttttggatttttctaatactcgaacttttaaatgtaaaataccttttgtatttctaatttgttttttgtatactgcttgt

SEQ ID NO: 1775 - DNA, 131 bp, Strongylocentrotus purpuratus
  source 1..131: mol_type = unassigned DNA
ccaaaccgttttcagtcataggagtcacagaaacgtggcttaatgatacatctccatctactttatgtaatattgacaattattcgattgtacgttctgatagaaaaaccggaaggggtggtggagctgct

SEQ ID NO: 1776 - DNA, 578 bp, Strongylocentrotus purpuratus
  source 1..578: mol_type = unassigned DNA
gtgaggtgatggctacagggagcagacatggtctggttttggtgatataaaatccacttaatcttgcacttttaactgcagatcgtgtattttatttacctgattttgcttcttgaacatatcttcaagcttttgatatgattattttgttctttgataccttctggaggtagaatattgtgatagttttacagccattttctgccaaggaatttgaacacacacctgtagtcccatatggaggatcctgagtttgcttattttgcccagccttcttcatacctacactacaggcaacaataactgtaatgtatattttctgactgaattatgcttatattattcttatgatatagaagcaattactcactgggatttaaatcatttaccagatgatttagctaaccgtctactactactaatagctaacctacataaaatgggtgtagctgagtgagtgagactgctgagcttttctgacttccctttgtttgttctgaatacgtattgaatattgaatactgtcctgccaaatttaatcaccggtattcatcaccgttcgacttgcaaacgccatc

SEQ ID NO: 1777 - DNA, 551 bp, Strongylocentrotus purpuratus
  source 1..551: mol_type = unassigned DNA
tgtgtgtgtgtcgcgggagtcggatgtacactgcaaatgcttcctggaaactgcctacatcgacaccctgggatgtctttatctggaatttcttcatgaatttaggaatttcacccttccttctcatggcagattgaattttatgttcttttggaccaattctgtcaactgaaatctaagctagattttgccactcatttcattaagagtgccatcaaaatctgtagtcccacagcaagactctgatgtctacagctttcacatgggctacagtcatacatgtacagacatgtacagggaaccacctagcttctagttctacactgtacaactggcaaccatggtcaatactgtaatgtattattattattacattcctttctccactatgagttgattgaattaacatgcccaagaaacctaaatttccatgtggttcatgtgggaaaaatgtggcttggaagtcaagggcattcagtgtgaaggtgaatgtgaacagtggttccatgcagagtgtattaactttaactctacagactacagtgccctag

SEQ ID NO: 1778 - DNA, 82 bp, Strongylocentrotus purpuratus
  source 1..82: mol_type = unassigned DNA
atatatcttcactctcgatatatcggaactctcgatttttcctaccctacaactaccggcgacgaatcacctaacaaccgca

SEQ ID NO: 1779 - DNA, 93 bp, Strongylocentrotus purpuratus
  source 1..93: mol_type = unassigned DNA
ggtctgttgtattacgatatttctgaccatttaccgatatttattatttctaaagttcaccttgttaaaaaaattactaaaaataattgtgca

SEQ ID NO: 1780 - DNA, 482 bp, Strongylocentrotus purpuratus
  source 1..482: mol_type = unassigned DNA
acaaatggatacaagatgcaaaaaagtggaaacctcacgtcaggctaccaaatccaaggcagtctacacaacaatcaaacaaatcactaagaaatctagcatcagaatgcaggcagtgaaaagcaaagatggagaaatccttaccgagatgaaagatgttaaagagagatggaaagaaagctttgaggaactgtacaatcaccagaaccaaacaaatggagaagcactactcagatggccagcctcgaaccggttccagacattctgcgagatgaagtagaatttgctgtacgaaaactcgcagaagagaaaggatttgacagcatcacaggagaggaactcaaagctactgggccaacaggaatcaccatacttcacaaaatatggcgggaagaaagttttccggctgactggggaaaagccataataacaccaatctacaagaaaaaacaaatcaactgtggaaactacaggggtattag

SEQ ID NO: 1781 - DNA, 861 bp, Zea mays
  source 1..861: mol_type = unassigned DNA
gatggccctcgtctctcccgcccccgccctctcggctcccgacgcccctccccctccccagcaccagcacgcgccggttcccattccggggccggcggccaactcccttgctgccgtcgccgcagcaccctctagccctggcgcgtcggcttctatcccctccttgtctcctcccgtgtcccatgtagccagggggcgctccaagtctctaaggtggggtgacctcagtccggcctcttcggatggcgtgacgtcgctcgactcccggccttccttcaaggacgtgctggtgagaccagcgaatcctttgccgcccagccgtgtggtagtccaagagtcagccctggcagctggaacgtcctcggcgctggggaaggtgaaccatcggccgccttgctctcaccccctgtctacaaagcggcggagtcccaggcaggctccccactctacaccggctttccgcccagctccaagttttgatgatcaaggatggacaacggtggaatccaaacaaggtagaagacgccggttgagggcttcacgacgcccgagtcgagtccctgctgagcttgttggaaggtgcttcaactgcttgggctgcgatcacagggctgcggggtgtgacagtgagcctcggtgcttcctctgctcggagcttggccacaagtcttcctcctcctgccccaagaccccggtgtggaagcggctcgggcgccccaggcctgtgaagtcccggtctgggagcggctttcaccggcagttgaggggagagtccaacgagcggcaggccaccgttcggtttggcagcgtatcgctacgcccgaagctgttccgatcgccccttctgtcctggtgggaagc

SEQ ID NO: 1782 - DNA, 1716 bp, Zea mays
  source 1..1716: mol_type = unassigned DNA
cctgcatgcttgagttctccactgctatggctcgggaggaggcggctcttcgccgggctttgttcgtctctattgttggcagcagaccggagatcagggagctgaagtgcgggatgaagtggctcgggcttttggaattgacgttaattcaatatcgattcatcagtccttgccagaagatttcctattgttgttaccggatgaaagtgctgatagagtcttcagcggaggaaaattgtttaggggccctcttttcaatcttcaattcagacggtggtcgcggttggctcatgctgaggcggctaggttgccagcactggtggaagtcgaggttcatggcatcccagcccacgcatgggatcgttctacggtggagtatctgctccgtgactcttgcattatcacagacattcatccgagcacgtcattgaagaatgatctgtcttccttcaggcttcgtgcatggtgtttgacacagatttgttccctcggccgatgaagctcctcattgttgagccggggacggatgtgcaggagaaaagatgtctttcctatgatattgaggtggctgttactgctgtgatggttccgacgaatttgactccagctcattcccctggcatggacgggaggcatgaggatggcggcgggaggcattcggaatccacgtcgggcatcgcgcccaattttccagcgtctgggcccaacgttcgtggtgcccagcgctgcggcagcgggcccggctgcaggacgaggcgcgcggtcctttggacgaggaggtggctgcagcccccctgttgctgcgggcctgtgcggcggctggcggttatggcgggagtcgaggaggtggccgcacaggaaccgagggcctcgccgtccagcgcactgctggggtgctggcggaggaggttgggccactggaatgggccagggaggtgttggcccagatgtcacggcagcagatgggtcccgggacagtttcgccccgctcactcctgtgcaacaagatgatgggcagggctgtgttggctgggtcgctgaaatcgcttgggtcgggctctccccgacagaggtttgtcgggttgcagaggctgaccaaatttcgcccccttcaatgtcggcttggtcccccggctgacctcaactcaaaatctttggttgactggcggacagaacctccctgaatgtttatgctaggaggccagctgattacagattgaaaaagcagacttcagataccgcaccggttcaatcccttcggccagatgaggtgtcggcacctctggtacctgctggtattggagaggcgacccccgttattggtggctaatatccaagaacattgactgcttgcttccgcaacctccaattcaaaaaagaagaactaaacagcttccgccagattttgtcccacgtcgcagtagtcgcttgtcaaagaaaagggaaggcttaaattcaacagtcagacaagtccaggcggagctcatttgaagttgaacgtcacaaaccaaggtggctgtgactgatgaaatgctggaggaatttggcagctgtttgacaaacccctttccaactctcacatcaaggccctggcagctttgtttggatggtcggtcccagataatgtgcaagaatgcttggtgttcctttgctagggagaagcattgagtgtgcttgctgctgtagcctcacttagtggttgtatttctgttatca

SEQ ID NO: 1783 - DNA, 294 bp, Zea mays
  source 1..294: mol_type = unassigned DNA
acaaaacatggtactgcgctacgacggagccgacgggttgcaggggcaggggtggaatttaacatgcaggatctggagaacagagccacaaaacaagtaatgcggactctgagagtcatcacagagaatgcaagcatcaaccagcaagctgttaaggattatgagaatctttttcagcatcctttaactcaaagtcatgttgaagcgttagcggctctctttggatgggagactccggggaatctcttcccgtagtgtgtttttctttctgggttgtaatttataattgttgta

SEQ ID NO: 1784 - DNA, 699 bp, Zea mays
  source 1..699: mol_type = unassigned DNA
ggaccctgttgatgagccagggaccgtggagcagctggcgcccagtactgaggattctatagctgtcacctctattccttccgcgaatttacctctgcttacttgggaagaggatagacttggtgctgctgtggttccagacattgtgtctaaccagggtattcctcaccctgttgagaggcataggtctgttgagccgcaggatgctgccattaatcgcagaggtggcctcccttccaaccttcaggtatattttaggcgaaagcgtcactctaagaaatgttctgcgccggatgcgcctgctgtttctttcaatgacctggagaaaatcatcaagccagtggtacagctgctgcccatgccggttgccaagattagaagcagtaagactgttgttgctgtgcctcgtcggagtaggagggtggctggtgtcaagccttgttctccaggtccgatcatcactgaagcccaaaagaaagtcatcaggagtttgggtctcgcagccacggaagaagccattgatcaaaaagctcaagacaactattttaagctgttcgaggggcgcctgacggactctcatcttgctgcacttgctgctatttttggctggcaggctgagcgatttgatgattccagcagcccagttctcctggcaggctgttaattcctgctgtccttggtcgtgtttatttgttttca

SEQ ID NO: 1785 - DNA, 272 bp, Zea mays
  source 1..272: mol_type = unassigned DNA
ccaaaaaggaacttattgattcagtttatctaaaaaacttctgtcctaatcagtttgattcttttgcttttgttccttcggtggggaactcgggggttcaattatcatctggaaaagttcaaaataacaggaaatgtcatctttcaaaatgactatgctcagtcagtggaattcatatccaatttatcgcgtgctcttggattattacaaacatttatgcaccttgtactccagggaaaatagattttctcaactggttctataacatttct

SEQ ID NO: 1786 - DNA, 2585 bp, Zea mays
  source 1..2585: mol_type = unassigned DNA
ggcggtcatttcggcggaccgttcggctccccgccctcccgccttccctgcatgcccttccgcctcccccgcccatcgctccgttaacggcgcccgccccaccctccccgcaccacctagcccctcgccggcgctcaccccgactccggcgaccacttcctcctccccctcccgtgtggcgactttgtctcccgcggcttgtccgttctcccccgctgggcgttccaaggcgcagcggtgggcgtcttcctgcctcaccagcccgtcctcatcggccttgggcgttggtgccgttggaagcggtgcctcgcagaggactttcaaggacgtgctgctgctccctccgcccctgccgtctgcccggcagtccctcctcgacctccgcacagaccgaagtttgcggtggtgcaacgtccctggaacggtgcgcaggcctgttcctgaccgggagggctgggttagggtcgaacctcgtcgacgtcaactccccccttcgccacctccccgtcgatcgatccctgaggatctccgggtaggtgttttaactgtctggcctcctctcatcgggcggcggattgccgacgttcggtgcgctgcttcaagtgttgggggttcggacatcgtgcagttcagtgcaaggttcgtgctgcgcaggtgatcaaagcttcagttcggtgtgggatcgtcttggccctaagctggttcacaagcctttggactctcctagacgcgccatggagtggcgcagggtctcttcgccgatcccggccatccagaggtccggtgtggctgatcctaccttgggtggcacgaagaaacgccgccatcgtacgcggggtcgaaggcctaagaccgcccccgttgcacctttggaggaatccagtgaagttgcacctccacccggttcctcttccctagagccggtcagggtgcatgcccctcaaccggttgttcctgatatggtggaagccacacatctctgcattttggaccgtgcggatgcgcttgctagagaagaactgcggttgcgacggtgtgctctgttcgttgttgtcactggttcaagaccgagggtggctgctgagactcttgctgatgaggtggctgctggtttcgggctggatgcgtcgtccttctccgttcatcgttcgtgcccagaagattttgtcttaatcctgaattcggaagagttggccaatcaggtgtacaacaatggtgctgttttcaattctctttctgggtctttcaagttcctgagatggtctagacttgcccatgccgaggtggtggcctttccatctcctgttcttgtggagttcaaagggattccaattcatgcttgggatttggctactgctcagaatttgttgagggatcactgcactgatgtggagctccatcctgacacggtgaatcgacacgacttctcttccttcaaggtttttggatggtgccgacgtccacacctcattccaaatttggtggagctccttgttccggaaccgttgatgatgacgcctggctctacctctcttgagagaagattgctcgcttaccaagtgactgcccttgtgtctctgatctctccgccggtgcatagcgctgctgcacctccgtcgccggcgtttgatgatgatcaggacaacgggcctcgtcggcgcaggctcaacagttcagttcagatggggcatgctgagtccggggaagcacttgcagcgcgaaggcccgtccgtgaaaggctgggtgttgccccggtctctgttcgacatgtggaggctggattgtccgtgaaagactcggcgccttccgttgccttggttactggggacacgcatactgatgttgtggagccggtgattggctgcatggatgctgggttgagtctgcccctggagaatgttcatgggcctggcactgagactttggagattccaggtgcttgcgatggcccgggtggtgaagtcttcttgtccatgactgatgttgactcttctgttccggcggtggaaactttgagtgcattttcatccctcccgagtggccctgccatcgctacccgtgtggggactgtgttgaagccgtccatgaaggctgttggggcagggctcaggaggtggccgtgttccccaatcaaatatttcagaaggaagtgcagaggggctgctgcttcacaatcccctctctcggctgctcagtctgcgaccactgctgatttcatcgctagagtgtccaggccggccgctcgggtcctgtgtgggccgcagaagcggcagcgtcgccccagggcaccttgtgagggggctctacctcggcggagcaggcgcttggctggagcagatgttgaaaaggtaatggccccagcacaagtttcgaaaggaaaatggaggattgctaatgagctcggccttcttggtggggatccatctgaatcgctgtccctggaggttctcgataactatgccaaggttttcggtgagcggctgactgatctgcaagttaaagctcttgcggctctcttcaactggactgtcccagaagacttgcagggtgcagtggtgcaggcctgatcgcctctgtgtgtattg

SEQ ID NO: 1787 - DNA, 947 bp, Salmo salar
  source 1..947: mol_type = unassigned DNA
tacattacaacggcttgatttgtttgatctgagcaattcttcttagctagctacatagccgtctttgtatcaaagataattgtgtagtttagagtaattagagtaattatcgaggctagctatcttcgtcctcctaacgtagtcaacaccgctgctagctagctagtcatcactgctagctagccaacttctaccgactagcagcactgtagaaactattacattacaacgtaacgacttgattagtgtggtgttagtgttagttagccagctacatagttgtctttgctgtctctgtatctaagataattgtgtagtttagagtaattatcgaggtgagctagccagccgcgacgcggcgccagacttagtcaacacacctagtcatcattaacccactgctagctagccaaccgttaccgactagcagcgctgtagatactaatactttacaacggaacgatttgactagtgcagtgttagctagctagctactagttgtctttgtcatagcttgataattgtgtagtttagagtaattatcgaggttagctagccagctatttccgtcccccgcgacgccatttttcctaacccagccaactattaccgacgagcagcattgtagaaactaaatacattacaaaggaacgtcttgattagtgttatgttagctagctagctacaaagttgctttgtatcatgacaaggtgtagtactgaaactatcgaggttacctagccagctacacgttcaaacaaagtcaacaacgcagccactgctagctagcctactccaccagccagcagtactgtatcattttcgtcattttagtcaataagatttttgcaacgtaagcttaactttctgaacattcgagacgtgtagtccacttgtcattccaatctcctttgcattagcgtagcctcttctgtagcttgtctact

SEQ ID NO: 1788 - DNA, 137 bp, unidentified
  source 1..137: mol_type = unassigned DNA; note = Description of Unknown:Mesobuthus martensii sequence
taacccctcctgaatcctgctaagctgcctcaaagtggcggaggggtgtacgtgggcggaataggcgatgcaagtcagaaattattttctagtagggtcaccctgggctagaaggctattccattatgctcaactaa

SEQ ID NO: 1789 - DNA, 997 bp, Anolis carolinensis
  source 1..997: mol_type = unassigned DNA
ttgatcccagaagggcagttggttctcgcagaagcagaggcagcaggaggacatttttgctccctggcttcaggtaggatttggctaagatttggctaagattttaaactgagtgtgggcttggctcctgtggtcaaagtctaactgttgtgtgactgttgtgttgaaagagagccaggtacttaagttgattgacagcaggcattgtcccctgttaattgagtttctgggaaagctttatttgccagtgtgagtttctgccagagcctgatcccagaagggcagttggttctcgcagaagcagaggcagcaggaggacatttttgctccctggcttcaggtaggatttggctaagatttggctaagattttaaactgagtgtgggcttggctcctgtggtcaaagtctaactgttgtgtgactgttgtgttgaaagagagccaggtacttaagttgattgacagcaggcattgtcccctgttaattgagtttctgggaaagctttatttgccagtgtgagtttctgccagagcctgatcccagaagggcagttggttctcgcagaagcagaggcagcaggaggacatttttgctccctggcttcaggtaggatttggctaagatttggctaagattttaaactgagtgtgggcttggctcctgtggtcaaagtctaactgttgtgtgactgttgtgttgaaagagagccaggtacttaagttgattgacagcaggcattgtcccctgttaattgagtttctgggaaagctttatttgccagtgtgagtttctgccagagcctgatcccagaagggcagttggttctcgcagaggcagcaggaggcacctttactaactatcctttgcagtacatacaggaaacaaagcaacataaacaaatacacaaagaggtggtttgttgcagtttgcacataaagtgcgtgcatattacttaactgtacaaagatcccacttggccaccacgctcaccaagag

SEQ ID NO: 1790 - DNA, 53 bp, Pelodiscus sinensis
  source 1..53: mol_type = unassigned DNA
agaaactcgcacagatacagacagacatcatctttctatccaagtgcaagaaa

SEQ ID NO: 1791 - DNA, 120 bp, Ixodes scapularis
  source 1..120: mol_type = unassigned DNA
tctattgattgcttagtcatatctgaaacgaacataaaggactgcgacgaagcattattccaaaataaaagttttgaaacgattacaaataacaggaagaacaagcgaggaggtggaatc

SEQ ID NO: 1792 - DNA, 281 bp, Petromyzon marinus
  source 1..281: mol_type = unassigned DNA
gcctgtgcgtgtgtgtgtgtgtgtggcaaaacaaccccctacctcctcgcggtgccggacgggcaactctgtcgtggacagtgctgtggggggaggtccaattttgattggctcctcccctcatggcatatgtgtccaccacaggggctaaacgggggctctggacgggtgcgaggggctggtaacccctccaccttcaattaattaccacgaaaccacgaattaaactgaaatatgtaactaataagcttgtgccggaggccccggggggccaggcgtct

SEQ ID NO: 1793 - DNA, 2763 bp, Monodelphis domestica
  source 1..2763: mol_type = unassigned DNA
gacagagtgaaacaactttcaagaaaagaaaaacccaaaaggtaggcagagaacatctggggcactggggtgagaggagagcagagccagcaagaggcatagcaagaagtgaagagcaagccacataccccaccacaccccacatctgctgtcccaggttcatgaacctaagcccaagccaaatcagaccctgagatcctgctgggcaaatagtggtacaagccaacccataccccttgaaatttcaaacctgtggagaagtccaaggcaatctgggctgaagtgggctgatccatgtgggcccagagcaaagccaggaatcccagtctgggcttgggataaggacataattcacagtttggggtgaggtgatagtactcaaggggagcctcactgggatctttttgcctaaagctcagggcagagctccaagacagggcaatcaagggtgtgcctgattggatcaagtacacagtgagaccaaaaaacttgagcctaagcctggggctagaatttgatcagcccctgacctgatcaagatcagagtgagatcaaaagcttacacccaagcctgaggcaagtctttaagctatcagcatctcaagggtcaattgaatcagcagggggagggggctctcagagctctcagccctcagaccatcaggtaaactggtaaaaacccagaaaataagctgagaataacatcaaggaaggactgaagtttaagagggtaccccaacttcccagaaaacagagcctacctataattagataggaaaaatgagcaaacaatcaaaaaagcacctaactctaaagaattttttatggagacaaagagcaaggtacagacacagaaggggacagtgaaagcaaaggaaacacatgcaaagtccaaaagaaaaatatggattggacacagattctggaagagctcaaaaaagacttcaaaaaccaattaagagaggcagaggaaaagtggggaagagaaatgaaagtgatgcaagaagaaaagaaagtgatgcaagaagaaatgaaaagtgatgcaagaagaaatgggccaattgaaaaaggagaaccaaaaactgacagaggaaaatcaggtcttaaaaatcagaattgaccatctagaaactaatgatttcatgagaaatcaagaaacaataaagcagaatcaaaggaatgaaaaaaacagaggaaaacatgaaatatcttattgaaaaaacaactgacctagaaaatagatctaggagagacaatttgagaattattggactacctgaaagccatgatcaagaaaaaaaccttggacatcatattacaagaaattatcaaagaaaactgcccagagatccttgaacaagaaaataaaattgaaattgaaagaattcacagatcacctccagaaagaaatcctcaaatgacaacttccaggaatgtaatagctaaattcaagagccaccaagccaaggagaaaatacttcaaacagccagaaagaaaccattcaaataccatggagctacaatcaggatcacacaggacctagtagcttctacattaaaggatcaaaaggcatggaatatgatattcaggaaggcaaaagatttgggtttacaacccagagtcacctatccagcaaaactgagtatattctttcaggggaaaaaatggacattcaataagatagaagatttccaagcattcctgaggaataagccagacctaaacaaaaaatttgaagtccaaacataagacacaagagaagcccaaaaaggtaaataagaaagagaaaatttaagggactcattaaggtcaaaatgtttatatgtctacatggaaagaggatttctgtaattctcaaaaattactcttagtagtagagaagatagaaggaatttactcagaaagagggtggagaagtaagctgattatgatgatatgatgtatatgatgatatatatgtaaatgtgatgatatggaatgatatgtatgtatgatatgatatgtatgcatatgaatgatatgtaaaaaatcaatcaagggctgaaagagagggttgcactgagagaaaagggaagggagagatagaatggggtaaattatataacataaagaggcatgaaaaatcattatagagaggggaggataagggtggtgatgggcaatgcttaaactttactctcattgtaactggctcagagagggaaaaacaagtatactcagtggggtatagaattctatcttaccctacagagaagtagaaggggaataagacaagggaagggggaggtaattggagggaggggaagtgggggggtgacaaaaagcaaaatactggtgaggaggaacagagtgaaagggaatagagcaggatctaaaggggataatatgatggagggcaatacacagttagtaatcataacactgaatgtgaatgggatgaactcacccataaaatggaagtggatagcagagtggattaaaaaccagaatcctactatatgttgtttacaagaaacacatttgaggcagggtgacacacacagattcaaggtaaaaggctggagcagaatttattatgcatcatctaaagtaaaaaaaagcaggagtagcaatcatgataccagacaaagctaaagtagaaattgatctgattaaaagagataaggaaggaaattacattttgctaaaaggtactataaacaatgaagtaatatcattactaaacatttatgcaccaaatggtatagcatctagatttctaa

SEQ ID NO: 1794 - DNA, 741 bp, Petromyzon marinus
  source 1..741: mol_type = unassigned DNA
agcttagctgattggagaatatagagtttattgataacatgaaggtaatttatattttagtttttattggttcactatatagtactgtgaatagctcagatgtgtaggccttgacttcaacatagtcatttctgtgaccagtcactagcaaatcacccagttatttcaatgctaaattcgcctagttatttcaatgctaaattctcctgtttgatttgtactaagtgcctcggtgaatgtgtatgctctgacttcaacgtaactatttctgtgagcagttacaagctaatcactcagctatttcaatgctaaattctatgctaattccattgtcaaggggtgcctctgcggatgtgtatgccttaacttagctatttcaatgctaaattctatgctaattcctttaacaatgggtgcctctgcggatgtgtatgctttaacttttaacatagctatttctgtgaccagtcacaagctaatcattcagccatttcaatgctaaattttatgctaattcctttgtcaaggctctttgttcctctcacacagcttaaaagccgtgatctgaacgtggctctctcactccagcgctgtcctaccagacagtctcgctcccttcacctgatgaaggccgcttgtgttgtggccgaaacgtcgtgagaatattattgtgttattttattttatcaatttattattttattctcattctacgtgactttaccgaaagaaccaaagaag

SEQ ID NO: 1795 - DNA, 799 bp, Drosophila persimilis
  source 1..799: mol_type = unassigned DNA
ggctaatgcagcacacaaatttacttgcctgtgagatcgcaacgcacccatacattccaagaaggctggccaggccaaggtatgccgcaatgatagaagagcacaatccaaacagcaacagaagcctgacagccatccaaacaatactgctccaagtcagacgcgagaactggctgcgcaatccatttgcaacacacaatatggaaatcagccgcagtagcgctaatgcagctgctacgcaggcaaatgacggccccagcagagaacctgatgatggacggcggcagctccagaatccagatgatggcggcggctgaaaagaaactaaaaacctttttattcttccacagatacgaagccacttcacctgcacagaaattggtaatccacatccagaatgacgatgcactggacctcggccagcttcagccctgttgatgctgtcctgcagtcacagtttagcgccgacactcgcaaggattccacttcgcagccgacgacgagaccaataggcgtaatgatgttcttcacggctgcatactccacctgaaataattaaaaacaaaaacaatgtaaacaaagtagcaataagtttagtgttaccctggcatttagccaaattatcgatagctactaaaaaaaaataaataccaaataagccaataccgtaagaaatgttaccctgccaatttacagccacttctgcaactacatgtaatgtagataagcagttggcgcgaaacaatttgtaaaatatgctaattataagagtataaacaaataaaacggttctctcttc

SEQ ID NO: 1796 - DNA, 488 bp, Parhyale hawaiensis
  source 1..488: mol_type = unassigned DNA
ccgaccgccagcgggataactggcaaaccctgtctcgaccaccggcccgtgaatccatcggggcgtatgagtcagacacaggggggtgtttaaggtgaccctgttgcgaggaaatgcgcagcaaaagccggatgagccttagaacatcgaaggccaacgacaacctgccgaaagactggcggctaatccagtcaacctcctgtaggtcaccggctggtcatgctgaatctcagcttaaccaggcgtacgaacttacagttggagggtcgagcacccctgatggctgaaaaggaccatcaaagtcgaaggtagccaacgagaagaccaacggctgattcaggcggaagagtcaactcgttgaatgcgttcgacagcttggggtagatggaactcctaagccctgaaaggcagtccatcttcgcagacgctaaggtgccccgccgcctgagggttatcaggccccgccgcctgagggttaccaggcaacc

SEQ ID NO: 1797 - DNA, 39 bp, Capitella sp.
  source 1..39: mol_type = unassigned DNA
gatgaattgtataattgtgttgattatgatcgtgattca

SEQ ID NO: 1798 - DNA, 158 bp, Anolis carolinensis
  source 1..158: mol_type = unassigned DNA
cccccccgcaggtgccaccttgacgtggtgggggggcttagctgctccaatgatgactgagggctgtgctggcggtagtgtaactaccggcaggtccaaccaagccagagaggcctcagctgaggagcacaaccaagagcacctaacccattagcatt

SEQ ID NO: 1799 - DNA, 18 bp, Aedes aegypti
  source 1..18: mol_type = unassigned DNA
atcgctgttcgtacctga

SEQ ID NO: 1800 - DNA, 188 bp, Aedes aegypti
  source 1..188: mol_type = unassigned DNA
ggtgggagctcaggcaacataactcctgggcgtccatgaaaaaccaccatcttgagtaggtgggagcttgaggtaaaatatcctgggcgtccatgtaaaaccaccctcggcgagcagcggcgcttgaaccaagctattaagcactgtaattggaggaaatgccaatgcagaacccgtagcttccggga

SEQ ID NO: 1801 - DNA, 113 bp, Arachis sp.
  source 1..113: mol_type = unassigned DNA
actccgcctatgttacacttgcggtacatagccggtcccaagcccggataaaggaggagggttgtgttaggtcttcggcaaccaacataaaaatatagccgaacccccatgac

SEQ ID NO: 1802 - DNA, 367 bp, Aplysia californica
  source 1..367: mol_type = unassigned DNA
ccggagtggggcgaccatccccgacccggcgggtcccaggtggcggatagggaacggccactgttatagaggttagctgtgaatatattgaataagcagccccggaccaactggcgatgctcttaccaggacggggtgaggtggtaggtggcactaccacgtcattaaatgccctaggagtcctctgacgggagcatcatgaggaaaaggaccgcattaagtcctggctacgggggggatccggtaacaattcctccctgtgctcccagggtaggtccttggacctggagctggagtgctgaaatcggaggtattgggccgcaaggcgcactctagagaaccacaataccacgtaatactgcaatat

SEQ ID NO: 1803 - DNA, 716 bp, Aedes aegypti
  source 1..716: mol_type = unassigned DNA
ttggcgcggtaaatggctgggcatggcgtaccattggtacctcgcgtacctgcaggaataaaatagacccctttgtgcggtccttagcctcttgcccagcaactcctatccctacctcctcgtggtactggccggggtacgagtaaccttggggaagatcgggtaaccaacccccggtgggaactttggtcgtatgctgacagggaagggggggtttgcttttgcaaacctggagcgtctgtactccacgttaggagcggctcacaacagcgtctgttccccatgtcaggggcggctgatcatcgtccgagtgccagagaaggactctaagctaaactgcgcactatggccctccgaacatttagggggaatggtcctccggaaatctagggggttggtgtcaggccctgcaagccaaccgtaaaaacacatcagcacaggaacgtcaacgagagaatacggaccggaacaatcggcaaagaccacagcgacgaaaatggactagcgattggaaactcggtacgtggaactgcaaatctctcaacttcattggaagtactcgcatactctccgatgtactgaagacccgcggtttcgacatcgtagcgctgcaggaggtgtgctggacaggagcattggtgcgaacgtttagaggtaatcataccatctaccagagctgcggcaacacacgcgagctgggaacagctttcatagtg

SEQ ID NO: 1804 - DNA, 333 bp, Aedes aegypti
  source 1..333: mol_type = unassigned DNA
tgggttgtaaaatggtgagtcgacaaccaggaaggagcgtccaacatagctctggtcctcgcaagtccctacctcacgcttcctcgggtctaacgatgacaaagaccgccagctaagggttgcgtacttagctggtagtgcaacctgggcactgttgtccttctgacatcagctagagtgagggggtgcgtcccgagcgtctgttcaccaggaggtgcggctcaaacagcgtctgttctggtatccagcggctgagtatgaaatgttgtatcacgtcaactaacctaaggtggcagccccatcaacgtgatgtaggtagcgcaaccccggtaa

SEQ ID NO: 1805 - DNA, 335 bp, Aedes aegypti
  source 1..335: mol_type = unassigned DNA
tgggctgtgaaatggtgagccgacaactaggaaggagcgtccaacatagctctggtcctcacaagtccctacctcacgcttccacgggtcaaatgatgacaaagaccgccagctaagggttgcgtacttagctggtagtgcagcctgggcactgttgtccttctgacatcagctagagtgaggaggtgcgtctcgagcgtctgtccaccaaggaggtgcggctcaaacagcgtctgttctggcatccagcggctgagtatgaaatgctgtatcacgtcagctacacctaaggtggcagccccaccatcgtgatgtaggtatcgcgaccctggtaa

SEQ ID NO: 1806 - DNA, 187 bp, Aedes aegypti
  source 1..187: mol_type = unassigned DNA
accgctagcgcatgacggctcaccatagtagcatgtccgaaagaacttgaaactattgagaaccagagctacaggtccaaagccctgataaaggtggatggttgtgatggctatgaccgtggtcatcatgtaaagaacaagcggacgatgctgtatcgtgtcagcatcgaggaggcagcccctctag

SEQ ID NO: 1807 - DNA, 333 bp, Aedes aegypti
  source 1..333: mol_type = unassigned DNA
gggctgcaaaatggtgagtcgacaatcaggaaggagcgtccaacacagctctggtcctcacaagttcctacctcgcgcttccacgggtcaaatgatgacaaagaccgccagctaagggttgcgtacttagctggtagtgcagcctgggcactgttgtccttctgacatcagctagagtgaggaggtgcgttctgagcgtctgtacaccaggaggtgcggctcaaacagcgtctgttctggtatccagcggctgagtatgaaacgctgtatcacgtcagctacacctaagatggcagtcccatcaacgtgatgtaggtagcgcgaccccggtaa

SEQ ID NO: 1808 - DNA, 402 bp, Aedes aegypti
  source 1..402: mol_type = unassigned DNA
gggtggtaaatgactggacaatgcgtaccattggtacttcgcgtacctgcaggtataaaatagaccccatttgtggtccttagcctcttgtccagtaactcctatccctacctccccgtggtgccgcctgggatacgagtaaccgtagggaagatcgggtaaccaaccctggtggaaccttggtcgtatgctgacagggaaggggggctcctctcttctgagggtgtagcttatcagagcgtctgttctccatgttaggggcggctcaaaacagcgtctgttctccatgttaggagcggctgatcatcgtcctagtgccagcgtgggactctaaacagtgctgtgcacgatgatcctccggcgagacagggggttggtgcaggccttacaagccagccgtaa

SEQ ID NO: 1809 - DNA, 429 bp, Aedes aegypti
  source 1..429: mol_type = unassigned DNA
ggtaaatggctgggcatggcgtaccattggtacctcgcgtacctgaaggaataaaatagacccctttgtgcggtccttagcctcttgcccagcaactcctatccctacctcctcgcggtactggccggggtacgagtaaccttagggaagatcgggtaaccaacccccggtgggaactttggtcgtatgctgacagggaagggggggtttgcttttgcttttgcttctgcaaaccttgagcgtctgtactccatgttaggagcggctcacaacagcgtctgttccccatgtcaggggcggctgatcatcgtccgagtgccagagaaggactctaagctaaactgcgcactatggtcctccgaacatttagggggaatggtcctccggaaatctagggggttggtgtcaggccctgcaagccagccgtaa

SEQ ID NO: 1810 - DNA, 640 bp, Aedes aegypti
  source 1..640: mol_type = unassigned DNA
ttagtggctgcttgggcacgtcaggagttaatcatcaatattaacctccttttcccgagcagcctagatagccgcgtagtgtcggtagcggttgtttcaactggctaagaattaacactacggactgcctgttccggtggtaaaagtccacctcacaggtgacccctaatttatggtgtgatgcgtaccgtgcctaagaatgaatggttaggggggtctaaataaaacctaaccgcaaacggagcctgtggggtaccagggcgccctccacagtattgagtccttcctgtgctacccggagcaatggtgcaggtgaccttgtgtttctccgagataatcggctgcccttcttcagtctctatcttgaggcttaataagggtgggattatgaatatgttgacatttaatttaaattatcacctatatggattcgcattatgcgttttacacagtgtattctgtgctctttcgcctttggcgactttaaatagataccgatctggttttttcgttgctggtctttttcgtgctgagattgcaaaaagcttaatcctgcctagtttgggtagtggctacggttaggttagctcagatcaatcttcagcataaaagaacagcaacgatcaatctttgcagactc

SEQ ID NO: 1811 - DNA, 297 bp, Aedes aegypti
  source 1..297: mol_type = unassigned DNA
gggctgcaaaacggtgagtcgacaactaggaaggagcgttcaacacagctctggtcctcacaagttcctacctcacgcttccacgggtcaaacgatgacaaagaccgccagctaagggttgcgtacttagctggtagtgcagcctgggcactgttgtccttctgacatcagctagattgaggaggtacgtctcgagcgtctgttcaccaggaggtgcggctcaaacagcgtctgttctggtatccagcggctgagcaagaaatgctgaatcgcgcacagctaaatccaaggtggtag

SEQ ID NO: 1812 - DNA, 667 bp, Alligator sinensis
  source 1..667: mol_type = unassigned DNA
cctgaccgtattatgagggacttcgaggctctggggaccaggctgaaggagacgggggcgcaggtggttttttcctctctccttccggtgagggggcggggacagaggcatgggacctgcattggtgaggtcaaccagcgcttacgcagctggtgccgccgggcaggccttgggttccttgacaacgacccatgctttcgggaggggggattgctggggcgggatgggcttcatctctcccctaatggcaagcgtatcttctcttccaggttggctgatctcgtacggcgagctttaaactagactcgccgggggagggggctgcaggaagacgaggagacgccatcagggcaaggggtgcaaaggtaagtaatgggggtcttgccatcagggcaaggggtgcaaaggtaagtaatgggggtcttgccatcagggcaaggggtgcaaaggtaagtaatgggggtcttgccatcagggcaaggggctgcaggaagatggggggtcgccatcagggcaaggggctgcaaaggtaagtaatgggggtcttgccatcagggcaaggggtgcaaaggtaagtaacaggggtcctgatggtctggctaatcagggggtgggggggcacacagtcttgcaaggccttaaatgcctgtacaccaatgctcgtagc

SEQ ID NO: 1813 - DNA, 1050 bp, Anolis carolinensis
  source 1..1050: mol_type = unassigned DNA
gagaggcctgctgttgtgctgcagaagaggccagaaacatctccagccagcctgcctgttgctgcctctgggactccttgtgagtagactgcagccccaggccctttccatctgggtgtgactcagcacttcctaggaaggaccatctataaagcctgagtccacaaggccctggcagggctgagaggcctgctgttgtgctgcagaagaggccagaaacatctccagccagcctgcctgttgctgcctctgggactccttgtgagtagactgcagccccaggccctttccatctgggtgtgactcagcacttcctaggaaggaccatctataaagcctgagtccacaaggccctggcagggctgagaggcctgctgttgtgctgcagaagaggccagaaacatctccagccagcctgcctgttgctgcctctgggactccttgtgagtagactgcagccccaggccctttccatctgggtgtgactcagcacttcctaggaaggaccatctataaagcctgagtccacaaggccctggcagggctgagaggcctgctgttgtgctgcagaagaggccagaaacatctccagccagtctgcctgttgctgcctctggactccttgcctactgcccccctccctttttcccagcgctggtgagtggacataagaagggagggaagacttttaaaactccaaagccatccggaggaagaaggcagaggaactgactttaaaatcattctgtctcttgctgcaggcctactgccctcctcgctttccccagcattggctattgaactaagagtctgtcttactgaggtccactcattatttatatattgctgctataacaatctttaaatgctgttataataactattatgcactgtgaagcctggtccccctgactagtttactaagtctatcatctctaattggtcctgccctggcaccttataataccatattgcaccatattgaattagttcaccatcataatccccactgcctgccttgcactttagtcagctcagacccctatacct

SEQ ID NO: 1814 - DNA, 1034 bp, Anolis carolinensis
  source 1..1034: mol_type = unassigned DNA
ccccctcgatggattgtcaccttgccgtggtgagggggcttgcgtgttccgatgaacctgtgggcacaaccactggagtgatgcactcccaggagtggccgcaggggaggttccagaccaagcacaatccgaagacccaaagacctcaacggcggagcaggcggaggataacatggtacatgttacaacggctgtgaaggcggaagaaggctgcaacagactgagaagccactgtcgttgtgttaaccacaccactgctggaacctcactctgtgaagactgtgtgttgaccggccgtgcaccgacctccacacattaaaaaaaaatcacgcacaggcgtcttccaacaaaaataaaaacaaacctacaaaagtcccatggcgatcagcgagtggcgacgggggcaggactgtgaaatctggaagcccctagtcacagactggcacatgggcggtggatatggactcagtcgttctacctcaaggaccgaggcagttgagtagtccggcagctgtatccatgactgagcagccctttttaggatccgctctgctcaccccacacggggaaggggctagaaaaggtgccctaaacatagtctgcctctcctaccctgactggactgccgcgtccagaggggtcaccactctgcggccaaaaaagaaaaatgaactttggaacatggaacgtacggacattgttagataacactgacagcgaacgccccgaacgcaggactgctctcattgcaagggagctgggacgctttaagatcgacatagcagcccttcaggagacccggagagcaggagagggacagctgaaggaagaaaagggaggctacaccttcttctggaagggactgcctgaagaagagcgaagaatacacggagttggctttgctatcagaaacgacctggtgaagcacctgactgaagcacccactggcatcaacgaacgactttcaaccctccgaattaaccttgccaaaaaccaacaggcaaccatcatatgcgcctatgcaccaactctag

SEQ ID NO: 1815 - DNA, 109 bp, Anolis carolinensis
  source 1..109: mol_type = unassigned DNA
gggggacacggaaagagcctccccgaagattgagtgaattcagtcgggcgtcccctgggcaacgtttcttgtaagcggccgatctttccaccccaaaagcattggatga

SEQ ID NO: 1816 - DNA, 372 bp, Anopheles gambiae
  source 1..372: mol_type = unassigned DNA
tgctctgtaatgggatgggatccgaagccccattgagggataatacaggctctcccatccaactcctattccgacacgtcctcgtcgtgcagagtggtaacatgtgtcaccacatatccaagcttgggtacacgggcttgacccaaccccttgggcggatggtggcacatggcgaaccaggaggggggtgggtatcccgggaaactgggtgcctgaacgtcgggggggcaacccgacgctaaacaaaacggtcacgtgggcgcagggccagtcacccagtcccatgaatcaacgactacggaaagcaccagaaatattcgaaacggacttaacgataccgaccctacgcaatgcccccggactactctgaaa

SEQ ID NO: 1817 - DNA, 213 bp, Aplysia californica
  source 1..213: mol_type = unassigned DNA
tggctggagctaatgctcctggtagggccacccatgccagacaggtcgacgggtagaggtcagacatagcgtgatccaccggccctccaggtttcggaggttcagctcagggctagcgacccagactggtaaaaagcatatgttacggaaacagcaacaaagagaaaccatatttctgtgtgtgttggaccttcagagtcgcttgtgactcgt

SEQ ID NO: 1818 - DNA, 690 bp, Bos taurus
  source 1..690: mol_type = unassigned DNA
gcgcaggcggctgcgacgggcgcactaagcgcggccgagaggagctaccccacgtccgaggtcaggggcagaagccgggaggaccccatgcccgaagggcggcggccaagaggagttaccccacgtccgaggtcaggggcagcggccgagagtgccagactgcgacggcgcaggaacggccgagaggagctaccccacgtccgaggtcaggggcggcggccgagaggagatacccagcgtccgaggtcaggggcggcgacgagaggagttaccccgcgtccgaggtcaggggcggcggccgggaggagctaccccacgcccctaagcccgaggccaggggcggcggccgggaggagcaaccccacgcccgaggccaggggcggcggccgggaggaccaaccccacgtccaaggagccgtggctgcgcgggcgcaggagggcctagaggagctatcccacgttgaaggtcaggaagggcggcggtgaggagatacccctcgtccaaggtaaggagcagtggctgcgctttgctggagcagccgtgaagagataccccacgcccaaggtaagagaaacccaagtaagacggtaggtgttgcaagagggcatcagagggcagacacactgaaaccatactcacagaaaactagtcaatctaatcacactaggaccacagccttgtctaactca

SEQ ID NO: 1819 - DNA, 2736 bp, Choloepus hoffmanni
  source 1..2736: mol_type = unassigned DNA
gaggcggggcaagatggcggagtggtgaggtgtatgttttagttactcctccagggcagtaggtagaaagccaggaactgcgtggactggacaccgcagagcaatttgactttgggcatacttcatacaacactcatgaacacgtggaacagctgagatcagcgaaatctgtaagtttttgtggccaggggacccgcgcccctccctgccaggctcagtcccgtgggaggaggggccgtcagtgctgggaacgaggagggagaactgcagttgcagctcttattggaaactcattctactgatccaaactccaaacatagatagactgagaccagacaccagagaatctgggagcagccagcccagcagagaggagatagggatagcaaaaacagcaaagaaaaacccaaaaataaaagcagagactttttggagttctggtgaacatagaaaggggaagggcagagctcaggcagagtcaggctcatatgcaaatccagagggcgagtttccttgtctgaaaagctggtttctctgctctctggatcgttccttaatggccctaatctccttgtctcttagcatttcaatagcccattagatctgcaaggagggcccttctttttcttcttttttttttttttaatctttttctctttttctaaaacaattactctaagaagcccaatacagaaagcctcaaagacttgcaatttgggcaggtcaagacaagagcagaactaagagagctctgagacacaaggcaataagtccagtggctgagaaaattcactaaacaccacaacttcccaagaaaaggggggcgtcccctcacagccatcttcctggtgggcagggaacactcctgcccggcgccagccccacagcccagagctgccccagacaacccagtgtgacgggaagtgtttccaacaacacacgcacacaccacaaaattgggcatggacattagcctttcctgcaccctcagctgattgtcccagagttgggaaggtggagcagtgtgaaaagggggaaattaacacgccccattcagccatcctttcagcagactgggaacctccctacacagccctgcagcccagaacctccctggggggacggcactcacctgtgacatagcacagtcatccctcaacagaggacctgggggtgcacggcctggaagagggacccactcgcaagtctcaggggccatacgccaataccaaggacttgtgggtcagtggcagagacaaactgtggcaggactgaactgaaggattagactattgcagcagctttaaatctccaggaacaccagggagatttgattgttagagccgccccccctccctgaccgcccagacacacgccccatatacagggcgggcaacaccaactacacacgcaagcttggtacaccaattggaccccacaagactcacacccccactcaccacaaagacaaagtgggggagaactggcttgaggggaataggtggctcgtggatgccacctgctggttagttagagaaagtgtactccacgaagctgtagatctgacaaattagagataagggtttcaatcggtctacaaatcctaaaagaaccctatcaagttaagcaaatgccaagaggccaaaaacaacagaaaattttaaagcatatgaaaaaaccagacgatatggataacccaagcccaagcacccaaatcaaaagatcagaggagacacagtacttggagcaattaatcaaagaactaaagatgaacaatgagaccatggcacaggatataaaggacatgaagaagagcatggcacaggatataaaggacatcaagaagaccctagaagagcataaagaagaaattgcaagagtaaattaaaaaaatagatgatcttatggaaattaaagaaactgttgaccaaattaaaaagattctggatactcatagtacaagactagaggaagctgaacaacgaatcagtgacctggaagatgacagaatggaaaatgaaagaacaaaagaaagaattggggaaaaaaattgaaaaaatcgaaatggacctcagggatatgatagataatataaaacgtccaaatataagactcattggtgttccagaaggggaagagaagggtaaaggtctaggaagagtattcaaagaaattgttggggaaaacttcccaaatcttctaaacaccataaatacacaaatcataaatgcccagcgaactccaaatagaataaatccaaataaacccactccgagacatattctgatcacactgtcaaatacggaagagaaggagcaagttctgaaagcagcaagagaaaagcaattcaccacatacaaaggaaacagcataagactaagtagtgactactcagcagccaccatggaggcgagaaggcagtggcatgacatatttaaaattctgagtagagaaaaattgccaaccaagaattctttatccagcaaagctctccttcaaatttgagggagagcttaaatttttcacagacaaacaaatgctgagagaatttgctaacaagagacctgccctacttgagatactaaagggagccctacagacagagaaacaaagaaaggagagagagatacatggagaaaggttcagtactaaagagattcagtatgggtacattaaaggacattaatagagagagggaaaaaatatatatctgacaaacataaaccaaaggataag

SEQ ID NO: 1820 - DNA, 15 bp, Clonorchis sinensis
  source 1..15: mol_type = unassigned DNA
tagtcggcgagctga

SEQ ID NO: 1821 - DNA, 149 bp, Cyprinus carpio
  source 1..149: mol_type = unassigned DNA
caaaaggtaaagggggaggtgttgcttcaatttataacaatgttttcaggatttctcagagggcaggcttcaagtataactcgtttgaagtattggtgcttaatataacattatccagagaaacaaatgttaatgataaatcccctgtg

SEQ ID NO: 1822 - DNA, 1110 bp, Danio rerio
  source 1..1110: mol_type = unassigned DNA
gcaggagaagcactttagcagcatctagaacagcagcctgtaagtacatttaagatttgtttcagttgttgtgtatggtttgaggacttgtttccagctgtttgtgtaaagttgtaggacatttaaacttgctttcagttgtgtataatactagaagttgtttagccactgtttccttggttactataagagcttgtgtagcgaacgcagacgcggttcgcgtcgtccgcctcagtttcggcccttgttttgactcgggaggcgtgtccaaacgccaggtaaccactatatagtgagcacggtagcattagtcggcaggagaagcactttagcagcatctagaacagcagcctgtaagtacatttaagatttgtttcagttgttgtgtatggtttgaggacttgtttccagctgtttgtgtaaagttgtaggacatttaaacttgctttcagttgtgtataatactagaagttgtttagccactgtttccttggttactataagagcttgtgtagcgaacgcagacgcggttcgcgtcgtccgcctcagtttcggcccttgttttgactcgggaggcgtgtccaaacgccaggtaaccactatatagtgagcacggtagcattagtcggcaggagaagcactttagcagcatctagaacagcagcctgtaagtacatttaagatttgtttcagttgttgtgtatggtttgaggacttgtttccagctgtttgtgtaaagttgtaggacatttaaacttgctttcagttgtgtataatactagaagttgtttagccactgtttccttggttactataagagcttgtgtagcgaacgcagacgcggttcgcgtcgtccgcctcagtttcggcccttgttttgactctcgaggcgtgtccagctgaattcaatcagctagtgctttggggttatataaacaactagttcaccgcggcagcggtcgcggcagcctcgtgtgaagaccgacgagggtaaagaccatcgactctacctgcgcgactccaccgagcaaagacaccgacaaagcacttgagtactttactgtattgttttactttacacttattttttgttgtcagtgcacttttatt

SEQ ID NO: 1823 - DNA, 89 bp, Dendrobium sp.
  source 1..89: mol_type = unassigned DNA
gttgccaggtcccaagtcctggatgagaaaagtggagggttgcgttaggtagtcgacagccagcgtaaaacttgtcgaacaataatgac

SEQ ID NO: 1824 - DNA, 1033 bp, unidentified
  source 1..1033: mol_type = unassigned DNA; note = Description of Unknown:Locusta migratoria sequence
tttcaccagaatattgggggactaaagaataaaatagatgagcttttggtttgtttagatgatatagaaactgataatgtaatagatatactatgcctgtctgagcatcacattgtcactggtatggaaaatgtgaatgtcagtggatataaattagctgcaaatgtaagtagagataataaggtaagaggaggagttgccatatatgtcaaaagctatcacagtgtaaaaaatttagaaacaaaaaagttttgtgtagagcaacatattgaagcatgtgcctgtcagcttaaactcaatgatgattctcttataattgtaacagtatataggtccccttcaggaaactttcattatttctggaaaacttggatgccttgttgtgctatctgtcagatagggggaagcaaattattatttgtggtgatttcaatgttgattcactgaaagagtgtaataggaagaatgacctggaagtcttacttggctctttcaatttgacatctgttattgattttcctactcgggtagtaaaggacagcagtacattgatagataattttttatagaccaagataagtttaacaacataaatgcttgtcctgttgagaatggtctttctgatcatggtgcacagctagtaacagtatatgacatagctcctttcagtaattcgaaacagtcctccagagttgtgcgctcaattaatgatttaacaactagaaatttcaaagaaagtctacagcagttagactgggatgaggtttataaggaacctgatgctaatttaaaatataacttatttcatgatacatttgtaagggtatttgaaaactgtttccccaagaaattagttaaatataattgtaagaaaccatgcaaaaaaccatggcttactaaaggaataaaaatatcttgtaaccgaaaaagggaactatatctatcagcaagaaagagtaataacccagaaacaatcaaatattataaaaactactgtgctacattaagaaaagttattaaaaaatccagaagc

SEQ ID NO: 1825 - DNA, 313 bp, unidentified
  source 1..313: mol_type = unassigned DNA; note = Description of Unknown:Locusta migratoria sequence
ccacccccatgaaccacagacattgccgaggtggggtggcttgcgtgcctcaacgatacagatagccgtaccgtaggtgcaaccacagcggaggggtatctgtggagaggccagacaaacgtgtggttcctgaagaggggcagcagccttttcagtagttacaggggcaacagtctggatgattgactgagctggccttgtaacatcagctaacatggctttgccatgcagttactgcgaacggctgaaagcaaggggaaactacagtcgttacttttcccgaggacatgcagctctactgtatgaatatatg

SEQ ID NO: 1826 - DNA, 136 bp, unidentified
  source 1..136: mol_type = unassigned DNA; note = Description of Unknown:Locusta migratoria sequence
caaaatagtgaagcaagacctacaaaaaatccttggatatcacagaaatttaattagaaaatataaaaatgcagtatgaaggcaaaatgagtacagacgactaaaaatgagattgacaggaagtcaaaatggctaa

SEQ ID NO: 1827 - DNA, 104 bp, unidentified
  source 1..104: mol_type = unassigned DNA; note = Description of Unknown:Locusta migratoria sequence
taactaaaacctctaggacagcaattgataatatttttatagacaaatcaaaggaacaaaatcatatcataaaaccaataataaatggcctatcagatcatgat

SEQ ID NO: 1828 - DNA, 710 bp, Monodelphis domestica
  source 1..710: mol_type = unassigned DNA
gggtgtatggggtgctcagggaggggtagtatctctggtatggagggcttgtcgtgccctcctagggcagctctccagcctctgacccccacctgacacccagctctcacttgtggctcccagtagctgctagcatgtggcagcggccacaccccgggcaacggcttcgacaggccggctaaaccttgtgagggtagccatcgggtcatcgacccctggtgaaccagggctttgctcacccagcatgtgaagactgcttcggctgaacagacggaagaaaccaataagaaggttcaacggctgagagggcgacgcagcaaagcactgtggagtgcttagggcgtgttggagcacaaaggacaacacggccatccaatgcagctgaggaagtctccagatgtaacaatttttcgtgccactggacccaggcttccaacgccgagagagtgggactgtctctgtgcatcggcttttccacttaaatctctttcacgcacaagtatctttgtgcacactcatctatcctaaccccgtccaccctcttcaagacctgcggcgatgggggagtggcgacgcaacaggtggaggtgaccactggcagttgtagtcacgatcctgcacgtaggcggcccacggaccagtggtcgctcggccctgtgggcagcagggacgttcggcagcatcctgggcgactgagcagccctctctag

SEQ ID NO: 1829 - DNA, 742 bp, unidentified
  source 1..742: mol_type = unassigned DNA; note = Description of Unknown:Nasonia vitripennis sequence
atggcggagtactagcatcgggtaacttcacgtacctgtatgggagtgggggatctctaggcaccggatttctcgtaagcaaaagcatcatacattcggttaaaagtttcaaatccgtcaatgataggctctcgtacatcattatcgaaggtgaatggtatagatatgtatttattaatgtacactgtcctacggaggacaaagaagaagaagctaaggatctctattacgaaactttagagcaggtaatcgaccagttcgcgtcttacgacacaagaatagtattaggcgatttcaatgctaaaataggtagggaggaaatgtttaggcctactatagggaaggaaagcctgcacgaagccagcaatgataacggtattagggtcataaatttcgcggcggcaaaagatcttataatcaaaactacgtgttttaagcacaaggacatacacaaggcaacgtggacatcgccggacggggccacacagaaccaaattgatcatttcctcattgaaaaaagacgtaagggcttacagaggggcagatagcgactcggaccacttcctagtagtagccaaattaagagctagactagtagcgaatcaaaatagtaagcgagcaaacaaggtagaaagcttcgatattgagaagctacgagatagaacagagcgaattaggtaccagatagaaattaataacaggtttcaggcacttgaagaagcaaacacatcgccggagggga

SEQ ID NO: 1830 - DNA, 776 bp, Nicotiana sylvestris
  source 1..776: mol_type = unassigned DNA
tactgtcagggctacaccagtggtagcggtgacagccctttttggtttttgggtcgtggtattttctgtgttttcagggaaattctcgaagttgttggagacaagttgggcgcacgagcactagcaaaggagagcaacctggacgagcgtcagcaaagggcggtgggaagcggtgcgtgagcgtacaactacatcgagtacagcaaatcaacacaggtttggttctcgggagttggtacctcccgttctactgtttcccttttggtgttagctaaattgatgttactttagttcacaatagttcaatcattcaactagtgtacttgtagtcacttgtttccttctagtttgattcgttgtccgttgtgcactagcgagtcttctttagatttgtcgtaggtgtagtggctgcagtctgggatgatagattaagggcatgtcctcgggtggggcagagtgtggggccggggtcagggtgtgggacgggaggcaggggaggtagagggggcaagggagcctataggttgagaatcgggtcatggaacataggttcgctaacgagtaagtctatagagttggcgaagatccttcagaagaggaagattaatatagcgtgtgtccaggagactaggtgggttggatcgagggcgaaaaacgcggatgggtataagttgtggtactctggagtcctgaggggtaagaatggagtgggtatcctggtagatagccatcttagagagtcggtggtagaggtcaggcgggtgaatgatagacta

SEQ ID NO: 1831 - DNA, 59 bp, Orycteropus afer
  source 1..59: mol_type = unassigned DNA
actcgtctgtcagtttgtcatactgtggtggcttgcgtgttgctgtgaggctggaggct

SEQ ID NO: 1832 - DNA, 112 bp, Oryzias latipes
  source 1..112: mol_type = unassigned DNA
atctagccacaggggttgcaagccagttacttctgtgccggtcccaagcccggataaatagagagggttgcgtcaggaagggcatccggcgtaaaaaattgccaaaataacc

SEQ ID NO: 1833 - DNA, 151 bp, Oryzias latipes
  source 1..151: mol_type = unassigned DNA
tgtgaaccgccaccttaacgtggtgggggagtttgagagctcgggtgatcccaggagctaagctgtctggggcttaagcccctggtagggtctcccatggcagacaggtcctgggtgacgagccagacaaagagcggttcagaaacccctg

SEQ ID NO: 1834 - DNA, 202 bp, Oryzias latipes
  source 1..202: mol_type = unassigned DNA
aattcacacatcagtcacaaaacctacgacatgcacacatcagattttacccacaaccatgaagatggctcttttaaatgtcagatcacttttaaataagtcttttatcattaatgatctgatttagaccatgatttaacctgtttgtttttaactgaaacctggcttggctctgcagctctactgagttctacctttttaa

SEQ ID NO: 1835 - DNA, 383 bp, Parhyale hawaiensis
  source 1..383: mol_type = unassigned DNA
gcgtggcctgcgcgttatcaggccgcccccattgtccggccaccggacgcctctttgtttgtatgagctggctttgggtttggggctctgggtagcccctgagttggaggaaatgccactctaaaggcggatgagacctcttttggtccaacggcatccctgagaggagatgaacaggctggtgccatagctgggtactcagtcttccgcagtctgctcctctctctcttccatcaggtagtaccacctgatgctcttttcctttcctttctcttcttcttcttttcggccaaagcctgtactggtgatggcagggtctggggcgcgtagatagctggccgctttcgtagctatcgttactgtcgatttgtttttgctttatt

SEQ ID NO: 1836 - DNA, 678 bp, Pelodiscus sinensis
  source 1..678: mol_type = unassigned DNA
tggtacgctaagagcacggcaagacatgaaagatgccctggtcaaccactgcgcccagcccatctccaaccgtctcgactttagtcctgccattggagtaagatggaatctgggaagagagagtgaggctgactatgcgcacctctccctcactttaatccaattcacgcgcaagtcttgacatctcgacatctcctaagtcctgtggcgacgggcgagcgacgaagcagcaggtgtggatacactgggagctgtagccgcggacctgcacacaggcggctcaggtctaatggtcgtcttcttgctggtggaagcaacagctggattcggcgtctacctgagtgactgagcagccctctttaggattgcactgctcacctccgtagtaagaggaaggggctagaaaaggtgccctaaacattgtttgcttcacagaaccctggccagcttaccgcggctggaggggatcccatctcatgcggtcgaacaataaaatttcgaacaaaatgcaaggtgacaccactcactattggcacatggaatgtacgcacgcttcaggacaacccttcagcagaccgcccagaaagaagaacagccctggtcgccagagagctcacaagatttaacatcgatattgcggcactgtgtgaaactcgtctagcaaatgaaggtcagctc

SEQ ID NO: 1837 - DNA, 98 bp, Petromyzon marinus
  source 1..98: mol_type = unassigned DNA
atattggtcgcgaaagcctacgtgttaaactgactaacctctatggggaggatacttttcttaaaaccagaaaattggagaagcttcgcattaagcgg

SEQ ID NO: 1838 - DNA, 1143 bp, Petromyzon marinus
  source 1..1143: mol_type = unassigned DNA
agatggcgccgatgatggcagcctcggccggttggtgcgccctgttttgtccagttttgtcgttttgtcttgagaggggcctgctgttcaacacactcgtgctggtgagagaggcctgctgttcatcacacccgtgctggtgagagaggcctgctgttgaggggcctgctgttcatcacacccgtgctggtgagagaggcctgctgttcagcacacccgtgttgaggggcctgctgttcagcacacccgtgctggtgagagaggcctgctgttcaacacacccgtgctggtgagaggggcctgctgttcagcacacccgtgctggtgagaggggcctgctgttcagcacacccgtgctggtgagagaggcctgctgttcagcacacccgtgttgaggggcctgctgttcagcacacccgtgctggtgagaggggcctgctgttcatcacacccgtgttggtgagaggggcctgctgttcagcacacccgtgctggtgagagaggcctgctgttcagcacacccgtgttgaggggcctgctgttcagcacacccgtgctggtgagaggggcctgctgttgaggggcctgctgttcagcacacccgtgctggtgagagaggcctgctgttcagcacacccgtgttggtgagaggggcctgctgttcagcacacccgtgctggtgagaggggcctgctgttcaacacacccgtgctggtgagaggggcctgctgttcagcacacccgtgctggtgagaggggcctgctgttcaacacacccgtgctggtgagaggggcctgctgttcaacacacccgtgctggtgagaggggcctgctgttcaacacacccgtgctggtgagaggggcctgctgttcatcacacccgtgctggtgagagaggcctactgttcatcacacccgtgctggtgagaggggcgtgctgttcatcacacccgtgttggtgagaggggcctgctgttcatcactcccatgctggtgagagaggcctactgttcatcacacccgtgttggtgagaggggcctgctgttcaccactacccatgctggtgagaggggcctactgttcaacacaccagtgctggtgagagagtcctgctgttcagcacacccgtgctggtgcgaag

SEQ ID NO: 1839 - DNA, 226 bp, Procavia capensis
  source 1..226: mol_type = unassigned DNA
ggtaagcagggtaacaccatcaggtaaggagggagtgagcagcccccacttgtctgtcagtggaggcttgcttgttgctgtgatgcaggaagctatgccactggtatttaggtaccagcagggtcaaccatggtagacaagtttcagctgagcttccagactaagacagactaggaagaaggacccagcagtctacttctgaaaggaattagccagggaaaacctt

SEQ ID NO: 1840 - DNA, 975 bp, Salmo salar
  source 1..975: mol_type = unassigned DNA
tccaagatggcgtagcagtcagacgtctttgtcctcctcttgtcgtgtcccgtgtatatatttttatatcttttttcttcgcatatctttttaatatttttcttaacctcaacttcaaaacactctcctgcaacccgcctcacccaatgtggaatagatatgctattttatttacctcgaactggaatccacaacagaagctagccagctaactagctactagctagtagtcagctagccacggttagcggtcatcagctatcctttagctcgaaaagctatcgccagtttgtacagcgcgactcagaccagagcataccggacctatttttctccatatccccggatttctaccgcaagctctggacatttacacctggatcattgcagctagctagctgcatccgagtgactactattggctaacgtttcggtcccgaagcaagcaccaattatcctggagctagcccatgctaggcccatctcccggctagctgaagagttccatcagccactccttgggctacaatacctattttgccaactgacctggacccgttttactgccgtgcggagccccaccgagccttcacgactggactaccgacgttatctgcccgagggagttatccaactggcccctccgtcgcgacgtaacctgaacgcccatctgctggcctgctaaccgcggatcgttagctgtctagagcatatcggactgctatctgaataggtctatcggacaatttcttgggccactatacctattttgccaattggactggtcccctctaccacacggaaccctactaatccatcacgactggtctaccgacggaaacgcacgaggtggctaaaacagacttcttccgtcgcgacgtccctctaaggcccttctgccagcttgctacctatggcccgctagctgtctgaatcgccgtgtccccagccagcccaactactcactggacccct

SEQ ID NO: 1841 - DNA, 18 bp, Salmo salar
  source 1..18: mol_type = unassigned DNA
cttccggcgccgacagag

SEQ ID NO: 1842 - DNA, 334 bp, Salmo salar
  source 1..334: mol_type = unassigned DNA
ctatcagttagcatgtggaacattcagggcctaaactcatcaacctttggactgaagagtttagcactggagttcaacaaaaatcttaaagatgttgacgtcatcattctgcaggagacatggtgtaaggctgacattgtcactcactgtcccacaggctacagagaggtcattgtgccatcacagaaacacagctctgtcaatagaggcagagactctggaggattgatcatttggtacaaatccgaactacaaaatctaattgatcccctcaaaattggcaaatatcacatttggttaaaactgaaaaaagaacttgtactgacagaaaaag

SEQ ID NO: 1843 - DNA, 1074 bp, Salmo salar
  source 1..1074: mol_type = unassigned DNA
ccaagatggcgtagcagtcagacgtctttgtcctgtcgtgtcccgtgtatatatatttttacatctttttcttcgcatatctttttaaaatattttcctaaaactcaacttcaaaacactctcctgcaacccgcctcacccaatgtggcgtggatctttttttttactaaagtatttctatttacctcagatctggaatcccacaacagaagctagccagctaactagctactagctatcagtcagctaaccacggctagcggtcatcagctaacctttagctcggaaagctatcgccagtttgtacaacgcgactcagaccagagcataccggacctattattatttttattctttttctctccatatccccggatttctaccgcaagctctggacattttcacctggatcttcgcagctagctagctgctatcccgagtgactactcctggctaacgtttccgtcccggagcaagcaccaattagcctgaagctagcccggccagggctcctgagctaccaccgaagcccactcctgggctacaatatccggaccccttttactgccggtacggggcacggagccccgccgatcctccacgactggactaccgacgttatctgcccgaggattccaactggcccctccgtcgcgacgtaacctgaacgcccattctgctaaccgcggcctactagctatctagagctacttggaaccctactaattccacgactggtctatcgacgtcaccgcacgaagaggcaaaaacagacttacccccatcgcgacgtcccccaaaggctaacttgcttgccccggtctgttaactgctagcttgcttgccccggtctgctaactgctagcttgcctgccccggtctactaactgctagccccggtctgccaactgcttgcttgctaacccggtctgctaactgctagcttgccagccccggtctgctaactgctagcttgtttagccccggcctactaactgctagcttgctagcatcggcctgctagctgtctgaatcgccgtgtccccagccagcccaaccactcactggacccat

SEQ ID NO: 1844 - DNA, 413 bp, Salmo salar
  source 1..413: mol_type = unassigned DNA
gttccggaactccaatttgagcagcagcagctgaaaaatgagctcctacaaatattgaaatttacatggtttttagagtgaagtacatcggaaaaaagcaaaagaaaactgcaagactgaataggagaaaaaacaagcaacaaacaaagaagataggcttttgaaaaataactatttttcataaaattgtagttatcttagctagctgaattgtttaccagttgctaagcagttgctagggactcttttggaagaagctagctagctaacgaagaacaacaaagaatatctagttaacagaagaaaagaaagagaaaatcaggacagaagaaaaaggatatcaaagtgaaacagttctctaaagacacaggagacaataatacaagaaacaacacttctgtagcttgtcaact

SEQ ID NO: 1845 - DNA, 692 bp, Schistosoma mansoni
  source 1..692: mol_type = unassigned DNA
cccaaatgccctggtacggccgagagtggggagagtccactctccctctcgaaatgctctcacatggccacgcgtatatagcctctgccagggaagtcctactcactgccttctcgtggcgggggtgttgtttacgaaagtgagaggacgaaaagcgaatgtccggcgctttaaccgggttggtggacacggagggtccacctaggggagttggaaaaccctgattccaaaccaatggtgcacatgggctccagtatcctgatggaacgaatggcgaatgaacctgtcattggtcaccggctaccatgggactgcatctcctcacgatgctccactgccttgtggatcagacctttaggtcaaaggctcggggtgtggccccctaagaaaaccacctgcttcggtttgggcacccgggcagtatcacagcccacacacaaataaatgaaatgatgaattctattgacgatactattctcgctcatactagaagcaagacaatttacattattattattattattaccattattattattattattattattactattatttactacgtcgctaattcaccccctttatccccaatttgtgtaaccttacttttcaacttatgcagcagctcgcccatggtggaaaatctgtcctatctaaacgatctccagtcactgtctggttgaaagtga

SEQ ID NO: 1846 - DNA, 1814 bp, Strongylocentrotus purpuratus
  source 1..1814: mol_type = unassigned DNA
caatcccttgatatgtgtattgtggaaaagaactgttgtgagaacttttgtttttgcattaacgaattctccaaacgtcgaaaattcaggaatgtaaagtgaagaaaaaaaattccccgccatatcgtacttggaggtatagattttaagactcaagaatgtaagccttgtgacattccatgagatgtaatctggttggaagtaccatgcaatttaaagcaccagtcaaaactcatgaatgtaaagagaaaatagtacccgccaatttgtactaatataggcataggtttgccttattgcattccatgagatgtctagcttgttacttaatctttaaaatgtgtcattagaggaatgtgaacactgtacaacgcaaattatagaacgggttccttttaaagatatttacaaatggagagggggagtggtttggtgtgcatgtgtgtgtgtgtgtgtaacttacatacatacatgtacatcgcatttctctttccttttccatttggtgagcaaagtaatccaactaatcaatagccatgaacacgtgagaggcttcctcagctatgattggtccgcgagagctggagggcgaaagtgtttcttttgttcttttcgtcaccggcttctcgtggtcaccaacgccggacatgctgattggctgaatggtctttgcggcagcaggagggcgggacgtgttttgagacaagtctcgtctccagctggtcctagacatttcagttgatcgagataaatggcatctgaaatatacaacataattgtcgatttgtttctgctctccccccccccccctttaatagtaaatatccatgtaatcttacaatcttagcaggaggattaacgttagtgccttgtgaagcaagcataattagatctcgtcaccggctgcttgtggtcactgtctatgacggcaggtgggcgggacgttgttcttttatttagaaaagtctcgtccccagccagttttagacaccagcgaggtctttaaatcaactataaattttatatctagactctgttttgagagaaattaaaaggggaaaataaataatgcccttttacggttaccttaagccggtcgttaacagtgaaaaaaagaaagaaaaaaagaagaggaatagttcaaaagttaattaattcgttttcttaaaataaaaataaaataaaagatgggaggggaagaaactccttatatactgtaaagtttataatggtatcaaaagccatttggtggggtacaagctgttgaagcttaaagtatgcacggggtttatttattacgttcgtttattacgttttttttcttttaaaatattatatatagccgtttgagcctggggctaaagtatcattagttacacattatctgaatccgttaattatgaggtcaagttatatcgtctggagttatgataaattgctctgttttattttcggtgttggtttttttttttttttttttttgtcacagtaagaagactgtattaatactttgtgtaaaaggctgccacgccatgatttagaataagtgatgggaggggtttcgaacatgccagcatatattatgcttatgtgtatgaatgtggttgatagtgttgaagggtggggtgatggtatgtgtggtatgttttccggttccgatgtctgcctgtacttgtttaatttgcaatctaacttgaaagcgtttgtttttcctagagttggaaatgcatcaagcttcccatctactgtgaaactgtcaccactatgtacatttctaaaggttctttgttacaggtatagattcatagttcttg

SEQ ID NO: 1847 - DNA, 374 bp, Daucus carota
  source 1..374: mol_type = unassigned DNA
catgaggtgatagtcatgaatccaaatataatagataaataagatatttttttaaggtgcagttctgctccctaactaatagtagaaataaagtaatggttataagggttctctaaaacatgacccaagttaataaatgtctctaaccaaaaaatgtctacatttttaatgtgttttttatacgcaataaattataactaattgaacatcactaaaattatagacacaattgggataaaaagttaggcacatttgaaaactttacaaatataaggacaaatccgacagtggcttaaaaatccaaatttggaccaattctagcctaaatcttctcaacgggggcctgaattacggtccaaatttaggccacttag

SEQ ID NO: 1848 - DNA, 1495 bp, Lottia gigantea
  source 1..1495: mol_type = unassigned DNA
tacgatatatagacacagctttatggaacaacaatcactggttaaagttttatgcaacgtttcgacgtgtttcccccgtcgtcctcaggcacataatgagaagaagtgatgggcaaactatatatacattaatgcttattattaagaacacacaagagataaatggtttattgatacattacattaaattttaacaggtacaataagaggtatataattcttaaaataacatacaggctgattaagtaaaataattgaaataaagtaaatgaattaaaaaagattaattgaagattaaataaacaactattgctggtattggagtcttttattaatagaaattacattgttcatataactaactatgcttaaagttggaaattgtttattaaatacatttatgaatatgatgataagtttatcatatgcatgcgataaacgaacaccttcatctctgttaaggtcaggctgatatcttctgatgtggatagcttcatgaagtctcctggttttatctatgtgcttattgattgtcagtatgttggtgttgtcaaagttgactttatgtcctgttttccttcccatagcaagatgttcagccacagcagatgttccttcattgccgggcttgtcttgatggtctttgagtcgaacatcaaggggtctctttgtttcccctatataagaacttccacaggagcactcaacttggtagacacatcccttaggtttttggttgttggagggattcaatttaccactggctctgagcaaatctttaagcgttgagttgccagagaacactgtttcaatgccgactgactttttcaggatcttcttgatttggtatgatgcctttccgatgaatgggatagctaagcgggttgatggtctgttgggattaggctgttggttggttggttttgccattaatacggatcgaaaagcttgatgtacaaaggctggagggtagttgttgtgcaagcaaaatactttcttgatgtgttgtaattcttgttgaaagtattctgggtcacaaatcctttttgctcttctgaccagcgctgtgatggctgcccttttgacatgttgaggggtgttggaatggtagttcacatactgatctgtatgtgtaggtttcctatacacgcatgtcttcaactgaccgcctaaccgcttaattctcacatccagaaagggtatagagtcatcttcttctgcttccatggtgaaattgatcctcttatgctgagcattaagatgctgaagtagagctgatgggtcatcttcagctctaagcatgacaaaggtgtcatcaactttccggaaccagcagattggtgagatcggagaggtttccatggtcttttcctcaaaggctgtcatatagatttcagtaatcaatggtgacaaggggcttcccataggtagaccgtggatttgttcatagatctcatctccccatgtgaagtaggtagaggacatacacatctga

SEQ ID NO: 1849 - DNA, 791 bp, Strongylocentrotus purpuratus
  source 1..791: mol_type = unassigned DNA
tccgtttctgcttaataaatgtgttaatatatttccagagttttgtctggggctgtcgtattatcaagcaatatgcttacaacgacagcccttcttccacatataattttataatgtgtcataatgtttgataatccatgaatgcagaagaaatcaaatcaaaatcaaatcaaaattcatgtatattgcatactttaacttctggccaatcagcgtagttggccttttattgtcaacgataacatcatccctggactacatttggcggcagatggcgtgcatcttaacaaccatggaatacgcgtaatggcgcgaaacctcatcactcgtctccgagatcagtcaagcgtcactagaagtagcccgccgtctgacccactgcccaatcagcgcccgcgatctccgaatacaatgaggaccgatccattctcgaatcggcaagactccgaaagctcctcgcacgccatggctgctgagaatgataactcagcttttcggagacgccaacatcgcaaattccgcaaaaagccgaaggggagagttttcccccgagactggctcgactgtctccagacggcccgcacgctcctgaatcgtcaagctcagcaatagatgatagcgataatttaagtcttcacgcggaggatcttaatgtaaacgctacaaatgtaataaacatcaatgagaaacaaacgcaaattgaaaaaactacagcttccaaggatgaaagtgaactaaatgaaggacacaatgtgacaaatacacaaggatattatgaacttgttgatggc

SEQ ID NO: 1850 - protein, 30 aa, Spumavirus sp.
PKDLKQLQSILGLLNFARNFIPNYSELVKP

SEQ ID NO: 1851 - DNA, 57 bp, Hydra vulgaris
  source 1..57: mol_type = unassigned DNA
atggcggcgtaaagatggcagcctagttgagcacgtgttttgaaataatttttaata

SEQ ID NO: 1852 - DNA, 199 bp, Strongylocentrotus purpuratus
  source 1..199: mol_type = unassigned DNA
tattgtgaatgaatttaatgacttttttgtaaatattggaccgaatttagcagatgaattgccgaatacagatgtagcatatggtgattttttggggcagaatatagagcaatctttattttggaaaccaataactgcagttgaagttaagagtcaagttctgctacttgataccaaaaaggcttgtggtcacgataac

SEQ ID NO: 1853 - DNA, 109 bp, Strongylocentrotus purpuratus
  source 1..109: mol_type = unassigned DNA
tccatttaagttcttctttacattttgtacatagttgttgttgttgtttgctttttactactttgttttaagtgtagaattcatattcctttgcttttttggttttcaa

SEQ ID NO: 1854 - DNA, 910 bp, Schmidtea mediterranea
  source 1..910: mol_type = unassigned DNA
cctttttacggtataattataaacatttatcataacatactttctgtatcaactatatatatgagtataaatctggatcttctgagaaggactcatatatataagataatctataaaactggaaggtaatgacgatgattcagaggtccagtgactattcctcgagagaggaactagttacgcagttctgaatcggcaatcactaactcaacaggctgatgtcaggatatggaaaggggtctaatagtggtcttaaaactctcttttgaaagtgacttcttattggacacctttttattgtataattataaacattaattataaatcatatcatactttctgtatcaactatatatatgagtataaatctggatcttctgagaaggactcatatatataggataatctataaatctggcaggtagtgacgatgattcaaaggtccagtgactattcctcgagagaggaactagttacgcagtgctgaatcggaaatcactaactcaacagtctgatgtcaggatatagaaaggggtctaatagtagtcttaaacctctcttttgagagtgacttcttattagacacctttttattgtataattataaccatttatcatatcatactttctgtatcaactatatatatgagtataaatctggatcttctgagaaggactcatatatataggataatctataaaactggcaggtagtgacgatgattcaaaggtccagtgattattcctcgagagaggaactagttacgcagtgctgaatcggcaatcactaactcaacagtctgatgtcaggatatggaaaggggtttaatagtggtcttaaaactctcttttgagagtgacttcttattaaacacctttttaatgtataattataattaaatataagcag

SEQ ID NO: 1855 - DNA, 499 bp, Strongylocentrotus purpuratus
  source 1..499: mol_type = unassigned DNA
aggctctgtataagcttggcttgttagagctcttgtgagttgtgtgccgcggggtttcatatccttaaactgctggcgaacagagcaacaagaccaagctctgtaattgttaggtttctccaatggtaggtttgtccaataatgccgagtttgtgccacggaacctagtcggacatttcgattatattctttttatgtcatacgtctttatcttttttttttttaaatattttttatagtttagtctaccttgctgatacctcctcaaaatatatacgatagactatcattaattctgctgcattaccatatagcttacttagaggttactgcagatcaatcacctgtactgtatctagagtatagttaagtgtaggagaacagtaaaaacagtggggccattgaaggagcgttcacgtcgcggtccgtcagatgaaaatctgcgaatccttcaaccacactactcaagtttcttttagtaactaccacaaccaacacc

SEQ ID NO: 1856 - DNA, 297 bp, Drosophila persimilis
  source 1..297: mol_type = unassigned DNA
actctgatatcgactcagaaatagacagtaaacaccctatcaaattcccataaaaacagcacaacctctaacattgtaaaaattctaccactaactacctctaagcgcagactagcagcaattaaggctgcggacaaattaaaaagctcaagcagcaaaaaaacaagacagaagaaccccaatactgacgccttgagtagcaacaactgctcaatggaaatagaatccgactaaaactaacagatcaagtaaaaacaacccaaataaccagcactcaagagataaaaactcaaaaaa

SEQ ID NO: 1857 - DNA, 1128 bp, Drosophila sp.
  source 1..1128: mol_type = unassigned DNA
tggctggcaaaaatcctccagctgaaccctccacgagggagccggctaggcaatgggcactgtattaccgcgtacaatggtaatgcagtggcgcatgctctgtccggggtaatgcagtgtctagctaaggcttcgattcaatttctcccgcctaaacgccatggttggaggtgcctggcggcaggcataaaacgcaagtgggtggttccccggaaataaaccaatttttcacaggatggagacaggagaggcaaccggggctgggatgtcagcccaaacgtcggtggaaggcgtgactgctaccaccggcgggcacgaaggggagcaatcctctctgcgtgtcaccagcggtcacacctctgatttgacgggagcaggtcaagtcagttgtagcgctaatgccaaataacgacgaaaagaaggctaagccgcacgggtgccgttgtctatacagactcggacctggagagcgtgcagctttcgaaagaagaggaagaaagccttcttcgctcgccagaaccaggcaccagctccccgcgaatagacgggccgaagcgttcaagcgaggggaagaaggctaaggcgtagtataaagctgccctccgaatccagagccggctccggacaaaagctgccctaaccgaagaggagaacgtaaaggtcaactgacaggatcgatgagagcaggctgcacttcgccaagcttcctagcttggcatcaacggccgggttcgccaacaaagtgtaggtgatgcttgccaccaagcggcaacgctcggccgagagtgccataaaggacattccggcgagcaagcggggactcgtgcgcaaggaagcaggccccccctggaaggcgaaaaccaaatccagattaacaagaaggcagaggacatcctgtatcccagacacgggaagatggcatgggtagcgtctacctgcgcctcaaaaagcgccatcctggggataaggatgaccacaccctgaaggcaggcgagatggaaaaggacctaggtctggaaaccatttttgacgccgcccaggaactaacgctggatgagtccgaagaggaggaagacggtgacctgacgatagtagtcaacccgtcgagtggagttgagcccagtaccc

SEQ ID NO: 1858 - DNA, 114 bp, Acropora digitifera
  source 1..114: mol_type = unassigned DNA
tttcatctctcccaccgacgcagcaccacagtttctttagaaactagaaattcatttactacttaaccgctgcgacctcattcattcctcgctaccgcgacgctgaaactcacg

SEQ ID NO: 1859 - DNA, 372 bp, Acropora digitifera
  source 1..372: mol_type = unassigned DNA
  misc_difference 86: note = a, c, t, g, unknown or other
gcctcttcgcttgaatctctgctggcccacagacgtgcaaaaaaagccgctcgttcccgcggtattattaaccacaatctcaccgncgataacctcaatcaacacatcaataacactaatgccagtactaatgacatactatctaatgttacacataacgcctctacctcaactgtcacacgcaaacgctctcgccgcgaaaccaaacatgccaacattcatttggatcattcttctgttatcaacctatccagttgctctttatctaccgacgagatatctatcctttcacgtggactcactttctgccctactccacgacatatcaactggccggaagtttcagccgacatttacgacttttctcggcgc

SEQ ID NO: 1860 - DNA, 3199 bp, Aedes aegypti
  source 1..3199: mol_type = unassigned DNA
cagttgacagccgaccgccgtcgcgtacagtcgcctttcgcattgttccgtactgttaatatcaattaacagcgcatcagccaactcgatcgttgtctgacggggtgctccacagcggggcgagtgtgcattgttttattccggatcagtgcagcacccagtggtgtggtgagaagtgaggttaaatagactcggtagcgtggttcgagtactgtataktattatttcgggcgcgagtgtatgtgttagtaacttgtgagtggtataaataaaattatcttcaaattaaaaagcggttcagtggttttcaactgtagtgtgactgaccaaccaaaacaggtgagtcttccacgagtgcctccttccggcccgccggcgccatgctggcgaacggccatcccctccacccaggggacccagggggccccggaggaggatttggcaaagtaggcaacagagttctcggcgactacaccggtgcattgctaccggagtttatggaccgtgaaggtactgcaggacaactgcagtatctaagaatggaagcgactgctggaaccatgccccaggatccgtttcttcttcggctatccgtcgaaaaggccattggaggtcccattttcggggccttcaaggaaaataaaggcatgtcctacgtgttgaaggtgcgcagtcaagaccaggtmaataagctcctccgcatgagccaactgcaagataamaccccaatccggatcgctgagcacccgcggctmaatcaaagggaatgtgtggtgaccaaccatgacacaatcggactatcggatgactacctgcttcaacagctctcctcccagggaatcaagggmstgcgaaggatcacgcgacgcggaccggcatggccaaagccgtggtaaacaccgccaccatcgtactcaccatcaagggcaccgttattccggagcatgtcgttttcggttggtcacggtgcaagacgacgtcttttctacccatctcccatgctatgcttccgctgctgggagtatgggcataccggtaagcgttgcacaagcccccagcagcatctgcggacgctgctgcgaggtacacccggaagaacaaacccccgatcctacaaacacccaggaaggagccgccagtgcccacgttgcgtcgaaaacgcggtaccagtgcaccgcagagccgttgctgcaagaccagtgcaaaacaggagacagcactcagtctcaagccgcaagtgtccggtgtacwwgaaggaacaggccatacaacaccttcgcgtcgacgtggacattccgtatccgcaggctcgacgtgaatacgaagcccaacaagcgagcaagtcgaagtggtgccaacttctgccggtgtggtcagtgccagcaaggacgctgaaatcgacagtctgaaggccatggtggctgcaaaactccgcggacggagaagaaaagaggatggctgaaatggaacgggctctgcagagccgcaccgtcagcgaccgcctcgaggcggttaaagaacacggcaccatcggagagctggtcaagcaagtggcaaccctaactgaaacggttcagaacctccaaaatgctctagcagtaaggacaaacaaatcccggatcaaagtcgcaccatcgctgagcttctaggcaggcaatcagctgccgtccaacgacaaacccgcgacaagctttggcttaccgcgcaagasgatcaaacgcaaaccgccccaagtcgccagaggttcccgtcatgaaaccgcccagtctgaaccccaaagtggacgtacaggtgtccaaatggatttcaaatataacaccggacctcaagaaactctcacaggcgatgaaaccaacgatggaaatgcgtctgatcatagcatgatgtcagccacatccgaagccactggaatctccaacacgtctcacgtttcgaaccctacgaaaagaatgcactcaacctcggatcacagttgcccatccggcgattcaaatgcctcatccaccaactcgaagcggaaaaacaagcaccgcaaaagaggtggtagaaccaaacagtaaaacagtaatttacgctcagtcctcttcaagcacatggtctaaacaattcgacaatattttcttcccgtcatcttcactccgcaaattagcgttgagacagtcaaatcacaagagtcgactgagcaaataccgatgaacacactacagcctccgaacgaagtactcacggacaactcagcgacaacaggggtcacggacagccggggccccgtcagtgcggacgctacaccccaaccggaactggcggacaacccccggcatccgggcgtaactgttgttatcgggacgcaaaagggacacagtgcctatcccccgaaagtcccaactagctgtatgggtacgccagggccccgtcggtgcggaagttttggaagaaccggaaccggcggacaacctctggcgcccatatacggtctggaagagggacgcaaaagggatcaacatcctattcccctkaggacagcgtgggaagcaagccacaggaaaccttttttctgcccctgccaacacacagagggtgaaggtcgggacgcccaataccccgaaggacaacgagggaagcaagcctccgtcgagtcgaaacccccccggaasagaaaaccgccggaccactacacctccaactggcacaaccaccccggtcagcgacaagctgaatcccccgacttcccgggcagccttgggacccggaagcaagcgacgccaggttgtatgacctgttacacaacgctcgttacaatcgctcagcccgccgacttcagcccgggtattccggaaccgtttccagacttcaactccaaacgcggaagcatacgaaaaccgatcgccatccgcgataatkatagctcaacccgctgctggcccctcaagccaaacagcctccccagatccctatcaggatcgccctgggcacctcggactcaacaatccgagcggtaaggccgaccctttcccgctgggcctccacccggtgaatcttcgtccgccacaacaacctatgtcaacccatttttcgacgcggctcccagtcttcttcgctctcaaactcacagcagcactccttgataaggtttcctagcagccctgttggaaacgactgtcttgccgcagctcccgaagttccggcagtagtaggtccc

SEQ ID NO: 1861 - DNA, 482 bp, Aedes aegypti
  source 1..482: mol_type = unassigned DNA
gggctgcaaaatggtgagtcgacggagtcctcacaagttcctacctcatgcttccacgggtcgacggatgacaaatgaccgccagctaagagttgcgtgcttagctggtagtgcagcctgggtcctgtagtccttctgacttcagctagattgaggaggtacgtccaccgagcgtctgttcaccaaggaggtgcggctcaaacagcgtctgtctggcatccagcggctgaataagaaatgctcttccccggaagctacacctaagatggcagccccatcacggcggatagggaaccttaggctaacaacctactgtccccgaaacatcaaaaaatgttcaagaaaccgatagagaaagattacgaactgatttaacggcaacgacttttagcgcgaaacaacggacacgaattggaacatggaacgtactaaccctagcccagcagggtaaactggcacaactcgccaacgaggcgtgtcgc

SEQ ID NO: 1862 - DNA, 332 bp, Aedes aegypti
  source 1..332: mol_type = unassigned DNA
agttagggatttgtataattattattatcccccttttcaatttttgaccaagacatgacaggtatactcctgtcgaaattttttcctaggtagtttgattgtgtaggtacttatctggtgttagtatttaaggtagagagatgcgacgatttcttcagtggatacgagtaactgacactgaagaagactgcaagtggtagtcgaaatacgcgtatctgtcaaagataagcatttaggagcggaattaaaaggtacacggtactccatctactttaaagtttctctatttgagattctgctcagaggattcgaacattcattaaagagttgta

SEQ ID NO: 1863 - DNA, 467 bp, Aedes aegypti
  source 1..467: mol_type = unassigned DNA
atgaactgttccactcctaaaagttatattgggaagctactgtttccccttctgctgctgttgttgctgtgtgctgttgatgctactgctgttgctgctgggaggcgttgctgtcgaataagatttttctgctgctctcgattgtggtgaattagatcaaattagactttttcgttttcggcatattagcagacattatttagctgttttttctttgtaatgtgcttttctctaatgtcaaatgaacttcagactaaaagttaatcacaatgaacatattagtagttagtagttttgcttttcctgatttctacactgcatgttgcttgggttcgatgggtagactgcttttgaagcctatactgttcaacatttagatatggatgacttttcccttgataatgcttctccgaacaatgtaattccacgtgttgttcttaatgctgcattaaaacatgactgtttga

SEQ ID NO: 1864 - DNA, 103 bp, Aedes aegypti
  source 1..103: mol_type = unassigned DNA
ctcccagcctgcacttccaggcaagtatgcgtgttataccagacgttctttscgtgatgaattgccaaatttcagctctctatccgccgctgatgtaacatca

SEQ ID NO: 1865 - DNA, 1656 bp, Aedes aegypti
  source 1..1656: mol_type = unassigned DNA
  misc_difference 321: note = a, c, t, g, unknown or other
aattctggcaccactgcgtgttttcgtttgtgttgtttataacgtcgccctaaaatcctgtgaatattcgtgcaatcaactctataaatcagggtttattgctaaactgcctcgttccgcttctgttagccgcaagcatcaggttttcgcatcacttttggcaaggtaggacagtgatttgtgatctaaatccgagcaggctagagagtggaagcatccgccatcgcccgataacatatttcccacctcgccgctctccaccttccaaccgatcgaaagctgcaacaagatcaaaaatcaacccgcccccatttgccccancgccccaccaacgccctactaytgtttgctgcaccgaacgaaatcaaaacaagaaatcgtcctgtaatactccgcttcatattggaaataaactacttacgctgcctcgtctttcattccaacgctccgaaagggaccaacgaacgatcatcatacagcctcaatcgccgtccaaagccaacccgttgctaccaaggattaatcgccaaactctgcatccgtagtatcatccattcacgtaaggaaattctgttttggttctgcactttgtttatgtattgaactgtgaagctcaccgttgacaagccaccgtttgtgacagagaacacacgcgcagctcgtggtcattccgagaatcaatagttcacagtatatcaccccttcgtaactgggagcttgtttctcgcagctaaaatgcagggtgtttgtgaaaaatgcgcttccgaactatccgctgatttttggagctgtggtggattttgttctggtcgcttttgcttcaggtgtaccggaatgagtcctgatatccaagctgccgttgcgaataacgggtgccttcactggatgtgtaacgcctgtagcggaataatgattaaagctcgctttactaaggcaatcacatcagtgaatgctgcctatgaaggcataatcgaatcaatgaaaatccgaaattcgagacaacattttgtccgaaatccgctcggaattgcagaataaccttaaacgaattccggagattgttgcaaacacaccgattcgaaatattcaacgtcgcacatttgattcggctgtccgtaatcctgcaaaacgtcttcgtgcaaatgatgatgtgcctctcgacccgcctaaaaaactggtctgtggcactgatggccacagtactagttcttcagacgtcatcgcagttcctgaacgaacggatgaaaacacgttttggctttacttatcaggagtgtccccgaaagcgcctgatgagaaggttatcgaaatggtcaagaataggctcgmaacagacgacttaactgtcgttaaacttgttcctcgtggaaaggatacaaacaatctcacgtttgtatccttcaaaataggaatgaagcttgatcttagggcaaaagcaatgacttcatcaacctggccagttggaattcgttttcgcgaattcgagaaccacagttcctcaagggcggggttctggaatccctcggagaaccagcccgaaccacagatcgtaacagtattgaactagtatccccatcgtgtcccatagatcttcattctcctcgtgatgagaccgttttaagccatttgacaatctactaccaaaacgtgcggggt

SEQ ID NO: 1866 - DNA, 82 bp, Alligator mississippiensis
  source 1..82: mol_type = unassigned DNA
tcagaacaagacacatgctcgggtgggatgggcttcacctctcccccaaaggtaagcatgtgttctctttcaggttggctga

SEQ ID NO: 1867 - DNA, 200 bp, unidentified
  source 1..200: mol_type = unassigned DNA; note = Description of Unknown:Amborella trichopoda sequence
taattagtgcttatgcaccacaagtaggattagatgatagaattaagagacaattttgggaggacatagatggaatagtccaagacataccaaatggagagaggacctttttaggaggggacttaaatggtcatgtagggaaggatagtagaggatatgaaggggtacatgggggatatgggtttggggaaagaaatgag

SEQ ID NO: 1868 - DNA, 399 bp, Anguilla japonica
  source 1..399: mol_type = unassigned DNA
cagtgtgcatctgattgtgtcgtcgcttctgccgtcccccgcgattcagataagcgtatcttaacttgatttgtctctgctgttgctagttagagaacatagttgtgcgtaatttagataatcttttttaaacgtgtctttactgttgctagtcagcgaacttagttgtgcgttagctgagaatctctgtagttgactcactgttgttagttagttaaacgcgttagtgaaactgtgtgtgggggttggtgtttaactgcccggtattgttgagctaatttcaagtagcttcacctggtgcttatctgccttaatgaaggtgatgcaagcacgtaattgtcacccggtatttatagctccagcggaggctgccataggcagcctcgtcgtcagtttgtg

SEQ ID NO: 1869 - DNA, 108 bp, Anolis carolinensis
  source 1..108: mol_type = unassigned DNA
atgmtgttgagagctgtgctggcggtagtgtaaactaccagcaggttcaaccaagccagagtggtctcaactgagaagtagaactaagtgcacccaacccatttaaat

SEQ ID NO: 1870 - DNA, 165 bp, Anolis carolinensis
  source 1..165: mol_type = unassigned DNA
atgcattacagaaacctggatacgagaaggagataatattcccttgcatgaactaacaccgtcaggtttccagatgtttcaaagatctcgaaaggggggtcgaggggggtgggaatagtggctcgcgatcatttctccattagaactattcctacccctgatatt

SEQ ID NO: 1871 - DNA, 159 bp, Anolis carolinensis
  source 1..159: mol_type = unassigned DNA
gggggacatgagagaagcctccacgcaggatcgtgacacatccgggcgtcccctgggcaacgtctttgtagacggcagattctctcacaaccagaagcgacgtgcaacttgcaacatgcaagcaaacaaaccaaccaacggaccttttcaggaccaact

SEQ ID NO: 1872 - DNA, 229 bp, Anopheles gambiae
  source 1..229: mol_type = unassigned DNA
ttgacagttgacagctgacgacwgagtgtgttttctcactgtgctccgcgtaaatccgtgaattattttgtcgtttcggcctwattttcgtcaaactgccgcttagctgtgacttaagctgtccctggtagtcctgccttcaatcgttcgtcacaaccattcctgactttgctgtatttcctgcgtttgttcctgagtcctgtggcatctatctgcaacggcaactaaa

SEQ ID NO: 1873 - DNA, 128 bp, Anopheles gambiae
  source 1..128: mol_type = unassigned DNA
tatatatcttcaatcgaaaggcatccccgaaaattttggcgcttcatggacagcagacgacgctccaagcacaatcatgggcacgtcacccgaagatatttgcaacattttcgctgaacgattttccg

SEQ ID NO: 1874 - DNA, 243 bp, Aplysia californica
  source 1..243: mol_type = unassigned DNA
ttagccgtgcagtctcggcattgagaagaataggactgacgtggtgctagcgtgtcgtacgaggcgactaaatggcgaaccaggtagtgactcctgaaacagagtcatcctgcctccaggtcgggggttgagtcacgaggctaacaacctctctcgtaaaaagaacctgttacagaaacacatacaagcaaaaaccattatctctgcttggctgatcgtggatcttctccaaatggagagttt

SEQ ID NO: 1875 - DNA, 662 bp, Aplysia californica
  source 1..662: mol_type = unassigned DNA
aattgaacaaattatggaggaactgggagtgactcgcaaaccctttgatatcaggagattatttggtaggaacagaacagaggatagcagagacagcggtaatgaccggggaagcgagaaaaggccaagacctacactactgaaatttgaaactgaagaagcaagtgctaatacgatgaggaaatttattgaggcaagaaaagacgcagcaaaggacaaaaatgaaggagaagaggacaagttatacttgactattgggatgcgaagagatatkacaaagcaggagagagaggaggactatgccctctaccaggagttgaaggctaagaaagagaggtaaaaaaacttgggggacaatttcgctcactgggtgaggagagacggcaaaattcggaacattgggaaatacccaacggaacgtcagaaagagagggagacaatacaagaataaagccaaagacagcaaagaatgtaaatagttttggccattgttcgcctttttcatattttaattattgctcatctcgttcctgacgtwcagaatagaagtttcacttcattttcttctttttcacctacatttcattccaatcggaatgcacatactttagagaattgtacttgcttgtatacaaatgcagatcaattgttgaacaaaagaa

SEQ ID NO: 1876 - DNA, 433 bp, Aplysia californica
  source 1..433: mol_type = unassigned DNA
  misc_difference 233: note = a, c, t, g, unknown or other
tcaagcgacaatccgtgaggctaacgctgacacacaggcggagacacaggcagagacacacaccctgcgtgccgtaaggcaaacaaatatggactcttttttcccgcagcctgaccgctcccgccccccagtacgctcaccccgaagccaggacacaaggtctccaagtgtcaagacgaggagacataaaagacaggtgagcgacgagccagctcggtcaccgagcgtgaaanctcgaaaacaggaggtgagtggcacgagaagaaggcaagacacggtagattattttgattatgaggagccagtgactaccgaaacgtgtgagcacgaagaggtcggtgcgtgagtggtgtgtacacgtttcggtagccattggtaacgacttggactggtaaaaggactttgagtttggttttgcgtctgactgttttgg

SEQ ID NO: 1877 - DNA, 341 bp, Aplysia californica
  source 1..341: mol_type = unassigned DNA
  misc_difference 257: note = a, c, t, g, unknown or other
  misc_difference 274: note = a, c, t, g, unknown or other
gtagagaggaagagcccgaaacagcgacgcattctctcctgatgatctccatgctagagtccgggatacggagcgttcggcggtgagcagtgcatacggctgtttagactacgtacctaccagtagcaggtgtatgctacggacatcctggaaagacagcacgacaacccggagtgacgggtggacatcgggaaagaccgaggacgtcgggaaagaccgacggtggcaggggctaactacccaggtcactgcaaatntaagttacgtcaaccantagaaaagacagccccgggatcccccgagaggggggagtagaggatggatccacaaggacggattca

SEQ ID NO: 1878 - DNA, 776 bp, Aplysia californica
  source 1..776: mol_type = unassigned DNA
ccccccccaaatagacccacctcttcgtggtggggggggggattagtactcttcgaataggaaaagaaaaagaggaagctaacgggtcaaggggtgaccccgaaaagagacatattactttactatgtttcttactctttctatttattgtttttattgttttactttattacatttattaacttttcttttctcctctctccatcgacaacctttctttgacctggagttgggacgggtattggtggggtggaaagcagaggttcattgtcagcactgtactggatgtgactttacgtagggaatacccagctacatacatgtattaagcatgcacttatcggagagccctatgactgcggagaaggtgcagagaccatttgcgtcttgcttgttgacaacattaaccctctgggatctgccatgccttcccctgcccccatctctcggatgagaggacttggttgctctgggagggggggggggggaatctagcttccaattggtattattattactattagtattattattattatattataatttttgtatttcagcaacacacagcaactatgctcttaatagcgtctttctcttctttatctcctcaaacaacttctcaatataatacaacagacaccaacatacccattcatttttcttacaatctctctgtgatggagttgggtttttgtttgtggcattgcacctacagccactgctttatctcctaccccgggatggaaggaaaatcacagaaccaccagttttag

SEQ ID NO: 1879 - DNA, 346 bp, Aplysia californica
  source 1..346: mol_type = unassigned DNA
gtaaagctggggcgaccatccccgacccaccgcgtccacaggtggcggatagtggaacggcctacattatgtagggtagctgcgaataaccaataagcagtcgcggaccaactggcgacagtcttggagagcgaggtgggacagggtggtggcaaccctgtctctataaaatacctcatgtgctcagtaaagagactgtcaggcgagagggaggcgccgaaacctgccacctgcccccactgccttgtgggttagtccttttggacaaaggctagcggagtaaaccgtacaaaaatccagcagaaggcaaggggaaaccactgctgtattctttccctagaacatt

SEQ ID NO: 1880 - DNA, 873 bp, Aplysia californica
  source 1..873: mol_type = unassigned DNA
  misc_difference 170: note = a, c, t, g, unknown or other
gggctgtaagggttgagggtgaaaccccagacgctctctggcaagccagcctcaaccaagtcaactccccgtccttgtcgagcagcctggggacccctgctctgtgcataggagcaggggttgcagacggagctctggccaggaggtaccatagccctgtgaggtgcgangtgagcaacgacccttcggctcgtagaagggtccgtacacatccaccattatggtaggtctggcgtcacagcaggccgacctgttcattcaggaactcactgtcgacatcttcttccctccctctcgtgggagctctacagacggggcatggtacccacagactgccagatgactcatcgtgagatgtctccgcggacccagaaggccttgtagctgtaaggaataggctgcctggaaacagatgacgtccctacagatatcctggcaaatgctcgctgacccatgacgtgacgatcctctgtctgagtagatttggccacccctcggattattctgccccatgaacggaaatgttaatagcagatagccaggagacagcaggtggcggggattgggcaaacgcaagctacgcttggtgatgtagacgactcactgtggaaggaacgcgttaccccttactcaatgggaccccttactggactgctcagacgatcacttgtcattggttgcactttgtggctcccatctctcagaactagagtgtgcctacaccccctatggttgtctactgtctaagaaatccccgtgaaggttgatggaaaacaggacagcgaacattgcacctttgttctcttgtggcaagatgtttgggcacaagccagtgtcaggacaagactaccacctacctgagatcctacaggg

SEQ ID NO: 1881 - DNA, 243 bp, Aplysia californica
  source 1..243: mol_type = unassigned DNA
ctcccctgctggtggggggccccgtagttttactatgggggagcaaagaatacacctgccgtgatactgcgtgtcgtaagaggcgactaaaagtgcataggtctggtcgcccgaaaagtgccagtttgcggagggccaactacccaacccagtaaaaaacagtaagttacagaaacacggacaaacacagctttttatttttcgatcttgggagacggaggagcttctgcatcagcaggaaca

SEQ ID NO: 1882 - DNA, 513 bp, Aplysia californica
  source 1..513: mol_type = unassigned DNA
gtcaggtcagccttagtgctgctaccataatgacagtagatggtactacctgcagctgttcctactgccttgtaggtgcatacgggagtatgaaaggttaagggagtaaaccctaaacaaatccggagggagggcccctaaggcagtcgacagggaggaacgatccgaactatcttctggcagcccctgcaactttactggttccaaatgtattgacctcgtctctcctttggactaaatcagctaagtcgagagggggttcgtgcaaattgggcaaggcacgttctccatatagtcaggcccaggcatttagcttagtcaagatttcaagatttctgggaggacgctgcaaaagagcaaatacagcggatcagacccacagctcaaccacagctacaacagcatttatatgattatggagaggacacttcatccttgttgtgacgagcaagggaaaaaacacgggaggtggcagtttacgggttataagacatccttatttggcgaaacagg

SEQ ID NO: 1883 - DNA, 109 bp, Aplysia californica
  source 1..109: mol_type = unassigned DNA
ggtgtatgcaccgtgcaacgactcctactcagacgaagaaaaggactctttcttcgaacaactctcggacttaattagcaacatcccagacgaggaagacctttatgta

SEQ ID NO: 1884 - DNA, 1958 bp, unidentified
  source 1..1958: mol_type = unassigned DNA; note = Description of Unknown:Blumeria graminis sequence
acatccacattccgaaaagtcgaccccatagatttttatccataaagttgacagcaaatcgtaatcgtgatgacgagtattcctacgagaggaattaatggtggaacgccttgcgcgggctctagaggtggtagcgtcgcgtcaaaggcgccacaagacacagacgcgtccctgaaaagattcaaggacgcaactaaaggcgaagagctctccagtagagcgtacaggagaatgattgaagaggccattcaggttatcgaaggccttcagaaagcgaaagtcaccccccccatccccgcccagacaggccatagtgatgataattctgcaatggctaagatcctacaggagataaaggacatcaaagcctccatagcccaaaatagcccaccaatgcaagccccaggccgctcctgggcaaaagtcgcaagcaagggagagtcgtacggaactactatccgaatacaggatgaacaggaaaagagagaatagccaagctctcgagcgaagagttagtcaaaaaaatcggagtacagcaaatagtaggtgctagacaaatgacaaatggtcaagtgaaggtctacttcgccggtgaaggaacgaaagaattatggagcgtcacaaggactggacaacgaagctggctgcttctgcgaaagttgccggccctgtttaccaagttctagtgcatgacatgccgctctcctttgagccacaaaatgcagaacatctgaagctgctacaaaaagccaaccatgttatatacaaggcatggtaatmcaaagagccgcatggcttaagaaatctcagcagccagggaaaaagtctggatcttaatcctgtggattgatcaggccgtacacgcagatatggcgataaaaaagggcttgatgtggcaatatgagctcaagtcaacagaaatattcaggagtggcttccgcatgatgcaatgcttcaattgccaaaagtacggacatattgcgaaaatctgctccgcagactcgaagtgtggccactgtgcaggagagcacaacactcgaaactgtacaggaaaacaagacgtcagatgcagcaactgtggaaaaggccacaaaacatgggaccagagctgtccagttagggcagctgcaaaaaatagggctgtccaaaacaggacccaagacccaggaatgttcttgaccgacgaaaaatcgacaagaaatcaagatggcgaatggcagattgcaggaagcaggaaaagaagagcagtaatgactgcaccacttgttggggccgatggtagtatagatggtcgtaggcgtccaggcagaccaccaaagatcccatcagctgtccccacagtcgcagggctcttcgcaaatctcagcgaggtgccatcaaaaatgacaccccggcctgtgacacggggaaatcaagcagatgagactgagagcgaaatggattcatgaaggacaaatcaatcctttcaatcatacagtacaacgtcaacaggagtaagaataaagtgcagcacgatttcctccaagctttgaatccactgaagcaccacatagtggccctgcaagaaccatggcgtcaccccacmgaacaacacgaccgtcacccaccctgcctaccacctggtcttcccaagtggccacaaaggcaggacatgcatctatatcagcaaaagtctggctattagcaaatggagaagagaaagagtgccagaggaatcgcaaggagacatcacatckgtcagcctcgataccgaccttggtaaaatttggatacatagcgtgtacaatccacccccattacaccacagcagcctagaagaaggaacactcaagtggctcccgcaaatcctatctcaagagggggaacacattctagtcggagactttaatgtgcaccatccgcattgggggggacagtcagtacttaggcaccataagatcgcagacagcttcatcgaa

SEQ ID NO: 1885 - DNA, 186 bp, Caenorhabditis elegans
  source 1..186: mol_type = unassigned DNA
ctctttctgtactaagccttttcgtggcgaaagggatcaacagataaccacttcaacaaactcgatgatttcgtcacatcgagagtggcttggtttggaaccaagtgcaaattatctggccaagaagtacaccgtctcacgcaggccagaggtagtgtcgaatactctctgtccgggcggctctag

SEQ ID NO: 1886 - DNA, 401 bp, Caenorhabditis elegans
  source 1..401: mol_type = unassigned DNA
agtgacgggtctcagtaatcaatactctgtcttccgtacggatcgtgctaaaggtaaacgaggtggaggtgtttgtaatgtggtaaaagtagaaatcccatgtgaaacagtagtttcagttgaaaacgcttaacgcttatgaaattctcgtaaatgacctgaacattgacgtagttccctttagaatcataaacatatatcgtgctccttcttgcacttatcaaaatactgttagattaattagtaaaattgaagaccttgtggaacatcaaggcaaagttgtagttgtgggagatcttaatattggaggtatcgactggggcctcaacgactctaaaactaaattaggttctttattagtagatctgtgcaaaaactataatctggaacaatatgtcaaa

SEQ ID NO: 1887 - DNA, 277 bp, Caenorhabditis sp.
  source 1..277: mol_type = unassigned DNA
tgcttgctggatacctcctcgcggtgcaaactgggcaatgctgtgctcctacgacaggggaaattggacaccactgttaggcacagtagccaaaatccactctttgccacggtagtgtccgatactcgtgaagaaggggcttcacgccggcctagtaagcctgctgaagtacaaacctaaacttactaaaaagctgaatcaaaagaatgtaaaggacccgtccaggaattcaccagctcggccacggtgctcgccgagttgtcttggtcggaagaaa

SEQ ID NO: 1888 - DNA, 79 bp, Caenorhabditis sp.
  source 1..79: mol_type = unassigned DNA
ggcggtcggcctatttttctccgaccgtccatgtcgcgtgaagaattggtgcaataccacgacaaccgccgcaagaact

SEQ ID NO: 1889 - DNA, 47 bp, Caenorhabditis sp.
  source 1..47: mol_type = unassigned DNA
tgcctctcagactttagaacttttcaaatcccttaccgcacttctag

SEQ ID NO: 1890 - DNA, 265 bp, Caenorhabditis sp.
  source 1..265: mol_type = unassigned DNA
cactaaaataaaggacctgaacgtgtacattaaaacgaaacaaacacacacttgcacgaaatgcgaccaagtcactaaccgccaccgccacaccwctagcaagaccaaagaccagcaawgggacgwgcagactcaggccaatcccaccacgwcgcgctcaatacacaatcaaacgtgtgaagattctgacatggaacgtaaatggctgggccagaagaaacagtgwgctcggtgctatcattagcaaggagaagccggacgttkt

SEQ ID NO: 1891 - DNA, 500 bp, Caenorhabditis sp.
  source 1..500: mol_type = unassigned DNA
cttctacacgtaatgagcctctccgtggcgtagaagatcaacacctggatcttttcttcaactccggcggatttcgtcaccccggcaaagattcaagtggctaatcattacacactgcctcgctcaggtcggatgtagtgtcgaatacttcctccctgcgcacattcctcggtttagcaggccgttgaagagtaggcatacccgctacgaacagcaccaacaactgcctcagtcctccgcatccggcctctactcttgttacggcagattcaagagtatgtcggaagaggcgatctaatcacggagtatcgaacgtctgccacactggacggaacaagaacacccggccaaaaacaagaagaatcgactacagagtgtgtacgttcaactgcagatcggttgccaccgatgaccgacttgcagagctgctagaggagacaaaaacgatcaagtacgacattatcggactgtcggaaacgaagagagcagctgaaacacac

SEQ ID NO: 1892 - DNA, 797 bp, Calypte anna
  source 1..797: mol_type = unassigned DNA
ccctccacgggcacccccttgtcgtgggggaggagcttgcgtgcccttgtgaggttgggagctctgctggcggtggcatatgcctccagtagggtctcccatgccagacaggtcacaactgaagggtcagacaaagtgtgtccatgggcaggatgggctcagtagccttcaggcaaccatcctaggagaaggacaactctaactccaaacccgggcagatggagctcgtttagccctgtaaggccatccatctaagagaaggatactctaactaaacctacgtcctgaggacttcgctgtcactgtccaagcttgctgggccctggcagatgaaccttaggagtaaagggtggggccagttccgtgcacgctgcgcctcacctaaaaaagccacagcgcaggctcgaagggtgaacccacacttgtaaagcccctgcagcgacaggcgagggwcgaaacggcaggggaaaggtgcactggaagccgcagacccaaccctgcatgcaggcggctcaggacattggtcgctcgagactgacccaggagatgacagtcttgttcggcagcatcctgagtgaccaagcagcctttttcaaggagagcactgcttgctccacatggagaggggcctagaaaaggtggcctaaccaaagctcatctccaccccccacccggttggctasccacggtcaacgggcatcttctgatgcagtcgaacaaagacaaagagacaaaggcatacacctgcctctaaaggtgtgttcagattgacactcgcatgttggaacatcagaacc

SEQ ID NO: 1893 - DNA, 36 bp, Capitella sp.
  source 1..36: mol_type = unassigned DNA
cacgcggcggtgcaaccgcaccagcgaaagacgacg

SEQ ID NO: 1894 - DNA, 687 bp, Capitella sp.
  source 1..687: mol_type = unassigned DNA
  misc_difference 173: note = a, c, t, g, unknown or other
gaacaggagaaagatgccatgagaaagagaaatgtcatcatacacggactgccagaaaagaagaccaacaacagagaggagagaaagaaagaagatgagcaacacaatcgagaggattatggacgcattggaactgaacctagaaattgaaaacttctaccgactgggaaaantacccaatgaagacgccgacagggaacatactactagcagacccctgaagttgtgcttcaatagtgaagacaaggtgaagatgttcatggggaggctgaacaaattaagagatgcagaggaagatatcaaacgaattagagttcaacacgacatgaatttacaagaaagagcagagattagagaactggtacaggaagcaaaaaacttaacattaacagagagtggagactttgtacacgtcgtgagaggaaaaaagataatcagagtgaaagccagaaagaacggtcagagcaggagagagacccaagaggactcaacatctggatcacgaacatagacacccttacaatagcaaaatttaacgaattaaaaaccataataaaggaatcgccaccggatatcatagccctacaagaagttaaaccgaaaaacgcacgtacaaactgggaggcaaagaattatataataccaggatacaatatagaagaaaggataagagaagatggaagagga

SEQ ID NO: 1895 - DNA, 171 bp, Capitella sp.
  source 1..171: mol_type = unassigned DNA
gcggcggagattaaatagatatggtgtcttagatcccgatgccattgatccttctcttgaggaggacatggccgtggatgtgcctccttccacttccctgacgagcccagggaagatgcaatccacaaaggagggacccagccctgaaaagggcccctcctaatagacaag

SEQ ID NO: 1896 - DNA, 103 bp, Capitella sp.
  source 1..103: mol_type = unassigned DNA
agatcaggtagcaccctccggtagcacctaaaatttgctccgaccattttgctgttttccgatatcttccactccgcggattgcagcgaatcttggtcaagac

SEQ ID NO: 1897 - DNA, 383 bp, Capitella sp.
  source 1..383: mol_type = unassigned DNA
ggtgtacaaacttcgtcatcaaacacacttcgtgcacagctgatgttgagatcctatgtgtgcagtgtcgaccattttatctaccgcgtgagatcagctgtgtcgtcttcatcgtgatctacatccctcccagtggcgatgccaacagagccacggaagcgatagcgtctgttgctttggacatacaacaaacaaagccagaggcagctatcgtcatcacaggagactttaatggagcttcgttacatgacgccctcccgacctacgtacaatacgtaaatttcaacacaagaggtcgcagctgtctcgatctactgtacagcaacataaaagatgcctacaagaccacaagcctgccacccatcggcagatctgaccacacg

SEQ ID NO: 1898 - DNA, 66 bp, Capitella sp.
  source 1..66: mol_type = unassigned DNA
gacttcaattttcaacaacatgtgactgatgcaacacatgtcaatggtcacacaatcgacctaatc

SEQ ID NO: 1899 - DNA, 278 bp, Capitella sp.
  source 1..278: mol_type = unassigned DNA
gcatcaaggaaggtgtgcaagggaggacgaatattgttgatggtcgagtaggggaatctgagatctgtgatgtgttccatgatggctatgagcatctgtatcagtctgtgccttctgatcagagtgaactcgaggaactccagcgcgaactttctgcgggagtagatcgcacatgtaaagtaggcttatgttactgtgatcacgtgatcagcccacgtgatattgagtttgccgttcgtaaactgaaaccaggtaaatctgatgcctgtccgcagtta

SEQ ID NO: 1900 - DNA, 171 bp, Capitella sp.
  source 1..171: mol_type = unassigned DNA
agcacatatctgttgcgacccatcactccggacacactcttgacctggtcattacgcgagagaatgaccttgtattgaactcaactgtcaaggattccctgatctcagaccataaggtgatccagctcagcattaacattgctcgtccccgagcagaacagaagagaatga

SEQ ID NO: 1901 - DNA, 315 bp, Capitella sp.
  source 1..315: mol_type = unassigned DNA
gcaacctttttgtggaagctaagaccacggaaggcctcgacgagcttcgaaacaagatagcccctctcacaagcgatctctttggggaagcggcttcattgcgcctgatggacgacagcaagaccaggccaaaacacgtcatcatcagaaatgttcctgcccactatgacgcggacaccatcctggaggaggcccgagtcgaatacagcagcgcctcatccgtcattaacttgaccaagccagggagcaccgccagaaggaggcccataaagctgagccttgacgacagcaatcaattggagcgacttctcaacc

SEQ ID NO: 1902 - DNA, 420 bp, Capitella sp.
  source 1..420: mol_type = unassigned DNA
cgatgtactctttgcgaattcttttctgccaacaatcaacaagccaactagaatcacagggtcgtctgcgactattattgataacattttcatcaataatctaacaagagcatcaactacatccggaatccttgccaactcaatctctgatcactgtcctgtattctgcttcacaccattccacaataataagagcaaccaaaataacttcatcacaaaaggctattcactgaccgaaataaaaataaattccacgacctcataagctccacgcaatgggatcaagtactcaatgaagcaaactgccgaacagcattcacatcattctacacacaattcaccaccatttttgatcaaagttttccattaaccaaaataaaacttggatataaaaatcgaaaaccatggctaacagatgca

SEQ ID NO: 1903 - DNA, 317 bp, Capitella sp.
  source 1..317: mol_type = unassigned DNA
tccttgacaccagcaacaaggtcgtgtctatcaccagtgagaacgacctaagggactactgacacagatgactgcctaatatcacggactccgatctctcacaatcattcaacctctttctgttcttgttcttgctatgttacaacccccatccctacctttacttgcacaaagcacctatctgcacgtcttccactctggtgagttcctatccaactttcttcattcctacccatcatgcgagtatctcataccttcgccataccttacctacctgtatctgaccctagctgcgcgaacagaaacctcactacgaa

SEQ ID NO: 1904 - DNA, 459 bp, Chlamydomonas reinhardtii
  source 1..459: mol_type = unassigned DNA
ggcggcggcggaggcggcggcggcggcggctgccctggcggcggcgggtgcggcggcgcctggtggtgcggcacccggtgccgcggaggcccccgctgccccggccgccgggccggcgatggcacccggtggcgccgccgcggccaccgccccggcagtggcgaccgacgcggcgcctgcggccgctgcagccgcggtgacgctgccgcccgcgtccgcccctctggctctggcgctggcgcccggcgctggtgccggtgccgccgcatctgcggcggccgccacggatggcagcggcagcggaactggcagcggcagcggcagcggccacggcggcggcggcggagtggcggcggcggcgacggcagctgcggcggccgcggccatgacaatggggatggtgggcggcggcggcagtggcggcggcggcgacggcagctgcggcggccgcggccatga

SEQ ID NO: 1905 - protein, 30 aa, Spumavirus sp.
PKDLKQLQSILGLLNFARNFIPNFAELVQP

SEQ ID NO: 1906 - DNA, 51 bp, unidentified
  source 1..51: mol_type = unassigned DNA; note = Description of Unknown:Copidosoma floridanum sequence
tccaatgctttaaaacgctggaaggacctgcacatacaactatcaaccagt

SEQ ID NO: 1907 - DNA, 439 bp, Crassostrea gigas
  source 1..439: mol_type = unassigned DNA
gaggagcaatcaatcaatccagtcttttgtacatttattttcggtgttattgatttttcattacaccacctgttttatataactcatatttttttcattttctttcatatttactacattctaacgcaatacgtttatgcgttatttaactacctttgtatattgttatttaccttttgttttgtcattgtgcacatacattttttatgctattactttcacccctacgttttgtttatctcttttgttgaacaatattttgtcaattgtcatattgaggtatcgtcattttcatttgaataccttcattcagctgtaagtttactactagtggtgtatcttccggtttttggtcttattcattacccatatacgacacattatacagattgcagccatcatttcccccctattgttatcaaaaagttaatcattgaca

SEQ ID NO: 1908 - DNA, 609 bp, Crassostrea gigas
  source 1..609: mol_type = unassigned DNA
gagagagagttgttagacgagatgaagagaaacatcaaatctttgcaaaaagaaaaaaagacattaggcaactaaaakattcaatcgttgatctgcaatgtcgctctatgaaawacaatctagtgtttacggggctgggtggcgaaacaaaggaagaggacacaggggcaagctgcgggactctatatattttgaactgggaattgactggaaagtggagttctgtagggtgcatcggttcggtcgatttcagcasaacaggagcasacctactgtagcgaaattcctttatgaaaaagacagctgcaggtctgtagctcccggtctgaaaaaagttgaatggatcccaggtcgtccatccgaatttkttcagaccggkagctacagacctkcagctatgaaaaagacagattaaststccttgaaasagcctatcaattaaawkgamgtggattcggtatcaatgaacaattcccgcacgcttttgaggaaagacggaaacagctttatccttaacaaaaatatgttagacatgaacatatcacttgtagaccaattttgtagtactgttgtctggatacgttttgaacataaaagcaaacagggtaa

SEQ ID NO: 1909 - DNA, 326 bp, Crassostrea gigas
  source 1..326: mol_type = unassigned DNA
gatgataactctgtattacctcaagaaatatttatgtgtcacagtatgtttgasagtatgtgtattaatgaacaagaaataattgatatactatctattcttcctgtaaacaaggccataggtgcagaccttattagtcacaaaatgttgaaagctactaaacttaccattgtcaaaccattatttctattgtttaaccgctcacttagagaatctgtttttcctattatgtggaaacaagctaacgttattccactcttcaaaaaagatgacccttctgttttgtcaaactatagaccagtttcgttattaagttgtgttggtaa

SEQ ID NO: 1910 - DNA, 430 bp, Crassostrea gigas
  source 1..430: mol_type = unassigned DNA
tgcgcatgcgtgaaagtatcgacatggcgtaaaattcagctgcgagaattttctgtttattccaaaatttwggtwgttgttatgtcaacaaaaactccgacaaaagtcccgactaacgtgccaaataaatctggacctggagctgatgttgggaagcgaaggctctcgtcggacggtcaaaccccaaagccaacacccaagcaagtcaaaatggcgacgaacagctcaccgaacacacccggcaagtccggtaggtcaaacatttctcatgccgattatgaaacatttgtggaaaaaatgactattattgctgatgctgttgataagttacagaaagggcaatcgacactacaatcaattgttgaaagcaaattagacaagttcaaaaatgagttcgttcagggcatcaatgaaaaattcaaagccatga

SEQ ID NO: 1911 - DNA, 141 bp, Crassostrea gigas
  source 1..141: mol_type = unassigned DNA
atcacgtgatatgtatggaggtggacgtgtttttaccggagtacgacctacgggaatttcataccatatatagcgaagtttagttaaaggttgcggtaaatgtgatacaccattgatacgtgagtattatactctgttcct

SEQ ID NO: 1912 - DNA, 427 bp, Crassostrea gigas
  source 1..427: mol_type = unassigned DNA
tataattgtatttcatgaacattaatatatctcacataattttggtatgatttttataatatgctgtcatattaacaagctcaaatcatcagaaaatcaaggtactttttttttaaacacatagtatgcgcagcatagggtttaaggtttttaaaaaaacagacaataagttatacatataaaactcctcacgaccgattctaattatttatactattgtacgatttttttttttaagttgacaaaaaaaaggttgtttttggtcaacttcatgcagtcaactattttttagtgtttgtaaaattagcaagcgtgatgtgctttcgcaattccaaacttctgccttttaactgttttttctcccttttatttgccccctttctattcttttcgggaaccgtaaaccttataaagcatttatatagac

SEQ ID NO: 1913 - DNA, 559 bp, Crassostrea gigas
  source 1..559: mol_type = unassigned DNA
aaaaatcgagcggcwatgacaacatcatcaacgagatgctcagtgcagatgtgtcgacccttgaaccagtgttaaatgtgttatttaattcgatatttgatagtggttattatcctttaaattggaaattgggtataattgtgccgattttcaaaaaaggagataaaatggatccacagaactacaggggcataaccctacactctaagctgcctggcgaagcttttctcccgtatcctaaacaatagattacaaagatgggcagaagaaaatagtgtgatatctgatgcgcaatatgggttaaagaaaggttgtagtactattgatgcattatatgttttaaaaagtatcgttgactttaaaattgcaaatggcagtaagctcttttgtacatttgtagattttcggagagcgtttgacacggttgatagaaatgcattgtattataaaatgtttaagttaggtatagaaggtaaaatgttacgcataatcaaatctatgtatgatgatgtgaaaagttgtgtacgagtcaatggtaatcttacagatttttttttga

SEQ ID NO: 1914 - DNA, 839 bp, Crassostrea gigas
  source 1..839: mol_type = unassigned DNA
gaatcatggaaaaggatctggtgtcaataaaagaagctaatgaaagtctacaaaactctgttacagacctaaaggctcgttcaatgcgcgacaatctgatattttctggaatcccggaggagagacatgaagacaccgaagctgtcctacaagaatttatccaaaaaaagtataaactggattacgaagtcccattcgaaagggtccatagaatgggtaaatggaaggagtacagttcccatcccagaaatattgtcgccaaatttacctattttaaggatagagaattaatccgtacacgtgccccccagaagctccacaaatccaacgtttgggtaaacgaacaatttccccctgaaatcgaggaaaagagaaggaagctatatcccgtcctccgccaggcaaagaaagaccacaagaaagtaaaactggtccgggacgtgctttacattgacggacaggaatatatccctcctataggatccgctccgagagcatttccaacgcccacgccagctcagacgcgatccgccagcaatcaaacagccgagcgacaatacaccccgcaaaacccgaccaaagacgaccgacaggcttttaaacgacaacgtcaaggatcaacccccgaccgaattggatagggagacgcaggagaacaactctcgcgaacaaacagctacacgtctctgaaatttctctcgcttaacgtatgcggtgtcaaacaaaaactaaattaccccgaattttgtgattttattgcaaactatgatatcattggactatctgaaacaaaaactgatgattcggacaatattcaaatacccggttacgtcacttac

SEQ ID NO: 1915 - DNA, 981 bp, Crassostrea gigas
  source 1..981: mol_type = unassigned DNA
ccaaattccaacaacagcacagacagtattattaaagatatttgcagagaaaaactggggatccaaataaccgaaaacgatatttttcgttcccatcccattggaaacagaaacaaccatgggggcatccaaattatttgtcgtttccaaaattggaaaacaaagaacgcagtgtacaaagcaaagagtaaactaaaaaattccgatatctttgtgaccgaggacctcaccagataccgacaaggaatcatacatgaactgtcagctgctaaacgcttgcgtaaagttcactctttctggaccaacgacgggagaattttcactaaactgtccgaaaatggtcaaaaatatttgatcaaatccatcagtgaactgcacgaaatcgcgccgctaccgagtgacgaacaacaaggctaaaacgcaaatcccgtactctcttctgaaccacaaacccatgtgagcaatgtatagtataaattagatacaatgttcaatcagttatgtgtgatattctaagtatcgtgtcttcaaaagtagatacatgtatttgcagatgtatgaaaataatttttagttatatgtacaccaatctaatagttgtggttaaattacatagctacatttttgtttgttatatagtagtattataactgtgtaaacctatgaatttatatttcccattttttctcaaatgcaatcaatttggtttttaccaatattgtacttgatgccataatgttttttttttctacattttcttgtttttgttcatttgttcctttcttgtttttcactttgcattctttatttgtttgcatacactttttcaagtgtttgcttactgtgtttttaccttcaacttttgtcttgatgttacgcaacgaaggtcatggtcgttcagtacatgtatgaattcacacctgtcttttcaatcgcagtgctctctcatagtttcaataacgttaatcaacatgtctttca

SEQ ID NO: 1916 - DNA, 36 bp, Culex quinquefasciatus
  source 1..36: mol_type = unassigned DNA
cacgtggcctcgcggtcttgtgatccgagaatttga

SEQ ID NO: 1917 - DNA, 22 bp, Culex quinquefasciatus
  source 1..22: mol_type = unassigned DNA
atactaccagaacgtcggaggc

SEQ ID NO: 1918 - DNA, 24 bp, Culex quinquefasciatus
  source 1..24: mol_type = unassigned DNA
tagggctccttaggctagccactt

SEQ ID NO: 1919 - DNA, 1879 bp, Culex quinquefasciatus
  source 1..1879: mol_type = unassigned DNA
gaattgtggtttggttgagcgttttagcagaatgcattactgtgaatacaaagagacgagttgttccttttaattccgctatatattttaatatcttgacagatacgtatttcgtctactacttgcagacttcatcagtgttctgttctcgactgaaggttcatcgctggtgtatccgtatttgtagttactgtaggtactacctcctcgttcttcttttgtgcctgtataggtaacagcttaaacagccacgttgagccgttacctgaatccttgttgagtaaacgtttgttgcctgccttgaagatttccaaactttcggcgacagccagcttcgatgggttagtgatgtgtcttaagatgaccgcgtcgctagctgtgatgttatgtttttcctcgatgatgtgttcggttactgctgacttgaaatgggggacaaatcctttccgtttttcctccatggcaattttgacatatgtgtgtatatgctcatccaacctggtttgcagcaatctcttagtttgtccaatgtagctcatatcacagtggccgcaggatacctcgtagatgccgggtttgcctaaagtcggtatggggtctttcgttgaacctaagatggattccaactggctgtttctactgctgaacactaaatcgatgccaaatttagccagtttttgtcgtaatgggcgtgttatcctgtagtcgaattctactgctgctcttcgcagtggctctgctgatggcgtaagggttgtgagtgaagttctgtgcagttttctttccttcttatcgatgattgcttggatagttgttctgctgtaaccgttgatttccgctgtttcaaatatgtactccaattctttctgttttcctgcttcgctgaggggtaaagttgtcatcctatgtataaaataatgatatgctgccatcttatgttggaatgaatggtttgacgtggctgggattgttcttctggtgtttgttggcttcctgtagatctcgaaagaaaacgaagatgggcaacctggttctcttaggatcaggatgtctaagaaaggtaactttccttcgacttccatttcgtaagtgaacttgatgctcctgcgtgcactgtttatggtgtccagtaccgttgttagtgagtcccttttgatgatgcagaagacgtcatctacgtatctccaccaacgttctggtagtaggtttttggtttgtagttcgtgttccaaagctgccatataaacatcgctcatgaacggtgacagtgggttacccatcgatgctcccatcctctgttggtagatgcaatccctgaactggaagtagctctgttccatgcataatttgacgaatgttatatactggatcgttttttgtctccatggttctccctcgtattgtgattgcagccaatcccgtagagttcctattgcgttttttactggtatgcttgggaacagtgctgttacgtcgaaggaaaccattatttcatcctcagctatcggtcccgactctaagagctcctttgtgaacacctgcgaactgatgatcgaacggctcgggatcactaacccatcgaagctggctgtcgccgaaagtttggaaatcttcaaggcaggcaacaaacgtttactcaacaaggattcaggtaacggctcaacgtggctgtttaagctgttacctatacaggcacaaaagaagaacgaggaggtagtacctacagtaactacaaatacggatacaccagcgatgaaccttcagtcgagaacagaacactgatgaagtctgcaagtagtagacgaaatacgtatctgtcaagatattaaaatatatagcggaattaaaaggaacaactcgtctctttgtattcacagta

SEQ ID NO: 1920 - DNA, 99 bp, Culex quinquefasciatus
  source 1..99: mol_type = unassigned DNA
ggataccatcgtagttgtaggcgattacaatctgcctcacctcaactggtctttcgattcggacatcaacggatacctgccaacaaacgcatctgctga

SEQ ID NO: 1921 - DNA, 177 bp, Culex quinquefasciatus
  source 1..177: mol_type = unassigned DNA
ttgtttggatttagatgatagtagatttgcccagcagtacaggattttttgttgttattgttattttgtttgtttaagsagtttatctgaaaaccaaaacagcactattatcttttgttttgccctgattgctcttttcctacgcgtgtttttctctacatagatttatatattttt

SEQ ID NO: 1922 - DNA, 615 bp, Culex quinquefasciatus
  source 1..615: mol_type = unassigned DNA
gtgtgtgtgcgtcgcgcgttattatcgcgcctcggtgcggctccgcgaaagtgccctcagaaccgcagaattaccgttccgtcgtggccgaaagtgtgatcaatcaacgccgaagtgcgtcgcgaaccggcgtcgtgtgttataattgacccgcaatcgacggctgggcaataaaagtgaagttatttttgccgtccatcgtcgtcgtcgcgggaaaacaggcagaacaaagcaagaagtgtggtgtagcaacaagaccagtggcagtgccgttgtgtcggttgcgtatacgcacactaatcgaaaccgcgcgcggtgtgccgagagtgcgaatttttgaaaaaagaaaacgggcaaaaagttttgaacttttttgcaaaaaataaaataaattttattattgcgaaatttggcgctagtagtgaagcgcatttacgcacgcagcggaggacgtcctcttccggatatgaagaccgttaggcttcgagataaaagccccgttacggtakcgtgagaaaaccggggctaggtctcggtagcccgtaggtggttctccaccccgagactaggtagcgcagccctgataaggctgcctaccgaaaaagaggatcgcga

SEQ ID NO: 1923 - DNA, 255 bp, Danaus plexippus
  source 1..255: mol_type = unassigned DNA
atccagagggtgtcctactaagtatttttccgatatttagccttgggcatacgggtacgcgaccccggatcctcgagccaccactttcatacctctatcctcagtccatgaaggtggtgtcctgtacctcccctcattccccttcctaacctctttccccccttctctatcttttcctttcctggttttacccgtaaaacggggttttggaggtcagacggcagtcgctccgttaaaaccactcccgccactctt

SEQ ID NO: 1924 - DNA, 205 bp, Danio rerio
  source 1..205: mol_type = unassigned DNA
ccaagatggcggcgcgcattgacgcagcggctcagagctctccttctcagtgctttgtttgtttgtttttatatgtctgtttaatttttttaacctcagccagtcaggcgaaaatattttatagtcgacaagacctcctctcagtgggattacagagcaaagagacagttacaacaatgtttattcagaaccacagcatacctga

SEQ ID NO: 1925 - DNA, 10 bp, Danio rerio
  source 1..10: mol_type = unassigned DNA
tcgatccaag

SEQ ID NO: 1926 - DNA, 190 bp, Danio rerio
  source 1..190: mol_type = unassigned DNA
attgtatagctttgaggcgtaatgaatagtgcgacaaatagagttaaacaacctctttgcttgccattttaagacttgctgtctttttttagtctctgtgtgcaaaaacgtcttgcctcctattcagcgttggcgctgtggcttagttggtcaaagtgcctgtctggtaagaaacttggctgaggccaag

SEQ ID NO: 1927 - DNA, 1752 bp, Drosophila sp.
  source 1..1752: mol_type = unassigned DNA
aggcaatcgatttgaggggaaaaaatcactctacctcaaagccacagaaaaataaaaccatacatggaactgccaaaattcgacggtamctacgtcgagttcaaaattattactactattcaatgtcaaaaaaatcaataattttatatccgctttgaaaaggaasagtaaaggcttaccaaatcamgtcgaccatgaatagggggtatgtaatccgtaatgcaagcgccatccgccgcagtgttacgatctctcttcgacgcccttactagtttttacggatttcttctctcggcaacgaaaagttggaaaaagtcatgtccaggttagatcgaaaaacgcggtcgcgatgggaagaataaaccagttaaaattctagtcagatatggaaatattcttgggaagcgattaataaacgttatcaacacttagtggctgaggattccacgacaggaaggagagcttccaagcgggagcagccaaacaagccatgctttagaaagaaggcattcgtagtttcgtgacctgmcgaagactcccaattgaaatktcaattttgtaagtcaaagttctatcaattgccaaactgtttacatttcgcccaaagtcttaagaaaggacgaaatttcaacagatgtaatatatgcaaaacatagaccgcattaaacatatattgtttcggttttcccttgcccggtttcgccttttgtttctaagaatagatcgggagttacaaaattacgatagtattgaaatattgcttacatagtcattattgcttttcggcgagccgagcagctcgattgctcaagaaatatataaacttaattatttatttataatgacaattattatttatataaaaattatacagtgtattggccagccattccattgaacaaacgtattgccgttgtgctctatccttaaattacgaactataggcaagtcaaacagtcatttcgcaacgatactgaccggttgtgttttatttgagctcttgaaattacctttcaatcgcggttacaccgaacgtatataatcttaaaattggagaataactttctcaacccccgcttaacacttcacgcaccgtatataaacattacatcgcgccaattaacatatttaattgaatcgcaattcatctgctgttgccacaagkgcttctgttccctatcgccgtcgcgtctgttctttacacccgctcgccaattgctctctcaaggccacggtcctctctccgtgcacttcactttgagcgcttcgcctctctcatcgcctggatattcgaattggctctccgaatcgacgactctcccatcaagtattctaacggtcctctctccgtttacttcgagtgggtcgcctctctcatcgccttgcttgctgcggatcttcgaattggctctccgaatcgtcgcctctcccatcgccgtatctgccactacctggtgttctgcgtgtctctttaatctcccacggcctgctcttctgcaagattctcttaactgcctcttaactgcatagtgtccaaacaatcactaaaatgagtgtcgtcatctgttccgcaaagaaatgcgagttcaattgtgttatcattggagataattatttgtcttgttggctttgcgacaattgcgctcatgtaaaatgcgcaggaatgggtcaaaacggccgtgtagttgatctgatctcgaagagaggcggcttaacttggttctgccctacctgcctcgtacttactcggag

SEQ ID NO: 1928 - DNA, 136 bp, Drosophila sp.
  source 1..136: mol_type = unassigned DNA
atgtagggccagaccaataacaatcgtgcagtgttacgccccaaccgaagacgcaaacgacgacatcaaagacgacttctataccgcccttactaccactctcactgacatacctcgaggcaacatcaccgttctc

SEQ ID NO: 1929 - DNA, 238 bp, Drosophila sp.
  source 1..238: mol_type = unassigned DNA
ggggggatgggggagagcatataaggcaaagtgtctgactgcattcaacttggtgaatgccagcatgatccttatcactgatctcctcaagccgacgcactacctccacgtggttctccctggattgccattcaacatccgttgagtggcaaactaaagcgcgcgacgagagtcctagctcttcaaactaggttgtggcgtaggacttgaaatccacccatggaaaaaccaaaattca

SEQ ID NO: 1930 - DNA, 16 bp, Drosophila kikkawai
  source 1..16: mol_type = unassigned DNA
ggaacaaaccaaccaa

SEQ ID NO: 1931 - DNA, 298 bp, Drosophila kikkawai
  source 1..298: mol_type = unassigned DNA
ggccatgcgatgcaaaaagcacaaccagctcacaggtgtttttacacgacgtggtgtggtgtacgtgaagctgagcgacggaggggaacctcgatatgtgcaaagctcacacgagctttctgagctgatcaacgatgctggcggcgccgataagagcacatttcgagattaagaagcttcactcaattttgtatctcctatgtttacacataactataatatttattagatttaaaattaatgtaggtcgctatgttttctttgtgtccttttcagtatgtttccaatgccttaattt

SEQ ID NO: 1932 - DNA, 237 bp, Drosophila sp.
  source 1..237: mol_type = unassigned DNA
gctcatttttgtctctcgccttaatcctggtgcttctgaagatgacgtcaaaaactacctgagcagcaaactgaatgtttctcgagccgaactaaccgtcttgaagttcaagtttaagcagagacgtgaaatatcttcgtttaaaattggacttcctgaggaacatcttaataaggctctcgatgtttctatatggcctaaacatgttattgttcacgagtatgtaaacatgcctaa

SEQ ID NO: 1933 - DNA, 438 bp, Drosophila simulans
  source 1..438: mol_type = unassigned DNA
caccacggaagacgagttgaagagtgccttggaggcccaggcagagatccctgcagcagtcgtggctatcaagagccttcggcaatcgcagtacggagggaagactgcggtgatagcagtcccagccaatctgacggacccgctgatcaagcgtggcaagctgagggtaggatggtcccaatgcttgatcaaggagctggagccacgccaaagatgcttcagatgcctggaagaaggccacatagcggcccactgcagaagcaccgtggacagaagccagtgctgcttcagatgcgggaccgcgggacacaaagccgccgagtgccctaacgaagctaagtgcttcttgtgcgcaagcagaggtagccaagcgaccaaccaccaaatgggcacccggaagtgcccattggcgggtaaaggagcaccaaaggcactgca

SEQ ID NO: 1934 - DNA, 904 bp, Drosophila sp.
  source 1..904: mol_type = unassigned DNA
gaaacgtcaaaaggatagattttcacaaaattaggacaatwwtggacgcaaaaagcaacaataacgaacggcagcccccccctttcaacaagaccccccacctaccatatagttccgaaatggccaaatctcggaaggaagccgccaggaaaactacatcaaacccgttccggcaaaatgcgaaggacgataggccaaaccaaacgggattctcttcacatgaagctgccatccaaaaacggctgaataaatggcgccgacacgcggacaaagcgaccacaaaaaacaggaccaactcgaaggacaaccccaagccgcgacccacaaaaacgacaaaaaacccggcacaaagacaccttgaggccttcaacgacaaactccgcaaggaaaggagggatgctatagaacacacccgcgacgaagctatgacaagccccaggaggggtgatgctggtagcccgccgacaacaagtagagccgccaaaactaatttcaagacaaggacctaaaaattaaccgccgatgggaccgaggacgtgcataagcacttgcaaagaggaccccctgacgaccacagcctaaacctggcgcaacgagtactggaaatggaaaagaaaattgacacacttatggaactcttcttcaaatgcttagaaaataacaaaaacctgaccacagcacaccccatgtcctcctaaacttctaagttcctcgcaaaaataagtagcaccatgacattaaacataaacaacacacatactatcaatacccttaaaatagggtattggaactcatgtggagttaccaataaaagagacgaactagaagcttacataaaaaaagagggtgtccagatcatgctggtaasagaaaccaagctagaacgaaattctactatgcttaa

SEQ ID NO: 1935 - DNA, 216 bp, Entamoeba histolytica
  source 1..216: mol_type = unassigned DNA
agtaatacaaaggaagataaataaactaaaagacatgctaataagaggaaactataaaaaattaagaaggatattaagaataagaagaatgatagaagaaaagataaggggagaagtaaatgaagaaataaaacaattagaatatttaaaagaaatgaggaaaaagaagtagacttaaacaaaagtgaaagaacaagaatctacagaaacaaaatc

SEQ ID NO: 1936 - DNA, 140 bp, Esox lucius
  source 1..140: mol_type = unassigned DNA
cctctccgggagccatcaccttatcgtggtggagaggtttgtgtgttcctatgaacctgagggctgtgttgtccgggccttagtgctcctggtagggtttcccatggcaaagtggtctcaggggaggagccagactaaga

SEQ ID NO: 1937 - DNA, 47 bp, Folsomia candida
  source 1..47: mol_type = unassigned DNA
aatttttcaaaaaaaaaaataaaacgcccaaaaatatagagaatgaa

SEQ ID NO: 1938 - DNA, 194 bp, Gasterosteus aculeatus
  source 1..194: mol_type = unassigned DNA
cttccgtggaattactggacattctagtcaaaggtgcgctcacctttcgtcacgcggtgagacgccgtaggagaggaaaacgggccggctcgctggtgagactccgcaggcgtggttctcgcactccgctgccaggcatctttctctccaacgtgcgctcactgtgcaacaaactggacgaaattcagctgctg

SEQ ID NO: 1939 - DNA, 156 bp, Gasterosteus aculeatus
  source 1..156: mol_type = unassigned DNA
cctctctgggaaccgtcaccttatcgtggtggagaggtttgtgtgtccctatgaacctgagggctgtgttgtcgggagccttgtgctcctggtagggttacccttggcaaagtggtctcaggcgaggggccagactaagaatggttcaagaccccc

SEQ ID NO: 1940 - DNA, 84 bp, Gavialis gangeticus
  source 1..84: mol_type = unassigned DNA
agcttagttgcctgtacactaackccakaagcatgsgaaacaaacgtactgaccaacaagcaacacgaccagctccacctmtga

SEQ ID NO: 1941 - DNA, 273 bp, Gavialis gangeticus
  source 1..273: mol_type = unassigned DNA
atacaggacctccacctaactcaggaggtgcacagtcccaccaggggaaatgccctgctggacctggtccttgccacaggcgatgacctggtgagggaattgcgggttctcggccacctgggcgatagcgatcatcgcctgctggaattcactatccagcgcagggtgtcaagggctagcagtaaggcggaagtccttgacttcaggagggctgacttcaatgagttaagaagactagtatgagaggcattgggatcccgaagttttggggag

SEQ ID NO: 1942 - DNA, 969 bp, Gossypium arboreum
  source 1..969: mol_type = unassigned DNA
gacttcgtttgtgtgtctgcctattattctttgaattttatggcagtcttgtggtgttgagtgtttctttgttgtttttggtattattttatttttttttgtgtctttcttcggtgggtttgcggtgccgggggaccgacgtgacatgttgctgttgaagtctggcgttaggtggggattttcagagggtttcttggctctgtgacgttcgttgctttgcatggccaaggagttcttgcgactttatgcgctttagcggtggcgggccattcgaggtgggacgggcgatacatacgtggctcgtcacgatcttttctagcatcgtcagaccctgttttgatgggattgtttcattggcagcaataaggttttgtcgtttcttttgtcttgttcagctattttattgattttctttacgttcagtaggttgcatgggtcttgcatgtatcttgcatggattgtttcgtcttgcacgtattccactggtggtatttcttattttctttgacttttcaacgttattcaatctgagggtttttttggtttaacaggcattatatgaatgcggaggataagttttaatgattttccctatttgttcgatttagttgtttttgttacagtagctattaggtttctgggttttcttggactgctggtgttaggttgcagttttttggtactttcttgcatgttttcctttccttgatgttcggggatgggggtttgatggggggtgtttgttcgtagcttgagtcggggtgttcctggctgttgttgttttgctgtgtttttgcaggttcttggactgtttctttgctctgctcccggtggcggttttcggggttctgtttttctctattcttggggtgtttcttgtcgaggttgggggaggcgacaagagaaaagtgttgatcagtctccctggcactcgtttaaggtagcagtctcgtgagttgtcgtttgaaa

SEQ ID NO: 1943 - DNA, 1429 bp, Harpegnathos saltator
  source 1..1429: mol_type = unassigned DNA
cgccgcgctckgcggccgtcaccataacgtgccccgacggaaaataccatgagttcatggtcgaggccaggcgccgaatcagaccggcggacctsgggataaactcttccctgagggtccgccgggccctgaacggggcaatgctgatagaggtgcctggcctcaacgtcggggcgtccgccgaccggcttgcggaggagctccgcaagctggcggcggaaaaaggccccggttatcgcatccagcggccggcaaagttcgcagcactgcgaattgctgggctggatgcgacgaccggggccgaagaggtggcggccgcggtggccctcgctgggggatgctcgcctgaggaagtttcctcgggcgtgatgagcgtctcccagcggggagtcggcgccatggtggtgcggtgtccgctggcggcggccgctaaggtcgccgccgcggagcgggttccagtgggctggacccgcgccggggtgacggcgctgcccgctcgcgcaacgctgtgcttccgctgcttagagcgggggcacgtgcgcgagcggtgcaccagcgccgtcgaccgcagcggtatgtgctaccgctgcggtaaccccggccaccgcgccaaggggtgccaggaggcggtgcgctgcccggtgtgcgccgaggcgggcaggccctccggtcacaagatcggaggacctgcctgcaaaccccctcccggaaggagaaaggggggaaagaagaaggaaggaggagagaggcagaaggggaaggaggacaccggcggggggaggcccgaaccaccaccgccgggggaggaccggacccgacgaagcctggggaggagascggaccagtctcctccccgccgagggactgagggggagccggggcggatccggcccccccctggcaagaaccccagaggaaaaggggaggagggggactcctcccccgacctaatagactgggactgggagccggagagccccgatccaggagccggaggaacctctgccccgcaggaagaggagaggggaagaagaggccaacagggacgaggacgacccggaggaggasgcccaggccgcaaaggtgaggagggtggagccctcgggcacacccccaacaggtgtagaggaaggggagtcggtgggagcgctgcccccgactcccctgcaggttgactccccctcgtacccccgagaggaggaggtcacgcaggtagggaccccccgtgtctccgcggagacacccgcgttggaggccaccatggccgaaaccccctccggggagaccgagacggcttgccgtcggaagtctcccaggaggagggggtggacgtaggcagcccggaggaggcgtgtaaggcttagccttcacgacactccgggccctacaggccaacctcggccacggcgcccgggctcaggacctctgc

SEQ ID NO: 1944 - DNA, 49 bp, Hydra vulgaris
  source 1..49: mol_type = unassigned DNA
gtgtatataaaaaccttcaaatattttcaaaataacaaaaacatacaaa

SEQ ID NO: 1945 - DNA, 117 bp, Hydra vulgaris
  source 1..117: mol_type = unassigned DNA
cgcgcgccgttaaagatggcagacgtgactttgtgaaaaaataagaataacaaaacataaacattttgtaataataactaaataataaaagataaacttatcttgtcaaatttgaca

SEQ ID NO: 1946 - DNA, 1122 bp, Hydra vulgaris
  source 1..1122: mol_type = unassigned DNA
aaacgttatcatctatggactagaagcaacccaatgttcttctcagacggaaaaactagaaaatgataaatcgcaagtaaataatttacttagtgctatcgaatgcgatagagcaaaagtgagatctattcgccgtcttaaatctaaaggaactatcgatcctttgcttatcgagcttgaagacgttaataacaaaaatatggttcttaaagcatcaattaaattaagaaaaatcaaaaaatatgaaaatgtgtatataaatcgcgatctaacagcaagtcaaagattcattctaaaaaataaattaatagaacgaaacgaaaaaaatgcgttaagaagtgaacaagaaaaaattaaatttcattacggtatgacaatcttactcgaatttttcacaaatagccactagcaaccactaatttagcaacgtcatcaaaagtatctcccccaaaaaagacaaatattgactatactcgaataaaatctcaatttattcaagatccacttctcaacataaacaaactgaacacttcttactttgattcggataaagccgctattttccttaaaagatgtgaattatatttttctaatcaattctcagtatttcatttaaatattcgtagtattactaaaaacttcgacgaactaaaagtcctactagataatcttaactttaactttagcttaatttgtttaacggaaagctggattttagatacaacatttaatcaaaattctaaatttatattgcccaactacaaagccattagttttgaacgtaagtcttcaaaaacaggcggtggtatatgtgtctatgtgcttgatgaatttacttatcaaattagatatgacctgtcgttctctgagccggattttgaatctttcactttagaaatctacaataagtcatctaaaaatattattgtgacaactacataccgaccaccaaacggatgtttaaataactttcaaaatcacttaagtgattattttgaaacagcatgcaaaaaaaataaagaccactcatttttatttcttggagattataacgtcgactatttaaaatatggtgaaaataataaagtacaacaattttacgatagctttaatgagtttgga

SEQ ID NO: 1947 - DNA, 148 bp, Hydra vulgaris
  source 1..148: mol_type = unassigned DNA
agaagctggaatgtttgcgtatatttcatacgacaagttggtggttcgcgatggtctcgaaaacccacgtaaatatttcttttaacgttactttatttttattttttatttatcaatagtttttcaaattttaatttaacttttagaa

SEQ ID NO: 1948 - DNA, 1083 bp, Hydra vulgaris
  source 1..1083: mol_type = unassigned DNA
tgcgcgatgaaggaaagatggcggtctwaattctgagttgaagtttggtatacttttattttawcgagtcgaaatttatatttatccatctattattaaatcaatgaaaaagataaaaaattaataaagtaattagtatcaaaataatttattcgtgatcaatattaatacaaagtaaccctaaagtagcaaacaaaaaaacgagccatatttcattatccatcaaacaagaagaaaagaagcaagaagaaaagtataacataaataaaatgaggagaagaaccgaaaaaaaaaatagcacgaatctattggaaagcataagatttaaagatacttaaacctccttatttttttcttttgatgatttttggttagccacatttgtttattatttttctggactatttatcaatatttgtaggttatttattttcattactttatagaattataattatatctaaatagctaatatatctgtaatataatttattcatatatataaaatattattatatacctatataactatctatatatctatatagcttttattagtgattatataaatgtcatataacttaatctttcagtttatgttaattatatatttacataactatcattatttacataactatcactatttacataactatcattatttatcatttgaactttatttattatttgtacatttctcttcatttattcttttctttgtgcttgttttaacattttatttgtatatttatttttatttattcttttcttcatgattattttaacattcttcccaagtatattattttattattatattggcttgttagtgtttttgttagttgtcaacatctatttaatctcttcaacatcatctacttgattttgtataacctacctgtactgtgttatatatactgttcttatgcaaatccattttgcctcacaattactctcttattatattattatattattataagtttatcttatttattatatccttagtcactcctttttttttcatcaccttctgtgtttatcaataataaaacataataacattctgcctatcaagtt

SEQ ID NO: 1949 - DNA, 1081 bp, Hydra vulgaris
  source 1..1081: mol_type = unassigned DNA
  misc_difference 798: note = a, c, t, g, unknown or other
aacatacaaaatggataacgataaagtaattacaatgggaatgcttcgagaactcatgtcaatacaaggagatacaattttcaaatgctttaaggaaagttcggtcagtgtcctggaaaaagttgagaacttagccaaagrcattgaagaaataaaacgtgggcttacttttgttggtgatcaaattgagacaaagtaagcaaggttgatagtaaaatggcagaaattaaagaaactattgtgtattaaatcattccacggaaaattaagcattgaaaataaaakaaaaactgtcgatcttgaaaccgacgtaacaatttaagaattgttggaatcaaagaagaawataacgaatcttttaatgatgttgtaraaaaagtaaacctactaattaaagaagatctggaaattgcgggtcyagttattatagaaagagcrcatcgtgtcggtaaatttagtggaaagcctagaactattgtctgcaaaatattaaactggcaggacaaggaaaacatcttatccaacgctcgtaaactcaaggggaaaaatatatatattaacgaagactatagtgatgaaacaatgcgaattcgtaaagaactttttgtacaagcyaaaatacatagtggtaacggaaaatacgcgaaagtcatttacagtcgattagtggtaagagaaatgataaacgagaacgaaggtgttgaaagyaagtaatttatttatttacgttttaatagttttattagatattaaattttawggtttttatttaaggataatattaacaatgaatatrtntaaaacaattcataayaatgaagcaaatttaacaaaattaatatctccaatttttgaaattttgaaatataacaaaaatgattayaattttttgactgaaatagatattaawtgcttaaataatgaatactataaaccggaagaatttaagagaaaaaaagcttaacaaagatttaaacattttaagtataaatatacggtcaatgaacatttttattattctttaaattatctttttgacgtaatatgtatatcagaaacttgggaagatgcaaacttgccc

SEQ ID NO: 1950 - DNA, 930 bp, Hydra vulgaris
  source 1..930: mol_type = unassigned DNA
aggtcatcgcaaatggcggacgtatttttctaacggtaaaaaataaataaaagaaaaaggataagataaacagttaatttttcattttcaattcgctaaaaagtttttttaaattgttaaaaatctgatttaaatcaaacgcttaaaaataaaaatcaaataaaaaaaagaacttcgaattattaaaaaaaaagaacactttaaacaaagaaaagaacgaagaaaaaaaaaaaaaaaagaaagaaagaaagagaaagtaaacaaagaagaagaaaaaaagaagaaataagtaaacaaacaagaaagagaagaacaaaaccaattttaaagagaataaagaagattggttattcatttattttcgcgatttaatttgtaattattattttttaatataattatttaacttatttgttattttattattattattattattttttttttttttcactttttcacatattttttaattatttatttatcattaattatattcattagttctagttaataaggttttcccgttatctatctaagttgtattatcacatattatttatttatttatcattagattatctatttaggaagttttgttatatattttattatatttaaattattttactatatataattttattatattttttgatcattattataactttatcattattatatattcttatacatttatttattatggatttatattattttaattttatctattgtttattattttatcttagttattaattaatattataaatctatactctttatttataatttcgataataattaactacgtactactactgattactgttgctatttatccatttactgtttattgtttgattattttctcttttaattttctatattttctgttctataaacggctttaccatctatatc

SEQ ID NO: 1951 - DNA, 460 bp, Hydra vulgaris
  source 1..460: mol_type = unassigned DNA
aaaggtctataatgaagcctattttcggaaaaaaagttgcatttaacagaaactctattgcaggcgaacgtacggtgcgagaatcttatatctttgtaggaggggtctgtaactcaatgtcggaagaagatctatctaaccacatcaaaaatgaaataggtattgagcctattaaggtagagcttaaccgggaaaataaatacaatcgttcattcaaagttatcataaaaagtactgaaaaagacataatcctaaaccctgatatttgggatactaatattatcgttaaaccattcaggcttcatcgtgttacctcaagaaacgaaacaccacagcagagtgcagttaatacgctacactctgtacaaccaactcaacaaatattttctacatctaaagaacaaccatcctttgcacagcaacattcttactcaactcgaatactaaattctaattcaaa

SEQ ID NO: 1952 - DNA, 750 bp, Hydra vulgaris
  source 1..750: mol_type = unassigned DNA
  misc_difference 38: note = a, c, t, g, unknown or other
gggaaatttttcaagaaatgttycaaaaacaacaaaangatattttaamattaataagtggaaatttaaaactgactaatgatcgaatcgatggattgctaaaagaaattactacattaaaagaawcttgtgaawctttaaaaaaagaaaacgaaaacmgaaawgccgatcaaaataaaaacaaacaagcagttaataaagtatgaaaaaatacaaaaagacattgaagaaagtctaacgttctatcaagatagccawgataaaaaagttagcgayttagaaaaaaaaaagtcatcgaatgcaaatataggtgagaatgaaaaaaataaatttagacarctggaagatcgacaaagaagaaataatcttcgaattgaaggagttaaagaaaatgataacgaaagttgggatgatacggaaataaaaataataaacatttttgaaaataatctcaatgtaaatggagtaatcatagaaagagcgcatagaactggaattattgaaaaaaaaaaaccaagaacaattgtaattaagttactaaattataaagacaaagtaaaaattytaaaaaatgccaacaaactaaaaggwtctggaatttatatcgacgaggatttttcgctagaaactacaataataagaaaaaaacttcttgaagaaagcaaaatgcataggaaaaatggtaagtattctgttgttatatacgataarcttattgttaaagaatttataaaaaaaaaataatgataa

SEQ ID NO: 1953 - DNA, 560 bp, Hydra vulgaris
  source 1..560: mol_type = unassigned DNA
gaaagtcttaacttccaagaaacaactattatggaaaaaataaataagatcacgaagcgttacgaaaaggagataaacaacttaaataagaagacactagatttggagaatcgatctcgaagaaacaacctaagattagatggaatatttgaaaagccaaatgaaaattggaatgagtgcgaaaatgcagtaaaggaaatgtttaaaaaacaactaaaaattagtaatgaaattatcatagaaagagctcatagaataggccaacctaaagaagataagaaaccaagaacgattgtcctaaagttattaaattttcaagacaaaacaaaaatacttaacgctacaaaaaacttgcgaggaactgggatatatgttaatgaggatttcgctaaagaaacgatggaaagccgaaggatgttgtgggaagaggtcaaaaagttgcgacttgaaggtaagtatgcagttataaagtatgataaaattgtttctagagaatttcgaaagtaaatgcgctcattcttaataagaactcctttttaatttatttgtgataattaatc

SEQ ID NO: 1954 - DNA, 750 bp, Hydra vulgaris
  source 1..750: mol_type = unassigned DNA
  misc_difference 396: note = a, c, t, g, unknown or other
ggctaaaggattatcatttactcaaattaaagaattactggaaattcatgaaaacacaatattaaaaatmtttarcgataaatttgataaaatggaaaacaaaatgtaagtacttaaaagmgaaaataaaattttaaaaaatgaaatagcagatattaaaagtgcaatgacttttcataaatgaaaagtatgaaaaagagactaaagaattatacgattttaaagaacatcttaaacacaacatgaaagtaaatgaaaaagctttaaacaatgatgaatttaaagacgaacttgckgaacttgaagacagaagtcgaagaaataatttaagatttaatggaattgaagaaaaggaaaatgaaacgtgggaagaaagcgaaaaaaaaattaaagaantcttaaaakaaaaacttggtattacgaacgaaatataaattgaaagrgctcatagaacaggaaaaaagaatgaagttgaaatgaaaaaacgaagaactattattgtaaaatttttaaactataaagacaaagaaaccgttttaraaaaataccgattactcaaattatggaacgaaaaactatacataaatgaagattttagcgaaagaacaatggaaatacgaaaaaatytwtttaaagaagcaaaagatttaagagccaaaggtaagtatgctaaagttgtatataataaattagttacacgcgatttttaaaagaattaatttttttatttttggatttcgaataactaaa

SEQ ID NO: 1955 - DNA, 106 bp, Hydra vulgaris
  source 1..106: mol_type = unassigned DNA
agtccctgtgtaataagcaaaactaataataataacattacaatttcactgacaggaggtaatccactgttatttagggtggtagccctcctatccagtaatccaa

SEQ ID NO: 1956 - DNA, 505 bp, Hydra vulgaris
  source 1..505: mol_type = unassigned DNA
aggagcatgtttatgaaaatgttaaggattggtgggaggctggtaaggagagagtaaaaataatctcgaaaaaatttagcaaaagattaaaacaagaaaagaacaaaaaagaatttaaattaatcaaattattaaaaaacgcatcgaaaaaaatgcatttaaattgcaatatgaaaaaactttacgacgatttaaaagttaaacttgaaaatatagaaaaagaaaaagccgtaggcgcggcaataagagcaaaaattcagtggaggttagaaggggaaaaatgctcccatttttttttcggattggaaaaacaaaaattagctaaacaatatgtctcagaaataaacggcagagacgggcaggttaaaatcgactcaaaaaaattttattagaatttgaacatttttatagaaacttatacaaattcaaagaaaacgacaaaccttctcaagaatttttgttcttaaatgctaaagttaawaaagttactaaggaagaaaataaa

SEQ ID NO: 1957 - DNA, 75 bp, Hydra vulgaris
  source 1..75: mol_type = unassigned DNA
gggaattggaagattaacaatttaagagtagatggaattgatgaaaatgaaggtgaaagctgggaagaaagcgaa

SEQ ID NO: 1958 - DNA, 804 bp, Hydra vulgaris
  source 1..804: mol_type = unassigned DNA
cttaagcctttgagccgataagacgtgtttttgtttgagcgtaagttttcaggaattttaaatttttttctttttttttttttttttttttccgtattctttatctttcttttttacttatttttctaactttttctaaccactacttctttttctacttattgctttatctaattagcttattaattacttttctacttaaaattatagtaatatattaactattcgtgtctataatacagttttttgttgtacttcgcatacctaaattaaatataattcttatattttatacctatacttatattttattatatatatctttatttatatattactattataaaaatagttataactgagatttttttttatgcttcagttcgcttaattttttttttttttttttttacagagttataaaaagttttttttttttttttttttttttttttctttttcttcgccaaaagttgcgtttgcacctgttctttgtttttagttttctgaacaataagctaaatttttgcgctctgacacaaactatattagtaaattatatatccatatattatatataaaatacatataaaaaagttatatataaacatatacaaataatataaagaaattaaatatatacaaataaatatgataacacggaaaaaaacacatactgaatctttttagtccctgtgtaataagttatttgtcataattgtaacaaataaatttgcaataattgtaacaaataaataaacataaaaacatcactgatataaaaaaaaaaaaaattcatctgtg

SEQ ID NO: 1959 - DNA, 46 bp, Hydra vulgaris
  source 1..46: mol_type = unassigned DNA
tacaagttacaatttgtgtttgtgtttacaagttcgagtaaaataa

SEQ ID NO: 1960 - DNA, 137 bp, Hydra vulgaris
  source 1..137: mol_type = unassigned DNA
ttttttggacttttatagcgatcggacatgttataagagcttttcattaaaaaaaaaatttacggaaaaattcaaataaagttaactatactttgtaactttttgtgaaaaaagtatatttgcatagcgtaccaact

SEQ ID NO: 1961 - DNA, 914 bp, Hydra vulgaris
  source 1..914: mol_type = unassigned DNA
tggtaaagatggcggagttatagatagaattgtaaatttatcaaataaagtaatatatctttacatgacagcaattaagaggaaaaatatttatagaaaaaaagactaaaaagtaaaaaaaaatatatcggaaaattaattagaaaaccaaagtacttaaagtttagagatgtgtaagaacttcatagactcaaataaatataattaaagaacaagatacattacaaaattaataaactaagagaaagtaaagaaagaatcaagttaatgaaagraaaagatcaagagttttttacatttgttttgattattttttgctttaaatattatttgtaaatttaagtattttccaggattcgtttttattattgactttttgattattattattagcagttatcattgttattattattataattaaatatttatcattattattaaataatatagcattatttatcctatatttatccattatttacctcttattacaatttacatcataatttatcttatataaatgttatttacctaatattactacttatctccttctttacttattattacttaccttattatcatcaaattatttaaataacatatattatttatattatactatgtctaaagctactagaggtattaatatatctaaatttatattctaaatcaagttaataatattctaattttatctagctgtaatacttattctcctgtgtaaagtatttaaatctcttatatcttactatcatttctttataactgatcattcctcaatatttaaaatagcaaccatttctagattaacatttcttagttttaatctctcagtttctttataaatatatagtagatatctttatttaattattttttctctatactttgtttaagcataataagtc

SEQ ID NO: 1962 - DNA, 97 bp, Hymenolepis sp.
  source 1..97: mol_type = unassigned DNA
ggggtgtgcaatagacttacctccacgtggtgcaccctgggaaacgtatactcatacggcaaaaagtctataaatcggcagttgacttcaaactact

SEQ ID NO: 1963 - DNA, 100 bp, Ixodes scapularis
  source 1..100: mol_type = unassigned DNA
catttggccggcagggtgcgtttttcgcccttttttcggcattcttaaagaactctcggacacggacacctcggtcgatgtaaacgcataatcaggtacc

SEQ ID NO: 1964 - DNA, 581 bp, unidentified
  source 1..581: mol_type = unassigned DNA; note = Description of Unknown:Locusta migratoria sequence
aggatgtcggatgtgcctttaatagccaggagatcgttctgattgtctggctgccagttagcgctagttcatttagttcacgttttacaacgctatccggggtgcaccacggggaggcgaactagcattacacccttacaaacgcccgacttatagatagcacgcttgccgcagaacattccaggtgacagtgggggaccaaatatgcccaaagaaccctaaacaacggattaccacagggctccgtcctagccccattgctattcagcatgtacatcgctgacatgccccaaacaactccagaaaatttgaatatgcagacgactgggcttagcgtcaacataagagctttgagacaatggagtgacctcgtcgtccaacttggcgactggcgcatatttccggggccgagcctacaaaacgggacgtgcttccatatctgtaataaatcagcaggcagacgacgacgtctactttgagggaactcgctccggcataacggtatccaaagtacctcggagtcacattagacagaaccctcacctataagcgacatctggagaacactgcagccaaactag

SEQ ID NO: 1965 - DNA, 157 bp, unidentified
  source 1..157: mol_type = unassigned DNA; note = Description of Unknown:Locusta migratoria sequence
cgactgttcgcgtccgtagcaatcctcaagctacacgtgtcccctgggtggtgctaaagaacagtcacttcgaggcacgaagtcagagccagaagtcacggcagccagaccacttgtggactgtcctggctatcaaacacttgggctgattaatgca

SEQ ID NO: 1966 - DNA, 1745 bp, unidentified
  source 1..1745: mol_type = unassigned DNA; note = Description of Unknown:Locusta migratoria sequence
cccctcaggggctcagcattaatttgctgagtacgggcttggcgaacccggggtcctgagccgtgggctgtgtcgcgccaacagtccgctacaccgtaagctctgtgcgtgcttcaacgaccatcgttcggcgcgacggtggaacgttgtacgtttcagagcccggggatcttggcttaatcgcccgggtcgcgaggacggtacaaacctctataaaaaaaaaacctcaatctcaaggtgtgctactgccgaggagatgcatggctgttgaggttgaacagtcgctagcgagcaacctctgaggaacctgccgcacctcagttgtataaggcttacccaggcaagcggggctctgcctgggtggacttagttccctagctgctcgtgggacgaaatgaaacgagccaaatagcgtggtggacgtaaaccaccgtctccaagcgtggaagagttgctttaatgcagcgacgtatgatccccgaacgttcccttccctggccacccctgggaggaacggcgggctaaagacagggatgagcttactccccaagtatcttgtttgcagtcgaacagatggggaaactttcatgtcgacgaagccacttttcttcgtgaaaaccttgaagataagtttggtgaagtctcggatgtcaagatgaggagcggttcggtactgatcgaaacagcgtcatccgcccaatcgaaagcattgcttgcttgcgataagctgggtgacgttccggtcagtataacaccccacaaatcgctaacatgatccagggtctgatctatcacagggaccttcttttacagtcgatgagagctacgcgccaacctagagcgacggggtgtccacttcgtccggcgcgtgcataggggtccgaaggataatagggtagccaccggtgctttcatcttggcctttgaggcgatacattgcccgaaaaggtcaaggtcatgatctaccggtgtgacgtaaagccttatatccctccccctatgcggtgtttcaaatgctggaaatttggacatatgtcctccagatgtagctccagccccacatgtagggaatgcgggcgtccatcacacccggacgctccgtgtactcctccacctatctgtgtaaactgtgggcagcaacatccaccctgttctccagactgtaccgtgctccgcaaagagcgaaagattatggaatcaagaccctggatcgactgacatatacggaggcacgtaaaaaatatgaacggcttcacccagtttccatgacgacgtctttcgctgcagttacatcgtcgccacccttctgataacacctaccgtgcaacaaccttctgtgggcccaaagggccgtcaaagctcatctgcctcctcaaggtcgggggcactcctctcactgccccccactaccacctggggggcaactccacccccaccatcggggacaccagtccccacctcccagccggagaaggagcagcctcctccggctcccctcgctcggaaggggtccctcggggcactcccttctgaggcttctcctagtgctccagcgatccagccaatggctgaaggatccaaaacctgctggtagaagggcttcccgctcttcttctacccctggcgccgctacagagaagccctcccggccctgcaaacctaagggccagcgagagggacggaagaagaagacaaaagactcttcggtggctctaagccaccgctactcatctctacatcggacg

SEQ ID NO: 1967 - DNA, 47 bp, unidentified
  source 1..47: mol_type = unassigned DNA; note = Description of Unknown:Locusta migratoria sequence
gagcgaaaattatagccttactmaaccagtagcaaacsaagtgataa

SEQ ID NO: 1968 - DNA, 523 bp, unidentified
  source 1..523: mol_type = unassigned DNA; note = Description of Unknown:Locusta migratoria sequence
atgtacatagtcagaagtgctcaactgaacagcacatgtcctcttctcaatcggaattacagttactcactatcaatatgacacgtcatcgtgatgggagaccttaacatgacttgttaagagacactccatccacaataaactaagagattgctccaacaacatgaacattctgccattagaacctactcaccatacggagcacactcttatagatgtgatcgcaacgaaaaagatcgacaaagtacagatctaagtcaaacgtcagcccgcctctcagcacacgatgcagcgccaaaagttaaatcacgttatattactcgtagaaacgtgaaacaaatagaccgtgaggctctaacagccaactgctcagaaatctcatggcatcaagtaaccagagaacccacgattgatggaaaaatttttgaacttagaataaacttatttcctatatgacaagcatgccccctacaatccgtgtaagaaaacccctgctccatggctgactaaagaattacgtcaa

SEQ ID NO: 1969 - DNA, 1080 bp, unidentified
  source 1..1080: mol_type = unassigned DNA; note = Description of Unknown:Locusta migratoria sequence
tcgtttcagaacctggtctaacagttacttcagtaaatatagaaggcatgtcacaatccaagcaacagctgcttcaagaactgtgccatgaacagaagtttgatgtactgtgcatacaagaaactcacagagatatccatcaaatgcgaccgacaatacctggtttgcagctagctgcagaagtaacccatgctaaacgtggaggtgctgtttttgtcaaaccaggaatacgagtcttgagtgcatataactaaatgacaataacatcgagatcatcaccttggaacttagtaacagtgtgatcacttcggtgataagcggtcctccttccgaaaattctccttgctcctctaaaaacttcattcaggaaaaatatcttggtaatatgggatatgaaaatgtgaacccgttatgtctcgagctgaaaccaacacccwcactctcactcacgacagcaaactacctcatccttcaaagtgaaggtggcaacgtgacctctatttgtgagtgaaactagccaacagtgttacaatcaatgtgtaatttcatacccaccacacaacacgggtaccaataatgtgtcgaattcttcccatcataagaccccaagaaactggttttagacgaagggatagtttcaaaaaggcagattggccgaaattctccaaaatgctggatgaaaaagtttatacacttagcctgtgcctgaaagtatgaacactttttgagctcttaattcctcgcgagcattatcccaagagctgcaaacaaactacctgagggcattacttcagaaacagctaccttgctcgatattatacccaatatgataatcccattcagtgatgaaacccaaaacagccagatccgtcctctcctcagtctccgaggcaaagagagtacaatgcgagaaactcatggaagactgtgatatgagtagaagtagtcacaaggctggaggcttctaaaggcttaataatgacccttcacaggaatatgcaggaatattcgatctgataaaattcatacatgaaaacacctcattcaaccaggtctggtaagaagacatgtgagagataa

SEQ ID NO: 1970 - DNA, 295 bp, unidentified
  source 1..295: mol_type = unassigned DNA; note = Description of Unknown:Locusta migratoria sequence
aagttgtttgaacattcatatgcgggaaaagttattcacattgtttttacctctacgggaggaaatgtatcggtgtttacggaagttggataaactccgcagcagtagagtaaggttatgtgcttgtcgtgttgaagtgtccatattgttccacgtttgctaaggttgtgcaccatattaattctcctgccgccacgtatcaagcaacgtgctgcttagctcttgttcgtgaaaggatccactttatcgtcgtcaattagattttgtttccaaggagttatttcggcttcattta

SEQ ID NO: 1971 - DNA, 203 bp, unidentified
  source 1..203: mol_type = unassigned DNA; note = Description of Unknown:Locusta migratoria sequence
acgagtactactaaaaggattgcaaagaatactcacggccatcccagtagaaaagccggctttcgtsccagccgaagcgtgcagaccaagtcctgctcttactacacatattgaagcagcttccaaaagaaattaaaaactctgtggcctttttgacttgtcagcagccttcgataccgcctgggacaaggcctgctctataa

SEQ ID NO: 1972 - DNA, 178 bp, unidentified
  source 1..178: mol_type = unassigned DNA; note = Description of Unknown:Locusta migratoria sequence
gtattctgaactcaattgatttagtgaacaagttaaaagacttccctatcccccctagtgccaagctaatttcttttgatgccagcagcttattcactaatataccagttggtgagtgcctaaacatcctcacagacttactggataaatcaggagttaatccacttgtcacagatga

SEQ ID NO: 1973 - DNA, 483 bp, unidentified
  source 1..483: mol_type = unassigned DNA; note = Description of Unknown:Locusta migratoria sequence
tcaaaataaaaatagtgtaaagataacagacaataaggaactcaaggcgaaaactgaagcagtgatgacgaaagaagaaattttcatattgtcaacaagtcatggtaagggttagcaaaaataatgtcgatatccaatcagaatatagtcagtggaatctcaaaacctggagctcgttgcgagaggtactgaaaaacagtgaaactactgtaaaaagtggagtgactgtgtagtaattggtggtggtaatgatgtgtatagaaatgagagcagccttgccgtgaaagcacgagagaatcactaggaaaattgtcacaagcgaaggtatttttggtaagcattcctcatagacatgaccggagacgattcatgtgtaaataaagaaatcgtcacaacaaacaggaaattcaggaagatctgcagcagttttgtgcacactacctttattgaggctactagctctatcagagaacattttagaga

SEQ ID NO: 1974 - DNA, 933 bp, unidentified
  source 1..933: mol_type = unassigned DNA; note = Description of Unknown:Locusta migratoria sequence
ccccccagggggcccacagctcttttgtgggtacgtgtgtggcgcgcacgggtccccgagccattgcggccttccttcctgtttcccaggccgcttttcctcaccccggttccctcccctccctaatccttcttcccaccctacccttctccaaccccgtctctaggtgttctcgcgatgacggcccggctatttccacggtactgctggtttcgcaattgtgtctttgtttgccgttttcaccgatttcggcccagttaggtccccctcggggtttgacctccatcaaaatttcagagtaagtgtgagccatttggggaagaactcccaacctagcccctacggcgcggattcctaccctttccttccaaatccctcttcctcgccgtagctccctcccccgctaggtcaccagcacggtagccagtccgtgtggtggggctgttatgtaccctcatggttgagccccctgaattgcacagggatcacactgccgatgcctgagctgtgacctcctcatgaatgccaaggagtcgatgcttgtctctgcggggcatcaggactcccagcaacggtcatcctgccaggtggcgttgctgtggctgggtggcgcccttgaggagagcccctgtttcggagtgggtggcatcggggcggacattccgcaatgaagaggaaacaaacctctgaaaatcctggctctaagtcaggtgtctcaagtgtggtaagtttaatttcaatgctgcaagatacgaccccaaatcgtttccttccctaactccatcatggggggaacgtgggcccacaaagcagactgaaccatactcaccacgatacctagttgttaccagacaggatggggaatctttccaggcaactaagccttccttcttcgtcgaacacctcgaagaaaggtttggagaagttgccggt

SEQ ID NO: 1975 - DNA, 347 bp, unidentified
  source 1..347: mol_type = unassigned DNA; note = Description of Unknown:Locusta migratoria sequence
gggtacgacgtgtagacaacctccccgatggtgtaccctgggcgctgtaacatgggacagcggcgaaaagtctacacaactatggcggccggacgcacaaatgcctcccggtccactcaaaggcaaatggagcaagcaaggaactttaacatgaagagactgaatgtatgtcatttcaacatagaagactacacaaggacgaagggagaaatccttgaaaaaattttaacagagaacaagtaagtgtcgtacttctacaagagacccacctcacagatgaaactatcgaccgactcaaaataccgggattcactaatgtgagctacattggccacgacaagcgtggt

SEQ ID NO: 1976 - DNA, 39 bp, unidentified
  source 1..39: mol_type = unassigned DNA; note = Description of Unknown:Locusta migratoria sequence
ggacttccctcatagccaacaccgcccagtcttcattga

SEQ ID NO: 1977 - DNA, 48 bp, unidentified
  source 1..48: mol_type = unassigned DNA; note = Description of Unknown:Locusta migratoria sequence
aaccattaaattacccatttcaggctgtaatccctccctccacaatga

SEQ ID NO: 1978 - DNA, 151 bp, unidentified
  source 1..151: mol_type = unassigned DNA; note = Description of Unknown:Locusta migratoria sequence
gccatagccggtcccaagcccggttgagaaaggaggagggggaggagtaacacctcgtaaaaaaccttggttcacctggcccgggtgatagtacctgtgagggccccttgccagggatacggtgaagacctcaacggcagtgaaggcggag

SEQ ID NO: 1979 - DNA, 158 bp, unidentified
  source 1..158: mol_type = unassigned DNA; note = Description of Unknown:Locusta migratoria sequence
cactcctagggagctaccagtttccagtttcatcagctctgtggagcaagtagtcaacactctaccatcagtgttgcagaagagatcggagagagacgcagggcgctaccagagcaggccccaaaacaaacatctcaagagacgagaggtggcgctag

SEQ ID NO: 1980 - DNA, 481 bp, unidentified
  source 1..481: mol_type = unassigned DNA; note = Description of Unknown:Locusta migratoria sequence
gccctagctaagtctggcattgcttccactacttgtgtcagacttctgctttcttcgttcctatcggcctctcttggtcaactctgctgcttcgaccccgacggtattaggttgcgaggccgagggtgctttcattttcttttctaacacatggctgttaaccgaatggctcccggtataaggagaccaaccttaccaagtgccaacggccagtaaggggggatgagcggtaaagaaggggcacctccttgtccagggatgagaaattgtccctaaaggcggaggaaccattaacatggtcaacggcaggaggatgcagaaggcaacgggaaccactgcattaacgatcccatacaggattcccaaatagaaatatggctacgtccaattcaaaattttccggagtttcaattcccccattcggatctccgagggaaatgtcttgagcaaggctgtaaggagtaaaggaataaaagaacag

SEQ ID NO: 1981 - DNA, 453 bp, unidentified
  source 1..453: mol_type = unassigned DNA; note = Description of Unknown:Locusta migratoria sequence
tttaacagatgccggaatgaaggtattgttcctaagtttgctagaatagttcactaattgattctaatgcacaagattaagaagctgccagtcttgcgctagtacgtgaacgcttcgttttactcgtagacaactggattttgtttccaaagacttatattttttgcatcttgagatttcatcacggctttcggccgcgtcatgggagtgggttgatagcgcttcttgggccttttccgactcggcacagaggggtgctgcctgcaaacagttatcaaatttgagcgactttgcactcaacagacaattctggtgacgatttccgtcggcgggttgtgtcaatcttacagataaggaactggacaacgctgcattatcggttttggaaaaaggtttaaattttgcacccacacctaaggttgtccctattacggaatttatttgtgctgttga

SEQ ID NO: 1982 - DNA, 30 bp, unidentified
  source 1..30: mol_type = unassigned DNA; note = Description of Unknown:Locusta migratoria sequence
agaggctgccgtacctcatacattccgggc

SEQ ID NO: 1983 - DNA, 888 bp, unidentified
  source 1..888: mol_type = unassigned DNA; note = Description of Unknown:Locusta migratoria sequence
ccctcaggggctcagcattaatttgctgagtacgggcttggcgaacccggggtcctgagctggggactggtaagcgccgccagtcctctagacaccgtaacctctgggcacgcttcagcgaccaccgtgtggcgcggcggtggaacgttgtgtgtaccggggaatggggatcttggcttgaccgcccgggtcgcgaggatggtacaaacctctataaaaaacccttcaatcccaaggtgtgctacgtgctgatgggatgcatggctgttgaaggggaacagtcgctagcgagcaacctctggggatactgccgcacctcagttgtataaggcttacctaggcatgcggggctctgtctaggtggacacttacttccctagctactcgtgggaccgagatggaaaaattctaatttacccatgaacctcctagtgggatgggtgtaccactggggggtaccaacacccaaccaamcaagagggctmgggtagccagtcctccggattcaggttctcaaaaaaaagtttagtttatagtaacagaacacatgctgctmmacagaatgtgtttattgtcgtgaagagaaaagagggctcgtttgagaaggtgtcgcccttctatatccagaaaggtctcgagggaattgctggtgmtttgaaatcagtaaaacggttgcgtaatggsacattgttggtggaaacatcaacttcccaacaggcggccaacctacagacggctaagtgccttggggaatatcaaatcgagacggagctgcacaacacccttaactatagcaaaggcgttgtcacctgtagggatctggtggacattccagcggatgaactgaaggatgagtgggcttcagaaggcattgttgatgtgcaaaac

SEQ ID NO: 1984 - DNA, 171 bp, unidentified
  source 1..171: mol_type = unassigned DNA; note = Description of Unknown:Locusta migratoria sequence
gttcgtaagtttcccaggaacagaatggaaacgcccattcttgtaaaatcgaacctccagccaaactgacagctgaactccgtggcttctctccgatcctctcacagtgttctgccagcgataagggatgctacctgacgccgattatgatggaaaaccgacagatgttga

SEQ ID NO: 1985 - DNA, 991 bp, unidentified
  source 1..991: mol_type = unassigned DNA; note = Description of Unknown:Locusta migratoria sequence
gacgaacaacatgttacggaatagcaatgtatgtcaggatgaacatagctgattatagagtggtttctaaggactctacagacaacatttatatcttagcagtgacgatatgtggaactactattgtcaacatctataaacccccattagtcatctggcctacgcccccattcaaactttttactgaccctgccatctatgttggagactttaatagccatcaccatgcttggggatacaagaataatgatataaatggtaacattttacatgactggctgtccttgaataatttgtatctggtctttagtgcaaaggacaaaggaacgtttcgatcagcaagatggcagaaagacacatcaccagacctatgttttacactaccagtcaagctaatggaaatcaactggcaaacaggaaagttatagattcttttccacatagtcaacatacgcccattatcattgactatggcatccagataccattagtaaattcaactgccaaagctcgttggaattttaaaaaagtgaactggcaacagtatgctgacaaacttgatgtgactgttgactcatccctgtgcaatttaataactatgacagatttgctaaagctgtcagagaggtagcaaaaagaacgatacctagagggaggaaacaaatattccaggatggtccaatgatgtgatgagctatatgaggaatacaacttacacattcaaataaaacagcagacgaacttcttcaagctttgaatgagcacagaagaaggaaatggcaagaagctacagagagcctcgacttcacccattcgagtcgtaaagcgtggcagctattgaagaaactgggtgcagactaagcctgagagatgcaccataacgtcacacaaatgaagtcgcgacacgcttattgcaaactctaaagcatctgtgaacaagaaccgcactaggctggtgaagaacagttacgatccaaacgctctcagctag

SEQ ID NO: 1986 - DNA, 340 bp, unidentified
  source 1..340: mol_type = unassigned DNA; note = Description of Unknown:Locusta migratoria sequence
aaaacggccttgactatgcaaaaatgaagttcgcaaaccagaattgctttgacgtagctaacatagttagtaataattcatcaaatgctgtgtacatgatagttaatcttaaataataagctaaagaaccgatgctttaataaccaaatctgacaaaggttgttccttggttattgctagcaattctgaatatgtctctaaaaccttagaattttttaatgaaaataatatttcggaactgcacgaggacccgaccgcagaattacaaaaagaagtcaggtcggccgtcagtgatgcaaaatatttgcttaagccatttcataaaaaaactctcgttaat

SEQ ID NO: 1987 - DNA, 59 bp, unidentified
  source 1..59: mol_type = unassigned DNA; note = Description of Unknown:Locusta migratoria sequence
tagagaaacagtaggaaatgaaaaagcctgcatgaggtgtcaaagactataactttgcc

SEQ ID NO: 1988 - DNA, 642 bp, unidentified
  source 1..642: mol_type = unassigned DNA; note = Description of Unknown:Locusta migratoria sequence
acctgttacgctgtcgtaacaggcggagaggtgatactccgacgtggcgcgtcccaggtggcggatakgggggtcctaactggcttgccagcggacttgagcgaaataaaatagctctcgcggaccaaacacaaaccctctggattaacactccagttgtatctcgagcaatcctcggaaagctccaccactccaaccttacaaatkttatggattatcagtggaaaagaaaacaaattaccccagggagtaaaatctctcgacctccggtcgcaagcaggcatttcggattctggggagcctgcactttctgctcttgttttaccaagacaacctgaaaaacttaaattcaagamgaaatacagtatcggaacactgaacattaactcgctcatcaaaacaggaaaacataaagaactgactcaagcacttgagcatcatgatatccaaattctggcactacaagaaacccgctacactgacgaaaactcttttgaaacaggcaactacagaatttataaaggaaaaccagcagagtatatctttggaaaatgccccttattaggtacagcttttattgttagaaaaaatataacggagtccgtaataaacttcaattctacgtccaacaggctctcaaca

SEQ ID NO: 1989 - DNA, 414 bp, unidentified
  source 1..414: mol_type = unassigned DNA; note = Description of Unknown:Locusta migratoria sequence
agtcgccgagtggacgtcgtccagtgcacacctgtccagcgccagcacattttcagttgtaagtgtaaccggcttctctctagaagctacatattttgacttttcagtgcgctttcccttcagttcattaaagttattgtgtgctcgcgtttttatttgattcatattcacgttaaatatctggttagtgtattattccgccgtgtgaatcgcgtcgcgacagtcgtctgtctttgttttctgattagaagcgacatatagtattttgattttcgtctgcgcgttctcgtttcagtttgtaaatttatactgtgctctcgtgcatattagattcaaatccgcgttttaacaaacagtgtagtcttcctttgagcgcatcgcgactgtagtttttgttttctcggcactgtaatc

SEQ ID NO: 1990 - DNA, 351 bp, unidentified
  source 1..351: mol_type = unassigned DNA; note = Description of Unknown:Locusta migratoria sequence
ctctgaaagtactggagattctaggaaacgccaatacggtcctagaatcaatgaaaggaaaatcctgacattcacctccacggggtagagagggggcaacgtttgcatagcaagcggctaacgaatgcagggaccgaatatcccccgggataaggggatcccctataccaagtgccaaaggcctccatgagggcggatgagcgggtataggatagggcactctcttgtccttggagtgtgaaatcgctcctaaaggcggaagaaccagcaaggtcaacggcatagaatggagaaggcaagagggaaaccactccattaaagatccttttggatatcccatgtcaagcagca

SEQ ID NO: 1991 - DNA, 848 bp, unidentified
  source 1..848: mol_type = unassigned DNA; note = Description of Unknown:Locusta migratoria sequence
gatctttggcgtgacgtcacagtgctggatgctgtgcacatcgctctcgattttttataattttaggattaatatagttattttaattgttatttcgtgataatattcaatataaaggtgttctagaaaaggatcgtcagtaattttagcgtttgtagtgccgtattgctttaagtggtgttatttgtgttcgcgtgtgcggcaccgacgtcttactgctttgtttacatctggtggcgagtggttccagccgtagcggtctccgaaagctaagttccaataagtgtttgtgttattgtagttaaattattaaagtgactagattcaggaggtgttatcacgctagttgtttattaaatttagtacttttcaacaggtgacttgctgtttttaacgtagttgaggttgggaaactttaagttacggtatttgataactcttktactctcactgtgtttagttagtttattagtgacgcttgaatttgaacttgtttatacaagcaatagtgtaaagtttcatgtggtagtgttatttgttcttttctgatactattagttgttgttacttgattttgtagagactgaggtttgttgattgctgtagttaagaggtacttcctagttcttttgtagaaacgtaacttaataacttagacgtctagttttttaaatattgtgaaattttaccatgagtgaaaaatgtgggctctgtcgtagggtcgtgcgtagtgggctgcagtgtgggatttgtagtaagtattttcatggggggagtgcagtggggaagacagtgggcattgtggtgaggttctctcctggaactgtaggatttgcagcaggaataag

SEQ ID NO: 1992 - DNA, 237 bp, unidentified
  source 1..237: mol_type = unassigned DNA; note = Description of Unknown:Locusta migratoria sequence
cacacatgtagtgatgactgacactgttatcaataagtcaaaaagagtattgctcaagacgagatttccgtccttacaaaaggtggaaactatgctataacgcctgtggaagtacagttgaggatattattgcgaatgtgaagcaggaataagaactctcccgaaagaaactgcaaatgcaattcggattgaaaccaccagagtactatgtcgcagtaacctctgaaaagtaatttg

SEQ ID NO: 1993 - DNA, 268 bp, unidentified
  source 1..268: mol_type = unassigned DNA; note = Description of Unknown:Locusta migratoria sequence
cccgtgtggagtttgctggtcttccatcgggcacctccccaggtggcggataggggaatgctcaccagatatggtgggtaccggggaaataaaatacccggggtggaccaaaaccagcaactgctgccttgtagtatgatattggcttatcaaaggctaaaggaagaaaaccttgaatacaaattacctggtcctccaggttgggggttgtgcagtgggccagctcctcactcacataaaaatataaaatgctaaaaaacctaataat

SEQ ID NO: 1994 - DNA, 147 bp, unidentified
  source 1..147: mol_type = unassigned DNA; note = Description of Unknown:Locusta migratoria sequence
aaatcacagtaaaagtagctaatgctctagaaaataaatctaactacatgtatccaagacacacagaatttttgtaatacagaacgatcaactctaaaaaataaaccacaagttaggcaaataatgttatagaaataaagctgataa

SEQ ID NO: 1995 - DNA, 520 bp, unidentified
  source 1..520: mol_type = unassigned DNA; note = Description of Unknown:Locusta migratoria sequence
ccctcggaataccaccttaacgttggtggggaggtttgtgtgtgtcagtgatccactgagctatgctggcgggagctgtgctcccggtagggtcacccatgccagacaggtcagttggtgagattccagacaaagagtattccccctagggggctcctgccttgggagtatgtgggtggcaaccacatgggcccttagctaagtctggcattacttccacttacttgtgtcaggcttcctctgcattctttcctatcggcctcccttggccaactcttgatttttccgaccccgacggtattaggtttcgaggcccgagggagtctttcattttccttcttctactcttattgtcaactgctgccttgtagttagaagtgggaacttcaaaggctaagggaagaaaccccgacagaaaatcagtaggcctggctacttagaaggcagccccttcaccaggctatgggtgctgaaggctaataacctacacacccgagattaaactattacagaaacatca

SEQ ID NO: 1996 - DNA, 174 bp, unidentified
  source 1..174: mol_type = unassigned DNA; note = Description of Unknown:Locusta migratoria sequence
ggtggtgctaaatgagtaatagcaacaagatgagacggaactgcccgaaaaggcctcccggtcaaagagtgcagagcaaacaacaagaagtccttttcaggatgcacaagttcgtagaattggaccatctattcgcatactccaactkaacatagaaggaataagcaggtcgaa

SEQ ID NO: 1997 - DNA, 623 bp, unidentified
  source 1..623: mol_type = unassigned DNA; note = Description of Unknown:Locusta migratoria sequence
cccctcaggggctcagcattaatttgctgagtacgggcttggcgaacccggggtcctgagccgtgggctgtgtcgcgccaacagtccgctacaccataagctctgtgcgtgcttcaacgaccatcgttcggcgcgacggtggaacattgtacgtttcagagcccggggatcttggcttaatcgcccgggtcgcgaggacggtacaaactctataaaaaaaacctcaatctcaaggtgtgctacgtgccgaggagatgcatggctgttgaggttgaacagccgctagcgagcaacctctgaggaacctgccgcacctcagttgtataaggcttacccaggcaagcggggctctgcctgggtggacctttagttccctagctgctcgtgggaccaatgaaacgagcaaataaagcgtggccggcgcaaaacggcgtctctaagcgtggcaaaacgagttcaatgcgtcactatgaccctaagacgtttccttccctgccaccccgtgggaggaacgaagggcccttaatagatcagagccatactcgccacaataccttgtatgtgcgcgttcagatggtgaatccttcatgaccactaagcccagttctttgttgaacagctga

SEQ ID NO: 1998 - DNA, 1043 bp, unidentified
  source 1..1043: mol_type = unassigned DNA; note = Description of Unknown:Locusta migratoria sequence
caagatggcgccaggtggaaagtactcacgtaacgacgagatttcatagtgacgtgtgtaaaatctgcgaaaaaaagttaaaagaggtatcgtatgtgttgactgcaagtcttggtatcatgataaatgtgtaaaagtaaatctaaatacataaaagagatcatgactggcatgccggcagtgcattgtgaatgccacgaaaagtgaactagtgaatacactaaagtcaaaagaagaaataatacgtgtgctgacagacgatttagtggctataaatgcaaaacaccaagaacttctgaataaatatcaagaactagtaacgaaacacaaagaagtggagcaaaatcattgccaagaacaagaaaatattattgttaatggacgttctgtgcgactaaggtggcatgtaccaaataaaaamtgcaaacaaatgataagtgcagctccggcgttaatgctttcaaataaattgccggtatagaagattttggctctgaaacagaagtcgcgaacgatctccagtgacaaattaccatcagaatgcagtacaagaaatcgaattctattgcaaaacgtgaaaaaacgggttctgatactggtgacagccacaccaggaaaatttccgagaaaataaatgaatataacacactttctatggccacaggaataacaaagccgagtgcgcctctatgtgagatactgagaaacagtaactcagtctgtgactcactaataatgattttgtcattatcatgggaggcagaatgatgtctatcgaaatgagagtaaaaatkccacacggtgtttaaaatctacactgcgtgatcttaaagtgccaaaatcatagttactagcatgcctcacagatatgacctgcaagaaaactcaattgtaaatatggaacttgcaaaaataaacagacaattccacaaaatgtgcaagtccttccaaaacktaacgttctgtgagcttccaaattcaagagatctattcacaaaacatggacaacactasaacacgctgggaagtcatacattggtaaa

SEQ ID NO: 1999 - DNA, 432 bp, unidentified
  source 1..432: mol_type = unassigned DNA; note = Description of Unknown:Locusta migratoria sequence
cccctcaggggctcagcattaatttgctgagtacgggcttggcgaacccggggtcctgagctggggactggtaagcgccaccagtcctctagacaccgtaacctctgggcacgcttcagcgaccaccgtgtggcgcggcggtggaacgttgtgtgtaccagggaatggggatcttggcttgaccacccgggtcgcgaggatggataaacctctataaaaaaaaccttcaatcctaaggtgtgctacgtgctgatgggatgcatggctgttgaggtggaacagtcgctagcgagcaacctctggggatactgccgcacctcagttgtataaggcttacctaggcacgtggggctctgtctaggtggacatttacttccctagctgctcgtgggaccagcatgaatatttctttgtttttcccctcccagtggg

SEQ ID NO: 2000 - DNA, 131 bp, unidentified
  source 1..131: mol_type = unassigned DNA; note = Description of Unknown:Locusta migratoria sequence
gagaagcctccccgcggaacatattaatacgttttggcgtctcccgggacggcggcaaattcctcaaaccagaacatcaacacagtcattaaaatgcctcataaagaacccaaaagctcttttcagaacca

SEQ ID NO: 2001 - DNA, 299 bp, unidentified
  source 1..299: mol_type = unassigned DNA; note = Description of Unknown:Locusta migratoria sequence
gggggtcacagcagaagcgttcccgttcgcgacccctgtcgagtctgataccagtctggtatcagtccgcgaattctgctacaagacgagctacatcggatcaatatgccgaaacaaaaagatagccaaaagagtggactcgttttagagcccacctgacaattatttcgctaacatcgaaggaatttcagtatccaaacaagatttaattgcagaaatctgcagaaccaacagctgcgacgtcctgtgcctacaggagacccacaggggcctctcaaaataagccaaacattgtaggt

SEQ ID NO: 2002 - DNA, 444 bp, unidentified
  source 1..444: mol_type = unassigned DNA; note = Description of Unknown:Locusta migratoria sequence
ttctcggtattgtaatcatgaatagggactgtgactgctgtgtgcggatgcagtctgagctggtgacacttcgctcccagcttcaagctggaggctgcggtcgaggggcgtcgttgttgttggccggtcgtgggacaacggatccgttccaccgatcggcctgcggcagcgacatgccctgatactgccagcaatgaggcagacaccccaccgtggttgcgtgggaggtgtccagtgcgtggcaggcggcgaagacattccgggggaccgatcgtgaggcctccccggttcgtcttgcgaacaggtttgaggcgctatctgttcggacaatgttcctgagccggatggtgtcgctcatcctgaagtcaccacgcagcctgcagatccgggctttcacagagggtgggtttgcttgtagttgggagctccaacgttaggcgggta

SEQ ID NO: 2003 - DNA, 215 bp, unidentified
  source 1..215: mol_type = unassigned DNA; note = Description of Unknown:Locusta migratoria sequence
cttgatgaagaaagacggatatataaataaaacgcttgacttctttaamtgcaaataacattacacgtatagacaaagaccctacaaaccgatttcaagctttgataaaaagagctataaaaatctgagtttcttttaacacaaaaagaacaaaacagatatatagttgtgaatccacaatgccccaagctcagagcacaaccaaaggtccataa

SEQ ID NO: 2004 - DNA, 118 bp, unidentified
  source 1..118: mol_type = unassigned DNA; note = Description of Unknown:Locusta migratoria sequence
gggggcgaagttgttcgcgtccggaagcaatcctcaaagctccacgtgccccctgggtggttctaaacggacaacaatctctggtagctggtcctgtcaccacggtgatctcccagct

SEQ ID NO: 2005 - DNA, 425 bp, unidentified
  source 1..425: mol_type = unassigned DNA; note = Description of Unknown:Locusta migratoria sequence
aatatgataaacaaattagaaaacacaaatgtaacaatagtaaatcaacctcgcgacatgacgcgtaaataaattaatagaaaaagtaaacaaagaaattgatgactatgcaaaaaatttcggtatgtaaacttgattgatgtaagcaagttagagagatctatgcataccagtcatggtcttcatctcaattacagtgggaaacagttcttagctgaagaaactgtaattcagtaaaatttaaccacaagaggtttaatctggaagctgtacaaagtactttggacaaatgggtagtaaggaaggaccaggtctcccagttgtcaaatacgtggccccagtgactgaagaaactaatgctgctgcaagacctgaagtcctgaagacgccagcccaacaccaaaatggttttctagacaaaataa

SEQ ID NO: 2006 - DNA, 610 bp, unidentified
  source 1..610: mol_type = unassigned DNA; note = Description of Unknown:Locusta migratoria sequence
ggggcccacagctcttttgtgggtacgtgtgtggcgcacggggccccgagccgaagcagccttccttcccgccccaggctgcttcagtccccccccccggtttatgccttcgcccggagacgggtgtcccgtgtgagtttaggtggtctcatgtaccagcttttttcttttctcggtttctcttctcctaacctttgcttccgcctttccctccttactgtactcttctagccttcctctcctcctttagtctccgcctcggcgtttgagactcaacctttcccacttccttcttctttccttctttcctctttcttcctccctgtgcgttcctgaaggccgcccacgcactcgctgcgtaacaggtgactgggtaatgcgtaagtcccagccccgggttggcatgtagggcccgcacgtaccccctggtaaaggccaggcccagggaggggtgattacccgagctgataccttccgaccgtgccgattggtccctccgtccgtttctcgggaggtgtgacctgaggtgtggacaatcacctaaggcgggtgagccctcagtgagggttccccattaggaaggagcgcgccatcggagacgccggtaatc

SEQ ID NO: 2007 - DNA, 176 bp, unidentified
  source 1..176: mol_type = unassigned DNA; note = Description of Unknown:Locusta migratoria sequence
ccaaaccatcactggaacaacaaccccactagaagcaactccataattgaagtacacagtcaacaaaaactgaactaccagcatcagaggcaactgctatgcctcagcaccactgacagcagcaacaggaccaactgcaacaccaacccaacattatcaccagtaacagcagctaa

SEQ ID NO: 2008 - DNA, 605 bp, unidentified
  source 1..605: mol_type = unassigned DNA; note = Description of Unknown:Locusta migratoria sequence
caaaacggcggacgactatagggccatcacagcgaagtttggggcgcttgataagcccttctatacatttccttctgccgccgacaaaacattgaagattgttttccgtggcctgcccagtaattacagtctggaacacataaaacaacaattgtcggacatggggtatggttttcgactccgctccgtgactcgggtgaattctggacgaacgaggaaagagacaccactggtcttggttgtcacctgtgacatacctcataacaggggtctctggcaagttaccaggatcgctgcgacgcctgtcaccacggaaaaactcagatcaaagcggggtgaaccacagtgctacaactgccaagctgtgggacacgtcgcccgattttgctaattacctccgcgctgtgtgaagtgcgcgggagaacacgccagccgagattgcacacggaagaaagaagacggcccacccaagtgcgttggttgtggtggggaccacgtcgcctcctaccgtggatgttctgtattcctccgggctgctgtaaagagccgcggacaacgtcctggggccactaggaaaccagcgacagtacgcccaggagtaagtt

SEQ ID NO: 2009 - DNA, 248 bp, unidentified
  source 1..248: mol_type = unassigned DNA; note = Description of Unknown:Locusta migratoria sequence
gggggatggtgttattcgcgtccgcagcattcctcaagctgcacgtatcccccggatggtgccaaacgaataacaattctggtagctggactgtcacaccagtgatctcccagctatgtcagctacccaccaaaatccaaatggaccttctcaggaccaacataattttaagaatatagtccagttctcagtgtttgtcattttaacgccgagggtttgagcaaatcaaaatgtgagtgtctaagtaa

SEQ ID NO: 2010 - DNA, 65 bp, unidentified
  source 1..65: mol_type = unassigned DNA; note = Description of Unknown:Locusta migratoria sequence
gggcgaaacgtcaggggaaagtttcatgtatggaccacggcatctcagcccggaagctttaagta

SEQ ID NO: 2011 - DNA, 420 bp, unidentified
  source 1..420: mol_type = unassigned DNA; note = Description of Unknown:Locusta migratoria sequence
accaaggtgctgctgcacagcaacaagtatgcaagtaaacctacaatgaatagtccttttcaggaccaaccaagctcagaacacccagctcatggtaacaacttaagaatatgtcacttgaacatgagtcgatttcatctgctaagactcagatctttcacgcctgatgctgaatcggtgtgcaattcaggaaccaaccaatctacagaaaagaaatcttttggatatgttctggctgggctataaatgtgacagtaggcattgcaacatatgtcagatccatttctctacaaaatcatcataagacaaacatcagagtctgtcttggctatagagatgcaggcacactattgcgaatatctacaaacctccgcttatttggcctaatccactgttaggtccttcatcccccagttgtgt

SEQ ID NO: 2012 - DNA, 539 bp, unidentified
  source 1..539: mol_type = unassigned DNA; note = Description of Unknown:Locusta migratoria sequence
cttcccaggggacacagccttgtagtaggcaccttcagtgccgggcgggagggcttgcgtgcttccgtgaagttgagagctgtgccggcagtagcgtagctactggcagggtcacccaagccgtattggtctcaactgagaagccagacgaagagtgtcccacaacatagggcagggagggctctagaggcgtagtgaagccagcttccctaggggaggaaaccttatacaaatcccggtcctccaggttgggggttgggcttgaggctaacaacctcttcctgtaaaaaaagtcaggttatgaaaacccaaagagcagaagcggacagatcaatagacgacgacatggcacggatattggacaacgaatggttaaaaagctgaaaactgatcttgaattggtacctggaatgttcgatctttatatagcccaggcgctctaaagaagttattagaccagcaggggaagctcaaggagagcattattgccatccaagaaattcgatggacagggacggggtattggaaaagaaggcact

SEQ ID NO: 2013 - DNA, 129 bp, unidentified
  source 1..129: mol_type = unassigned DNA; note = Description of Unknown:Locusta migratoria sequence
gggtgcaatgaaggagcctccccaaagattgcgacagcaagataaaaaaaaaaccgcaatcgggcgcaccccgggcaacgttgatcatcagcggctaatccttcaacaaccggaacggacttctgagaa

SEQ ID NO: 2014 - DNA, 458 bp, unidentified
  source 1..458: mol_type = unassigned DNA; note = Description of Unknown:Locusta migratoria sequence
ggcggctagcgtgaaaatacggaatgtgactccgcgaaaaaacgtgaattttagtgttaaaaataaacagtgtgtaaattgtaaagccgaaattcaaagctaaatgaacgtgtgtccagtttacagcttattatcagcgcactgaagatggatattacgaaacttaaagatgaaatcagtgaactaaacacatcaagatcgcgccatgatatttcgactctgtcggaaaagttggcggaagtaaagttaaaggatgcaaacaaaaagtgaaaaagcaagaaaacagtgaaacaaagaaaaktgtagtgcacgaaaattacttccaggttcttacagatacggtttgtgatatcgctgtgacaaatgcaagtaggccaaaacaacataaaaaacaaaacgaatccgtaaaaaacaatcaaagtgcaaataaacaaaatstaatacaagtgacagaaaag

SEQ ID NO: 2015 - DNA, 435 bp, unidentified
  source 1..435: mol_type = unassigned DNA; note = Description of Unknown:Locusta migratoria sequence
cagggacaagcatcttgcgtgacgtggtggcgagcatggggacccaagctggcctggcattgcttccccttacctgtgccaggtccctcctgttatctttcctatcgaccaccctcggtcaactcttgttcatttccgaccccgacggtattaagctatggagtcttcattttcctctctcagtgcaaggtaacaggaaaccaccactgacattattttctctagacgctcatggggtgacctctttgtaaaagatttggaggtaaagcttcccctcaatcggatctccgggaggggaatacaacgaggtttccagacataaggagagatggaacaggaaggaaggagaaggaaaaagaagaattattgaggataggaacgtggaatgttttgacccttttgcaggaagggaaattagaaaacgctaaacatgaa

SEQ ID NO: 2016 - DNA, 94 bp, unidentified
  source 1..94: mol_type = unassigned DNA; note = Description of Unknown:Locusta migratoria sequence
ggggacacagaaggagcctcctagaagatcgaaagatcgggcgtccctggaaacggcacacagccggmtaatccttctaacaccagaacaccag

SEQ ID NO: 2017 - DNA, 142 bp, unidentified
  source 1..142: mol_type = unassigned DNA; note = Description of Unknown:Locusta migratoria sequence
cctggtcaacggtctcaaaggcggaagaggaatcttagttcccaaggagaagagcggaagaactaatggagaaaaccatgaaaaataatcatttcggactaacaatccgatcttatcttggaatttacttcctccctgtaca

SEQ ID NO: 2018 - DNA, 421 bp, unidentified
  source 1..421: mol_type = unassigned DNA; note = Description of Unknown:Locusta migratoria sequence
gctaataagcataaacattgagcgcttggccaacgataagcaggagctgctctcggaatgtgcagaaatacaaatgtcacattctgtgcatcagagacccagacaccaattaacctcgtccaacataccaggaatgaagcttgtaattgaggtatcacacaaaaaaatatggtagtacaatctatgtagaaccggaccaaattataacatcagtgggctcaacaaacatgacaatttagaaattctaacagtggaaactgacaatgcacaataacaagtgcgtacaagcccctagccaaaaattcatattaatgaacacataattttagaacaaaataacaactgcttcatcctgggtgattttaacagccatagcactacatggggatatgaagaactaacaccaatggaagtcttgtag

SEQ ID NO: 2019 - DNA, 248 bp, unidentified
  source 1..248: mol_type = unassigned DNA; note = Description of Unknown:Locusta migratoria sequence
tcttaaacgaaaatggctaaaaactacggccaacataaatttcaacaaggcttgtgtaaagaataaatgtatcccgaactatatcaagtttaagatatgtaatccaaagtccaatgtaggtagggcagtggttgataaagcgcggaaattttggttgaattccgaaattaaattcctccataagaaaaaagattgtattagtgggcaattacttaaggcgcatttagaagcagctagtgcggtacaca

SEQ ID NO: 2020 - DNA, 411 bp, unidentified
  source 1..411: mol_type = unassigned DNA; note = Description of Unknown:Locusta migratoria sequence
cccctcaggggctcagcattaatttgctgagtacgggcttggcgaacccggggtcctgagccgtgggctgtgtcgcgccaacagtccgctacaccgtaagctctgtgcgtgcttcaacgaccatcgttcggcgcgacggtggaacgttgtacgtttcagagcccggggatcttggcttaatcgcccgggtcgcgaggacggtacaaacctctataaaaaaacctcaatctcaaggtgtgctacgtgccgaggagatgcatggctgttgaggttgaacagtcgctagcgagcaacctctgaggaacctgccgcacctcagttgtataaggcttacccaggcaagcggggctctgcctgggtggacctttagttccctagctgctcgtgggacgagaatgaaacgagcaaata

SEQ ID NO: 2021 - DNA, 783 bp, unidentified
  source 1..783: mol_type = unassigned DNA; note = Description of Unknown:Locusta migratoria sequence
tctcctggcgaataacaacttcgaaaaactacgggtatgctgccaggtatcaaaatcgacgtcaaatttttcgaagctgttattcgccaggagaaattaaggaatccattactctacggggaggaaatgtatcgtttttgcggaagtcagataagcttcgtagcagcagggtcaggttgcaatgtgcatgtcgtctttgttggaatgtcgtgataatagtgttgttccaacttttgccaaagttgtgcacatatcaattctcctgccgctggtcgcattaaacaacgtgcaggcttagctcttgtccgcgagaggattcattacacccgccgagaattggattttgtgtccaaggaattatttcggcttcatttgtacattgcctctgaaatttcggaattttcttgggactggttggacggtgcttcctggtcacaatccgattgggaatttcaaactgtaacggcccggcattcggcgaagtttgaacggttccgtagctcagggtctgcttttacaactcgacgttctgtgattaatctcacagagaaaacctttgacgacgcagctctatccgttctggggaaaggtttgaattttgcaccgacgcctaaacgtttacctgttgttgattttattagttctatcgaacaggctgtttttaaactaccttctgacattaaagaggaggttaggagggaagcttgtcgtgtgttgactagggcacgtccgcctgtgagtaatataacagcagctgaggcagctgccttacgttcacttagg

SEQ ID NO: 2022 - DNA, 299 bp, unidentified
  source 1..299: mol_type = unassigned DNA; note = Description of Unknown:Locusta migratoria sequence
tgcatgaacagtgtaatactttaagagcaatatttttggacctaaattcatttacagtaagtgtctagcacaagatggactgcatctaaataggctaggcacaaatacttgtagcaaagtattggagatgtatgtgtgtgataaaaacaagggaaactaatgtataggcagggggtgaaaatccagacaagaatacaaaaagactacaacctctgtgaactagagcatgtactagagatatttaaggaaaacaaagtaagtgccaaccaagtaatcagaaaaaagtgtattattatttt

SEQ ID NO: 2023 - DNA, 338 bp, unidentified
  source 1..338: mol_type = unassigned DNA; note = Description of Unknown:Locusta migratoria sequence
tcacatcagaaacctctacggggaggagatggttgaatcgtgggaagactggataaacttcgcaagaagaagggtaagctgctgagcgctcttgcttttttattgagatgtcgtagtgaaagtatcataccgaagttcgccaagtttgtgcattacattgatcgaaagtggccaataacatcaaaaaacgtgctagtcttgccctaataagggagcgcattcgttttactagaagacaattggatctcgtatccaaggacttattttatttacatctagaggtatcttcacggctgtcggctgcatcttgggaatgggttgatagctcttcgtgggct

SEQ ID NO: 2024 - DNA, 261 bp, unidentified
  source 1..261: mol_type = unassigned DNA; note = Description of Unknown:Locusta migratoria sequence
ttgcttgtctcctaccgagcgcctccccaggtggcggatagggggatgctcaccagatatggtgggtaccggggaaataaaatacccggggtggaccaaaactagcacaagggcacgacggatccatatgtcagtggcggtaccccaacagcgtctgttccacatgtcagtggcggctgatcagtatcctctgtggctaactaccatagttgtaacacggagctcgctccactcaaggttgatagcctctgacagtcaatc

SEQ ID NO: 2025 - DNA, 600 bp, unidentified
  source 1..600: mol_type = unassigned DNA; note = Description of Unknown:Locusta migratoria sequence
caagatggcgtcaaaagttcagtgcagtgacacttcgatctcctcaaagaagcagttatacaactcttctgcttgtaaaaagtgcgataaacgcgtaataaaaggtattctgtgcgtcacatgcaaattttggatgcatgaaagatgtgctaaagtgaaccttaagttcgtaaatgacgagttkccatggtcgtgtggcgaatgtttatgtgatgaacggaatgaactgttaaacacaataaactcgaaaaatgaaatcatcaagatactaaataatgacgttgaagaacttaaaaaggtaatagttgcgttgaaagaagaaaatgcgaaacttgcaagtgatggaaatacacaaaagtgcgaaaagaatgtatcactgtgtggaaaaaaccaagaaaatccaagtgtttctaattctggaaatgatgcaacagtaaacaaatcgggtaggcctagcgtggaaaagtgacaaacaatgccacttatgcggatacaacaaaccaatacaaatggactgtcgtacagcacaaaaagagggacaagcaggaaaagaaagaaaaagagaacactaaaaacgacttcttaataatcggtgattcc

SEQ ID NO: 2026 - DNA, 90 bp, unidentified
  source 1..90: mol_type = unassigned DNA; note = Description of Unknown:Locusta migratoria sequence
ggggtacatgaaaggaacctccamgaagattgcaataatagaagaacaagaaatgaacagcaatcgggtgtacctgggcaacgtcagaag

SEQ ID NO: 2027 - DNA, 133 bp, unidentified
  source 1..133: mol_type = unassigned DNA; note = Description of Unknown:Locusta migratoria sequence
gggggacttgaaaggagcctcccagcagaatgtgctgttaagctagcatcacattcgggcgtcccctgggcaacggttttttcttgccggccaatcctttcaaatccagagacatcaaggcatagctagtgta

SEQ ID NO: 2028 - DNA, 545 bp, unidentified
  source 1..545: mol_type = unassigned DNA; note = Description of Unknown:Locusta migratoria sequence
tggcggcctgtatagatgtactaataagtggctctgtgaaaaacgattatgttgtaaatataaagtgtattttgtgcagtgaaaatgttctcagtggcattaggctgtgttcagtgactcaaaagtgggtacatacgaagtgcatagcatattttgacactataaacacaaaatgtaattgtggcgtaattcattgtgatttgcaattggtagctttagcaaaatatgatgctgagcgggaagaaaatgtgctatttacgatagaacatgacatattgatcgttaaaaagtactcaaacaacttggaaacattggcaataactcttaacgaagaacaaaacacgaaagagcatccatttattaggcctaaatggagctggtgttcgaaacagaacgagaaagaaaaacatcttggaaaaacaaatgctttagcagtagaagcagttgcgcctaaacaagcaaaaacaagaagtatttcgaagaaacaagaaaaagcaaagctcctacaaaatgaatccatcaacacagaaaaagagaaggaagag

SEQ ID NO: 2029 - DNA, 209 bp, unidentified
  source 1..209: mol_type = unassigned DNA; note = Description of Unknown:Locusta migratoria sequence
gtggagttgctagtctcccatcgggcacctccccaggtggcggataggggaatgctcaccagatatggtgggtaccggggaaataaaatacccggggtggaccaaaactagcacctactgccttgtagttaggtattggattaccaaaggctaaaggaagaaaaccttgatcaaaaattacctggccctccaggttgggggttaatgca

SEQ ID NO: 2030 - DNA, 1068 bp, unidentified
  source 1..1068: mol_type = unassigned DNA; note = Description of Unknown:Locusta migratoria sequence
gccatagccggtcccaagcccggttgagaaaggaggagggggaggagtaacacctcgttaaaaaaccttggttcacctggccctggtgatagcacctcgtgagggcccctgccagggtacggtgaagacctcaacggcagtgaaggcggagatgaagatcatcggtacggcggaactggcggaagaggcagccctaatccactagcgtctgccctggaatccagcggttagtggtcagcgtctgttcacctagttggtgcggctgctcctagttcttcttgatctcaacaatcaagtcgtaaacatgtgaccttcgtagaagatcaccaaaacaagtttcaacttgaataagcatgatggaacaaaaggaaagaattccactaccccaggcatcagtctctagactgaattctcctggtcatcggatctgggggaccaggaacttcatgcgcagaagagtcggagcttctcaaaatctctaagaccaaaacagaaaaacttcataggaactctcaacacaaacacactctcaaaagtaggtaaacttaaacaactcacaaacactgtggaaaaattccacataaaaatccttgcgattcaagaaacacgatttaccgacgaaaatcattttgtacaggaaacttcagaatctacaaaggaaaacctgmaatccagttgaacaaaggacccaaacaatttggcacagcttttgttgtgcataaatcaattacagactcaataataaacttccattcaacatcagaaagaatatccacaatctcattaaaatctggaaacaaggcatacacactgataaatgcacacgctcccacaaatgattacaatagaaaagacccacaggtaatagaggacttctgggaactactggaggaaacctcaaataaaattcctgcacatcatgtgaaaattcttttaggagatttcaatggacaactcggcaaagagaaaaaattcaggaaaacaacgggaattcatacagctcacaagaggacaaataaaaacggcgagagactgataaacttctgtgaaaattttgatcttaaaatc

SEQ ID NO: 2031 - DNA, 376 bp, unidentified
  source 1..376: mol_type = unassigned DNA; note = Description of Unknown:Locusta migratoria sequence
ctggttcactttaggatagtgctgttttactattaatctcatacttacattattaattacggtaccatattaggtttaaattcaattttatatagcgttggtctcacgcatcattggcaattgctcgctctactatcgatattgttatctttatttagtgttgttccgtgcagattacttttactgtgcttggcgagattctcccccccccctcagcgccccgccctcggcgaacggccggcgaccttggctgcagcgcctccctgtccctcccctgtcctgaacccacctgacctgcttcgctctctctctctgctgtcctgcactcctcccccgaccccccggaccgctagccacccagccacgccacattcca

SEQ ID NO: 2032 - DNA, 1764 bp, unidentified
  source 1..1764: mol_type = unassigned DNA; note = Description of Unknown:Locusta migratoria sequence
tagttattctcgcatatttgataaatactgtttgatagccttgtctgtggctggttttcaaaacaagtcagagaccttactacagtcgttatcagtcagtccagtgccagctgttgccagtgtcacatcgtaaacagcgctaagtatctaatttaatttgtgtcaaatttaatttgccagtctagttcttcattttcgttagtacttctgttttaagaggtttattctcgcgtacttggcagatttcgtttgtgctactgttttaatagtttattctcgcgtatttgataagtactgttgggcgcgtcagcagcacacagtcagcagcaccagcagagttacagctaagcaggagcgaactattgtgacttatttgtgggctgagcagtgtcaatttctataaactcgcgctagtaacaagatacttaactctctacaggcaattgttgatttgttaggatggataggatgtgtgactgctgcgtacggacgcaggaggagctggccgctgttcgcgagcagctgagcgtgctgttggccgcggtcagccgtcttcaggctgctgcctcggagtgttgcggcagtgggggctctggtgcgtcgcatgggacaccacaggtgttacatgcttcacccacggtccctgctgtcgggacatcttcgcgcgtgccggacgcggttgagccaccctctcctcaaggggtgtggcgggttcaacggcgttcgcgtcgctcggggcgaaaggtcaatgtggaggctggccgtgcggcgtcgcccgctctgcctgtgagtggacatgtggccgctccttcagcagggtccgagcaggcacacggggggaggggtwtattagtgattgggagctccaatgttaggcgggtgatggagccccttagggaaatagcggaaaggtcggggaagaaggccagtgtgcactctgtttgccggggggtctcatccgagatgtggaggaggcccttccggcggcgacagagagcactgggtgcacccgactgcaaattgttgctcatgtcggcaccaatgactcctgccggctgggttcagaggtctcctcagttcatacaggcggttggcggagttggtgaaggctgaaagcgtcgctcgcggggtggaatctgagctaactatttgtagtgtcgttcccagaaccgatcgcggtcctctggtttggagccgagtggaaggcttaaaccagaggctcagacgattctgcggagatctaggctgcaaatttctcgacctccgctatcgggtggagaaatgtagggttcccctgaataggtcaggcgtgcactacacgcaggaagcggctacaagggtagcggagtacgtgtggagtgcacatgggggttttttaggttagagaattccctccctaggcccgacaagacgcctcctgagccgcgacaaggtagcagtaggcagaacacaacagggaatgaaaagatcaatgtagtagtagttaactgcaggagcgtctatagaaaggtcccagaactgctctcattaataaacggtcacaatgcccacatagtactagggacggaaagttggctgaaaccagatgtaaacagtaatgagattctaaactcagactggaatgtwtaccgcagagataggctgsacagtgaagggggaggcgtgtttatagcgataaaaagtgcactagtatcgaaggaaatagacggagatccgaagtgtgaaataatttgggtgaaggtcacggttaaagcaggctcgaac

SEQ ID NO: 2033 - DNA, 1259 bp, unidentified
  source 1..1259: mol_type = unassigned DNA; note = Description of Unknown:Locusta migratoria sequence
agtttttctggmtggatcaaatgatgtagcgasaaatgaaggaaaagacttgttgttatcattaaggaagaagctgcaggaactacaaaatacaaaaatcctcatcttttcaacaccatttcggcatgatcttaaatcctggtcatgtgtgaatgtctaagtaacgagagtaaatgaagaaaatttgtaaacacgttaaattgttgcttttgtaaacataattaacttaggtgaaatatttcatacagstcatkgcttccatctaatcactggaaagaagatgtgagtaatgaatcataaatctagccatgagttattatacacaaatcgataggtcagatcaataccacttagatttaagggaaattcttttttagaggtagaaaaagggctgagccaactggtttgcccagattcacactggaagaccagattaaagataagaataatctaataaatgtttgtaatattagagagaaatatagcagtaatgatgattgccctcataacaacaattattcatcaactttgtcatttaagataggctatctcaatattgaaggtatgagtggaaaacacgcaattttaaacgattttgcaaatgagaacttatttgatgcattatgcttaagtgagtatgggtgtaaaggaaatgaaatatcttttcatgtattagatgatttccatttagttaacagttttagcagagagcagcatattcctggggggtgtgtcaatttacattaagaaagcattaataaattgtagtagtgaactagatctagggttcttgtgcagtgagatacattttgaagccacaggtgtatgtatggatmatttaaaattgtattgtagctctttatagatcacctagtggtgatccactaatatttttaagaaaaacttgagaatttattcaatttctttctcagacctcagtggaagaaatatagttagtgattggtggtgacatcaagctgtatttgatgtaaataaagatgcacacactgtaaatatttaaaaccgttacgacaattcaacttcaattttacaaactgcaacagtctgcttgtcttgacaactacttacaaatgtaatagagagttactgtcctcagatgtagctgtttttgatttctcggaccatgacccagtttgggtaaaaataagtaccgataggcctaatatgcagtataaggagttcaaagagcctaaatagtcatcacaagaccaataacacaggaaaaactttcctaattc

SEQ ID NO: 2034 - DNA, 1314 bp, unidentified
  source 1..1314: mol_type = unassigned DNA; note = Description of Unknown:Locusta migratoria sequence
catgggctcagcattaattgctgagtatgggcttggcgaacccggggtcctgagctgtgggctgtgtcgcgccagcagtctgctacaccgtaagctctgtgcgtgcttcaacgaccatcgttcggcgcgacggtggaatgttgtacgtttcagagcccggggatcttggcttaatcgcccaggtcgcgaggacagtasaaacctctattaaaaaaaacctcaatctcaaggtgtgctacgtgccgaggagatgcatggctgttgaggttgaacagtcgctaggagaactctgaggaacctgccgcacctcagttgtataaggcttacccaggcaagcggggctctgcctgggtggacctttatatccctagctgctcgtgggaccaagatgaaacgagctataaactatgccaatggcgtctctaagcgaggaagatcaaatttcaatgccacgaaatatgacccccgatcgttcccttcccttggtacatcacgggaggaacatcgggctaaagatagggatgagttatactctccaaaatatctcatatgcagcagaacagacggggamagtttcatgacgacaaaacctcttttcttcgtagaaaatctggaggataagtatggtgaagtcgcgggaatgtcaaagatgaggagtggttcagtgctgatagaagctgcatcatccactcagtcgaaagcattgcttgcttgcgacaagctgggtgatgtccctgtaagcataacaccccacaaatcactgaacatggtccagggtctgatttaccacagagaccttcttctacagtctgatgacgagttacgcaccaacttagagcgacggggcatccacttcgtccggcgcgtgtataggggtctgaaggattgtagggttgccaccggtgctttcatcttggcctttgagggcgatacattgcccgaaaaggtcaaggtcatgatttaccggtgtgacgtaaagccttacatccctccccctatgtgatgcttcaaatgttggaaatttgggcatatgtcatcccgctgcamctctagccccacatgtagggaatgcgggtgtccatcccatccggacgctccgtgtactcccccgccaatatgtgtcaactgtgggcagcaccatccaccctgttcaccagactgtaccattctccgcaaagagtgtaaaatcatggaaattaagaccctggacagactgacatacactgaggcaaggaaaaaatatgaaagactccacccagtccgcagacaacttcctatgcgacagttacgtcgtcgccagccaccctggcgacg

SEQ ID NO: 2035 - DNA, 806 bp, unidentified
  source 1..806: mol_type = unassigned DNA; note = Description of Unknown:Locusta migratoria sequence
cccagggggctccaactaggaggcgcccgcgggaccccgagctgagtctgacattgcttccacttacttgtgcaggcccctgcttttatctttcctgtcggcctcccttggccaactcttgtttcttcgaccccaacagtattaggtttcgaggctggagggtgtctttcattttccaaacccttcttctacaactggagagtaaactccaaaaacaaaaaaatcctggtcctccaggttgggggttggcaacaggctaccaacctgttccagaaaactaacaaggtaaaaacgatataacaaggcctcggataggacggatgaatggaaatcgacccaagcaagtgaacggacagaatactggactacggattggaacctggaatgttagaagcttgcatcaagcaggagcaatacggagtatgacaagggaagtagaaaggtacaaaatggatgtagtagctctacaagaaattagatggccgaactgctcaaccgatgtgaaaactcaacattctgtatggagtttcagaagaaaccatacactggggacaggttttaagtaaggaaagccttatgtaaccagtactagacttcagtcagtaaactcaagaatctcttttttgactatagtactgggggacacaagcttgtcctgatcaactgaattcgaaggacgccttttatgatgactgagactgcaagtgacagtgtccaaaggatcacttaaggtgctgttaggtgacttaaatgccaaaattggaaaagaacaaatttttttgtggactccatgatgtaagcaatga

SEQ ID NO: 2036 - DNA, 228 bp, unidentified
  source 1..228: mol_type = unassigned DNA; note = Description of Unknown:Locusta migratoria sequence
cgtaccctgggcgttaggagaaatcctwacggcagatccttccatcacmaggaccaaaatcaagacgtatctcawccacaacggcttttctcaaagcmakmtctcgmagkaatatcactgaataaagaagtsmtactmtccgacagctgcagtaacacagcttgtkatattttactgctacaggagacccacagagggccacaacagcaaaggccaaaagtaaatgga

SEQ ID NO: 2037 - DNA, 682 bp, unidentified
  source 1..682: mol_type = unassigned DNA; note = Description of Unknown:Locusta migratoria sequence
ccccagggggcccacagctcttttgtgggtacgtgtgtggcgcgcacgggtccccgagccattgcagcctttcttcttacattcctgggctgcattacctcccccagttcctctcctcctccccatcctaattcctccccgtccctctcatctccccccctctctcggtggtttcctttaaaacggcacggctattcctatggttccgatgatggttgtagcaattttgatcttcgtcgttttcctctgttttcggcatagttcggtccccctcggggtttgacctccacaaaaattcacagttactagtgtgagccatttggggaagaactcccgacctagcccctatggcgtggatcccaatcctttcctttcccacttccttccttgccatagccccctcccccgctaggtccccagcacgtgtagccagtccgtgtgggggggggggggggctgttatgtacccttatggctgagccccctgacaacgcagggatcacactgctggtacctgagctgcaacctccccatgcaggccaaggagtcgatacccgtcctcgtggggtatcagggctcccggcaatggccatcgtgccaggtggcctttgctgtggctgggtggcgcccatggggagagccccggatcggagtgggtggtaccagggcggacgtttcgcacg

SEQ ID NO: 2038 - DNA, 335 bp, unidentified
  source 1..335: mol_type = unassigned DNA; note = Description of Unknown:Locusta migratoria sequence
ggtagggtttcaccctatcccacaatctaaacccacgcaactaccatgatggcacaactacggaaactagtaccccagccggttcaatccggggccaaaattttggttcaagtagggcaatggattctgggggccctacaccatcatgtttggatcagtcagaggatccttcatcccgcaaactcagaacgaaggagaaacatttctttggtacacttaacgtgaacaccctattgaaaattggaaaacaaaaggaactgtcaaagtacttgatgaatacaaaataaacttctggcagtcaagaaacaagattcacaacagatgaagtgtcagct

SEQ ID NO: 2039 - DNA, 134 bp, unidentified
  source 1..134: mol_type = unassigned DNA; note = Description of Unknown:Locusta migratoria sequence
ggggacaaggaaggagcctcccagaagattgtaccgtacatgtacagtcgggcgtcccctgggcaacggtaaacaccggcaaatccttccacacactgagctacgtctaaaccgacattgtattcagaatctga

SEQ ID NO: 2040 - DNA, 515 bp, unidentified
  source 1..515: mol_type = unassigned DNA; note = Description of Unknown:Locusta migratoria sequence
gaagatggctgccgatcagtatactcattttgtgcgcgccgttgtgaatagtaaaaatcgcgtgttcaagtgttctctgtgcgagaaatacaatgctatatgtgataatttatgcgtgccgtgtcacatcttaataaaaaacagtggaaaaaatgaacaggtaaatcctcgtgtaggtctttgtacaagtcttagtgatcagcgtggtaaacatggacatctgcatcaaaatgtggacgaaattctgagtgaattagcaacgaaagaaaaaattatcaacatcctgtgtgacgacatagcaaagttgcgacaggaatatcatattttcaatcaacaaacagtgtgaatacatcgccaaatataaattgtgctgagtttattaggcctaaaaagttcacgagtggtaaactacacgaaacggtcgcgcaagtgccttcaaataaccgtttcagtgtccttgaagakaacactgatactgttgatttgtattgaaaaacaaaagtttgtctacaaat

SEQ ID NO: 2041 - DNA, 331 bp, unidentified
  source 1..331: mol_type = unassigned DNA; note = Description of Unknown:Locusta migratoria sequence
ctcagtgaccgccggccagtgcacacgtgacagcagcagctctacattgtaaggtaaccggcttcttaatagaagcgacttattttcatttcgtgtgtgctttcttttacagttcttcaaactttagtgtgctcgcgtgtttatttattaagaatcgcgtttagttgtcagttcagttgttgatattttgatttattagctcgcgtatatatttttcagattcgccgttaataaacagtttagtgttaggttcatatttttcgaagctcactgtttatcaaacttctgtgtcctcagacgtacttacttggaacatacataggtttttaga

SEQ ID NO: 2042 - DNA, 416 bp, unidentified
  source 1..416: mol_type = unassigned DNA; note = Description of Unknown:Locusta migratoria sequence
ttaagacggccactgcacggaagattatggagaagggagccatgctattgtgagagagaattagttatacaggcaaaggttggatacatttcaggaactgttcccttgacatcgaagattgcagcctttccccccgggactgggttgatggagttacttcgccaactttgattgggaattttggatgcaagttcgggatgtcaaaattgatcgcatggtgccacaacaagcttcaacacaggaagttactgtacaacgttccattttaaatttcggagagaatttggacgttgcaactgtctgttttgggcaaaggactgaagttttgtacctacacccagtgactgggttgaagaagctgtacgacattcctatggcactgctgaagaaatgggaaacttgccgtgttctcttga

SEQ ID NO: 2043 - DNA, 427 bp, unidentified
  source 1..427: mol_type = unassigned DNA; note = Description of Unknown:Locusta migratoria sequence
gtctcccacaaggccaacccctcgtccacgtcgtgggagacgggcaacggcgcgaagtaagggattgtctgtaagggtgaagtacagtggagactatgcgagttccgcgaccgctacggcagctgtgaaggccttacaggaaccctgaaaagcggcggctaacggggctctggtgaagccgtgttaggcgtagctggccagcggtggattaaagcgtgctttcaagactaaaacaagcctcggatgtataaaagaaattactggacatgacacctctccagggacctcacgaaagtatgacggccaaaaacctgaagcatattggagacscctgaagacacaaaaaccaacaaagaaacaaaaactcagacttggaactctaaacatcctcacgctcactggtaaatgtgaagagcttgttgaccta

SEQ ID NO: 2044 - DNA, 306 bp, unidentified
  source 1..306: mol_type = unassigned DNA; note = Description of Unknown:Locusta migratoria sequence
ccaggcacaacattaccagacgtgaaagggcgcgctgcggtcgctgcgtgatgatccagacgtcgtcgtcctgccggcggataaggggaacataaccgttctgctaacagctgcggaatacaaggagaaaatgtataagctcctagatgaccctgcttacaggaagatcacgacggatccaaccagccgaatacagcgcaagacaattgaacttcttcggagtactttcacagacgaaacagctaagaaactccgtcctcgtgcggccgcaccaccaagactctagggcttccaaaggtacacaag

SEQ ID NO: 2045 - DNA, 464 bp, unidentified
  source 1..464: mol_type = unassigned DNA; note = Description of Unknown:Locusta migratoria sequence
aacacctacataccaagaaacaagaataaatgttgaactttacaaaattcatctggaactaggcaaccacatctctcagacatactcaatgatttaatgaatacagtcaaacaaaatacagaacaactaatcaaaatgggagaaacaacaacaaaaaataaacacactcctcaaacatagcaacactgttaaagatagaaacacacaaccaaaccacactttcacaaacgctagtcaacctgactgacatacaattcaccaaacaggaaacaaacctcttagaaaaaggacccaaatataatgtcaacacacatattacacacagaacaatagagaaccttgtcacagaaagtgaattcataataaaacaacaagaaagaaacacaaatttcaatgcaggcctcacaagagaattaattgcagaggaaattagatgcataataaaagaaaacagaaatgacata

SEQ ID NO: 2046 - DNA, 191 bp, unidentified
  source 1..191: mol_type = unassigned DNA; note = Description of Unknown:Locusta migratoria sequence
tattggtggattgagtaaccctgaagtgctgctgccggtcccaacccggataaaggaggagggttggcagccaaagaagccgtaaaagaaaagccgggtcacatctcaaggcacctctgaggctaactaccccagttgtaatcacgttgacgcctaggcgtcaaccsccaatataaatcattcgtttcagc

SEQ ID NO: 2047 - DNA, 321 bp, unidentified
  source 1..321: mol_type = unassigned DNA; note = Description of Unknown:Locusta migratoria sequence
gaaaccgttgcaacaaatcgaaaatttaggacgatttgtagcagttttgtaaacacacattcattgaagcaaccagttctgccaggagcactttaccggacatggactgcacagaaaccacctgggcaaggatgtgttggccaaagaaattctccatgtgataaaagctgcaggaatgaacagtcacgtaaaaattgcactgcctgcaatatgttcattgccaattacaaamgaaaagaagacggtaccaacagcatatgaagaagaaacacctatggctwcatctaataagtagaaagtacatcagcaccagcacatgaa

SEQ ID NO: 2048 - DNA, 1103 bp, unidentified
  source 1..1103: mol_type = unassigned DNA; note = Description of Unknown:Locusta migratoria sequence
ggggtacgaagaaggagcctcctagtagactgtgaaccaataagctgaaggacacagtcgggcgtaccctggaaacggtgaaaaacttcaccggctaatccttctaacaccagatcaagttagagccaaaaggaacatcaaagatgcaacggcctttatcaagaccaaccctcgtgataatctctataaatattgagggattttctagtcataagagtattttattagcagacatatgcaataagcataaatgtgatgtattattggtgcaggaaacacatcgggaaaccaccagccacagacctaaaattgcaggaatggagttagtcatcgaaagacctcatgacaagtacgggagtgcgattttcgttagacctgggctcaatgtaatatcagctgcattgacagagataaataacattgaagtacttaccatccgggcccagaagttctctgtgacgactgtgtacaaaccaccagatatggactttgttttcaatgaacctaacaattttacatatgaccatattaattttgtaatgggcgacttcaactgccatagtgaagcgtggggatacaatgagactgatgaaaacgggatacagcttgaatcctgggctgacagtaatgacctgcaacttattcatgacccaaaactcccagcatcgttcaatagcggaagatggaggaggggatataatcctgacaacatctttgtgagtaggaagttggcaatgcagtgtgtgaagcttgttgatcatcccatcccaagtacccaacacagacccattatttgtgttgtgaatgccatcgtgaagccagatgaggtgccctttcgaaggcggtttaatttcaaaaaagcaaactggcaacaatttcaagagcaattggatgaagagattgagaaaattcctcctcgaccagatgagtatggtagatttatcgatctttgaaagaggtttcaaggaaaaatatcccaagagttgccacacccgtacatccaaggactgactggcagcagtaaagccttgcttgacaggtaccagaagttgttcaatcaggaccctttcagcgaagatacgttggaggctgcggaagaccta

SEQ ID NO: 2049 - DNA, 554 bp, Lottia gigantea
  source 1..554: mol_type = unassigned DNA
ttaagtttaaccacctcaccctcatctccagcctgtaaaccacgacgtcataataatgagaaggataaatccaaatggtctattcccacactcaccaaaccaacagttatcattggatcttccaacatcagcaacatcccgttcctacatccagatacccaagccgaatcttaccctggtgcccgaattcagcatatcaatacattactctccaagatctctccaacaaccattccgaaaaaggtgttatttcatgttggcctaaataataaacaggaatcaggagaatccatacacagaagaatgctggaactcctcaaacttgccaagtcgaaatttccgtctgctaccctttacgccacacagattccttactcaaaggagctacaattagctgaacctcatttagtcaataacctccagaagttcaacagtctattatatcataaaccgtctaccaatgcccatactattcctcgcttcaatggagtggtcagtgtcatttcggataacatccactggatgtcccccactgcaaaaagtatttatttttc

SEQ ID NO: 2050 - DNA, 882 bp, Medicago truncatula
  source 1..882: mol_type = unassigned DNA
taatcctgccaaggccggtcccaagcccggataaaaggagggttgtgttaggcctcgacagccaaagtaaaactttgtcgaatctctatgacatggaccaaatgcaaaatagcgtgaatgctaggtcgttgcccggaagcaacgcgttgtatggctcgagtacagtgtcaaatgagcaagagccgctgcatcaccacctggatgtagtgaaaattaagcaagggttcccgcatcttcgtgaacgggtgcgggtaaagaagctagttcatgagaataggattcgttttggaacttgaaatataggtacacttacaggaaaatctatggaagtagtagacacaatgactaggaggaagatcaatttcatgtgcctacaagaaactaagcgggtggggaaaaaggcgaaagaattagatagttcaggatttaagctttggtatactggtgaagttagatcgagaaatggggtaggcatctttgtggataaggagtggaagaaagatattgtagatgttaaaaggataggagatcggattatagccctaaagattgtagtggaacaagacacctttaatgtaattagcgcttatgcacctcaggtagggttagaagcacaccttaaagtgaagttttgggaggagctagaaggcttaattcaggatatcccgttaggagaaagatttttctaggaggggatttaaatgggcatgtagggagtgtttcgagaggtttcgagggtttgcatggggggtatggtctcggggagattaatgcggagggtaaatccatcttagatgtttcatcggcttttgatcttactatagctaatacttgtttcaggaaaagagaggagcatcttatcactttcaagagtggggtctc

SEQ ID NO: 2051 - DNA, 694 bp, Melopsittacus undulatus
  source 1..694: mol_type = unassigned DNA
tctctttcacggacacccccttgtcgtggggaaagagcttgcgtgcccttgtgaggttgggagctatgctggtggtggcatatgcctctagtagggtctcccatgccagacaggtctcaactgaagggtcagacaaagtgtgtccatgggcaggatgggctcactagcctttgggcaaccatcctaggagaaggacaactctaacttcaaacccaggcagatggagctcgtttagccctgtaaggccatccatctaagagaaggatactctaatcaaacctatgacctgaggactttgctgtcaccgtccaagctcgctaggccctggcagataaacctcaggtgtaaagggtggggccagttctgcgcatgctgtgcctcacctaaaaaatccactgcacaggcccgaagggtttacccacacttgcaaagccctgtagcgacaggcgagggacgaaacggcaggtgataaggtgcactggaagycgcagacccaaccctgcatgcaggcggttcaggacattggtcgctcgagactgacccaggagatgacagtcttgtttggcaacatcctgaatgaccaagcagccttttttcaaggagagcactgcttgctccatatggagagaggcctagaaaaggtggcctaaccaaagctcatctccccctccacctggttggctagccgcggcca

SEQ ID NO: 2052 - DNA, 167 bp, unidentified
  source 1..167: mol_type = unassigned DNA; note = Description of Unknown:Mesobuthus martensii sequence
gccttagaggaaccgactaagatcaaaacctagtgtccaatccgtaccttcacgtggtgcagctgttagtactcaatgtttctttaacatgaggaacggacacggatgggctcacaccaacccgcattggccagcgtggtgtgttttggctaaaaccttcaagcata

SEQ ID NO: 2053 - DNA, 111 bp, unidentified
  source 1..111: mol_type = unassigned DNA; note = Description of Unknown:Mesobuthus martensii sequence
aactccgcccaagaagccatatagctgactggccagtcccaagcctggataaaggaggagggttggcgtcaggaagggcatccggccgtaaaaacaccctgccaagtcttt

SEQ ID NO: 2054 - DNA, 53 bp, unidentified
  source 1..53: mol_type = unassigned DNA; note = Description of Unknown:Mesobuthus martensii sequence
ggaacgtccagacactatgggccccagggaaactcgaactgttacgacatgaa

SEQ ID NO: 2055 - DNA, 61 bp, unidentified
  source 1..61: mol_type = unassigned DNA; note = Description of Unknown:Mesobuthus martensii sequence
  misc_difference 60: note = a, c, t, g, unknown or other
ttcttcgagaagaaagaacagtgaaaatggacatggatcagccccaacggacggacaaana

SEQ ID NO: 2056 - DNA, 142 bp, unidentified
  source 1..142: mol_type = unassigned DNA; note = Description of Unknown:Mesobuthus martensii sequence
tggggaaagcaatggtgaactaccctgtaaaaacctcacctcgaaattctatggatcaagaccaaagtgttatcgatatggtgttggacggtgggcccccgggctggacaacatcgaccatgctactggggaagagcaaagg

SEQ ID NO: 2057 - DNA, 2726 bp, unidentified
  source 1..2726: mol_type = unassigned DNA; note = Description of Unknown:Nasonia vitripennis sequence
agaaaagtaagaaggaaagaactggagaagaggcagaagaaagaaacgcatttgcaaaaggagggaatgtgaaaagatcaccaattgagaaagagaagatggaagaggaggcaatcgggtcgttaaagtgcactatgaatataatcctacaaaaagtggagaagatgagtatgaaaatggataaggaataggtagaaagggataagatgatcgagaactgggaacagaaatatattggactggaggaaaaaatgaacagaaaaatagaggaagggctaaaaggtatggaaggaagactgtgagaagaaggagaataaaggaaaagaattagaagagaatgcaaggaggcgagagaaaaggaggaaagagagatggaaagaaagaatgggaatgagaatgcgaaagaaaagaagaaaaaaagaaattgaggagatattagggaagatagaaagtctggaaaaaggggaagagatagacaagggtagagagagtcaaccaggggagagagaggataagggaaaggtaacggaaaaggagagggacagaaagcagatagaagaaatggaatggaggatcgaggaaggagagaggataggaaaaagaataatattataatagcagggtggaaagaagaaaaatgggatagaaagacggtagaagactggatgaaaaaactcgaagtataggttacgttgaggaaaacggtcattgaacgggaagatctaaagaataggggcggaatgtagaaactgggaagaaaaaggagatatcatgagagagaaggctaggttacaagggtctgatatatttatagacaacgatctaacatggaaagagagaagaaataaagaaaaactgagagaatacgcgacaaaggaaagaaaagaaggaaaagaggtcaagataggatacaacaaactatggataaaaggcgtagagtatttatggaaggaaagagaacaggaattttttcggagaaagaaaaggacaggagaggaagaaaagaggggagcaaaggaacttaaggataattaattggaatgtagcgggaataaagtgagtagatgagaggacctggggctatctaaaagggtttgatgtaatttgtctgcaggaaacatggctggaagataaagaaggaaatttctgggaaaagaaattaggaggttatgaagtcagaattagaaatgcaaagaaagggggagaaagagggagagtgaaagggggaatagtgatggcggtaagacagggaacgaaaacagagagaatagagtggatagaagaaaagacaaacgaattcataggagcaagaatattaggaaggagagatatatggtggataggtacggcatacatgagagaggaaaaacaagaaaactttaaggagatagaagggatgacggaaaacgccagaggtgagaaattgatatggtgcggagacatgaatgcaagaacgggataggaaggaggaggagtcgacgaggaagaaaacgaagagaacagggaatcgaaagatgaaaagataaacagagaaggggaagaacttctggaaaaaacaagagaaatgggacacagtatattgaatggaaataccgaaggagacaaaacaggagaatacacgtacataggaggagcaggatgctcagtgatagattatgtgataacaaatgagcaaggaaaaagagaggtacaacgcaatagagatagagctgggaaaaacactcgggaaaacagatgaagagaaagacaaaatcacagaaagagctatatggactgaaaaagcaataggtcaattccgagaagaactaaataaaggggaagaggaaacagaatggacagaactaaaaagaaaactagaaaaagcaatcagaaggaaaaagggaagcggcagaaaaagaaagaaaaacacgtggtgggatgaaaaatgcagactcagaaagcagaggtaaggaagttaggcaaggcgattaagaagggagcgggaaggaaagaatacgtcaaagcaaagagagactggggaatattagtagaaagaaaaaagcaggaagaaatggaaaaaagaataaaagaggctggagatagtaaaaccgggagaaaattctgggaggtggtaaaaagtaggagaagaaaaaagaggacaagatgcagcagtaaaataaagaaagaggaatggttaactyacttcaaagggcaactaggagaagagacagaggaagatttgggaacaagcayacaaggagaggatgaagaaggagakagagaggataaagaagraagaataaccgaaaacgaggtgaggaaggcaattagaaaaatgaagaagggaaaagcgccaggagcagacggactacaaaatgaggtatggatacacggggaggaacaggtaataggagaaataactaaaatactgaataacatatggaaagggggaaaagtaccagaggaatggaaaacgggactaataaccccgcttttcaagaaagggaagaaggaggaagcaaagaactacagagggataactctcatggacacagggtataaattatacgcagaaataataagggaaaagatggaaagggagttagagggaagagagatgcttgacgatacacaaatgggtttcagaaaagggagaaggtacggcagacgcaatttatattttgagtaaagcaatagaaactgaactggataagaagggaggtaaagtctacgcgtttttcgcggat

SEQ ID NO: 2058 - DNA, 942 bp, unidentified
  source 1..942: mol_type = unassigned DNA; note = Description of Unknown:Nasonia vitripennis sequence
tggtgagtacagttgacagctctgctgatccatcatttttctgtactgcttttctgctgcttcttgccttcgggccctcttctgttgtagatagttgcacgctcctttttgcaaccttcacgtcgatacataaatcgccgaaggctgcaatttttctctgtcatcttttctactgcaaactttctacacggctcctaacctacaaatctgcttggcttggcttggcttgtttcctcacttgcacggcgtctctttctctccgcaatcaacatcgtggcgacatctgctgcatcgtgggagaactttcaaggcgacttcacactgatcgaggtcggtactttcacgctctttccactaacgctccatctagccgtaagagtcacaacacctactctttcactccgtcgataacttatcatcctcctacaaatatctgctttaccgactgctagtaagttatcgacgaaaaatgagtgcaaacggcgagaagagtgtggaagtgccttttcagccatgcagcagctgtaaacaacctatacagcacaaagaccccaagaagtgtgaattttgtggtctgcactaccacgtcaagtgccaaaacaccgttaacatcaaaactatcgtggtgaacgacaggcagattatagcctgtccctcatgtgcagacaacagcaacgccaagggtgccaaactgaggactaaatccacctctgccacaacatcagcaacgggagtaactgcaacaacagcagcaggcaagaatactcccaaacaacagcagccggtgaataagaagacgaggtcagcaccaccatcagccaacacgtcgagaaatccctcaccaacccgctcggccggagtaacaacacctacgccgtccgttgaggccgctttgagggacattcgcggagcactgctctcgacgacatacgcaatgctcaa

SEQ ID NO: 2059 - DNA, 77 bp, unidentified
  source 1..77: mol_type = unassigned DNA; note = Description of Unknown:Nasonia vitripennis sequence
acacagataaacttgcatcatagcaaaggcgcctcggccgcactggtcaggcgcatggctaagatgcacacaggcat

SEQ ID NO: 2060 - protein, 30 aa, synthetic construct
  source 1..30: note = Description of Artificial Sequence: Synthetic polypeptide
  VARIANT 20: note = Q, I, S, H, P, A, L, E, K, or absent
DIHATVPGPPBLLSLPPSLXWYTVLDLKDA

SEQ ID NO: 2061 - DNA, 438 bp, unidentified
  source 1..438: mol_type = unassigned DNA; note = Description of Unknown:Nasonia vitripennis sequence
tgctgtaacctaacctacaacctctcatggcttttctccttgctgcacggcgtctatttctcctcaaagcgatccacgtggagccacctgtcgggtacacggaacaccaccagcaacatcatcaatcacaggtcggtcaattctcacctctctcgattagcaccccatctggcttcgagagtattaagtctctagctctgtcgataacttaccacccgctactatcttacaacactctctacgttatcgactgccagtaagttgtcgacggagacttaacaataacatcgaaaatgagcggaattggtgtgaagaatgacgagtcgctcctcatgtgtgctcactgcaaaaaaacaaaaagagggaaaatgaagacctgcgagttgtgtgaccggcagttccacaccatatgtgtcgccttcaggtctataatggtga

SEQ ID NO: 2062 - DNA, 442 bp, Nelumbo nucifera
  source 1..442: mol_type = unassigned DNA
ggtgggagtaacagaagagataggggwtggtgaggmtgtagaagggtctaaggaggaaggggagmgaatctgggaattaatagtgatccttttcgagcagttggtagaggtggaaattcactccaggttgggatcagaagagggggctgaactkattgggactacttctaaggaaaaggagagggagattaataagagtggtgctggaactaaaaaggcaattaaaaaacttagcaagaataagaaaaaaggacaagaagtaactcagttaaaagcttcaaacaagggggagggagagaattctaaaagaagaagaaaaaagatgagtgaagtcgaaagacttaggtgtggtgtggattatgaaagaggaggcacaggaaggaaggagagaaagctgggttaaattaagctgagtcgtttgggcctttttgcttagttttcc

SEQ ID NO: 2063 - DNA, 379 bp, Nelumbo nucifera
  source 1..379: mol_type = unassigned DNA
gaagtttggggcaaaaggagakagaaggaaagggggaaagtagtggtcaagggtagaagggaagtaagaaagaagtgagaatgaagatactaagttggaatgtgagggggataggaagtgcgaggaaaagagcaacaataaaagaggtaataaagaggttcgacccagacattgtactgttgcaggagtccaagaggatggagtttaataacaggtgggcaaggagtgtatggaaagccagggggattagttgggtggctgctccctcttggggtgcttcaggggggatagtgacaatgtggaagagggaatgtggttgaaggcttggaggaactgattggaagatactcagtttccatgaagttcaaacagcaggagg

SEQ ID NO: 2064 - DNA, 249 bp, Nelumbo nucifera
  source 1..249: mol_type = unassigned DNA
  misc_difference 110: note = a, c, t, g, unknown or other
ggagatttgtagggaagattcagtggcagaatttgtgggaaagttggggcgtaaactgaagaacccaaatgatttaaaagcatttctacgaaaaaaggaggatagaaagntcgagaaaagaaaattgagcgaggttgagagattaagaagagatattgagggggataagaagtttggggccagaggggacagaaggaaagggcccaagtagattttggtggtgatagggcagattcttgcaaaattgtg

SEQ ID NO: 2065 - DNA, 72 bp, Nelumbo nucifera
  source 1..72: mol_type = unassigned DNA
agtgtttggagaggtagggggatcaattgggcgtttctgccctcatgggggtctgcagggggtgttgtgaca

SEQ ID NO: 2066 - DNA, 279 bp, Nematostella vectensis
  source 1..279: mol_type = unassigned DNA
tcctcgatgggatcgccaccttatcgtggtgagggtgtttgtgtgtcccaatgacctctagagctatgtcggcgggagtattttactcctggcagggacacccatgccgaacaggtcgaaaggtaggggccagacgaagagtgatccactggtcctccaggttgggggttgggcaaagggttgataaccctctcccataaaaaatagcttatcacagaaaccagaagcagagcaaattcacttgggaagaccgtggctgcatctcatgaaagagattgt

SEQ ID NO: 2067 - DNA, 18 bp, Nematostella vectensis
  source 1..18: mol_type = unassigned DNA
ggtcagcggtcgaccaag

SEQ ID NO: 2068 - DNA, 90 bp, Nematostella vectensis
  source 1..90: mol_type = unassigned DNA
ccaaaatggctgccacggcttttgtagctctgtgaatcttgtctctgttttcatgtgtcattgctagttgaaggcgtttgactgtcaaag

SEQ ID NO: 2069 - DNA, 519 bp, Nicotiana sylvestris
  source 1..519: mol_type = unassigned DNA
ctctcaataatgtgaaaaccttcctcactaccgctgctcctatagaacacaccttcctttacctcaatctcttcaacactttacacwcatcatgtctgactctcagcaacamctgcaacagcttaatcaagttwccgaccctccggatataggatctatgcaaatcgatgatacaagtatgcatacacaaccagctactttcctacaaactctactaacagataaataccttctgccawctctaaccaaccaaataccttccttaaacactctagatctagcagatgaagtactccataacmctactgacgatgacacatttataccaattacatcaactgataaatcacgtttatatgagccmtggaaatactctgtgatagttaagctwtttggcaaamggattacacaccaaatcatgcatgataaactgatgactctgtggaaaccaacagaggtcctcctctcattgatttgggttctgacttttttctcattaagttccaaagagaagaaaat

SEQ ID NO: 2070 - DNA, 60 bp, unidentified
  source 1..60: mol_type = unassigned DNA; note = Description of Unknown:Notamacropus eugenii sequence
aaattccttttatgatacaaatatggtwttgatacctaaactaggaagagccaaaacaga

SEQ ID NO: 2071 - DNA, 55 bp, unidentified
  source 1..55: mol_type = unassigned DNA; note = Description of Unknown:Notamacropus eugenii sequence
ggttactgcagcaggcaaggaatcccacaaaaaatgtacaaaaacatctgcaaag

SEQ ID NO: 2072 - DNA, 330 bp, Oryzias latipes
  source 1..330: mol_type = unassigned DNA
agatttgtttttattgacaattttaatcttttctggaacagaacctcattctataaaactgatgggattcaccccagtccactgggcagcaatgttttagctgcmaacatcagacactctgtccagacatcaccggcccccatcatgcccmcaccagtccagacctcctcctcatccgtgcagacatcggtctgtggaagtgactgactggatgtggtatcacccccccacattccccaaaaaactgcttcaatcgacagtgcttccttgccaccacctacaccccccccagtctatcccattaagaccattattacagacaggtcttcc

SEQ ID NO: 2073 - DNA, 99 bp, Papilio sp.
  source 1..99: mol_type = unassigned DNA
accggaggacgggcagcagcgtccctttcaaaaacggtggagaagtctgcgatcgccaacccgcctgccaagcgtggcgattatggcaaatccccccaa

SEQ ID NO: 2074 - DNA, 30 bp, Papilio sp.
  source 1..30: mol_type = unassigned DNA
gtacgtgcgactcgtgaktgctatgtatga

SEQ ID NO: 2075 - DNA, 296 bp, Papilio sp.
  source 1..296: mol_type = unassigned DNA
ggaaaagaagggagatattaaaaaataaaaggagtttgaagcaggtatatgttactgaagattttccgaaagaagtattagaaaagcgaaaagaattacaaataaaggttaaagaggagcgtgctaaagggaatatagcgtatataaaatatgataagatagtagtcaaagaaggccatttagtcaaagaaaaaaggaaaagagatcaatcaacatcaccagaaaatcaaagttatgccaaaaaactggttagcaataattcattgataaaggaaaataggaaaaacgctttcgac

SEQ ID NO: 2076 - DNA, 212 bp, Parhyale hawaiensis
  source 1..212: mol_type = unassigned DNA
ccagttaccctccgtggcggtcggttgtgacgtgtacggtgctccgctagagtagataaaatcagaaagctatagatttttctcgaaagcaataaactaattaagtgttaagcagtgtgccagcctggctataaactcgtacggaccgtgtgaccagcgggaccagtgaccacaccgtagctcgcttaataggggaagcgtagacgtcagtt

SEQ ID NO: 2077 - DNA, 404 bp, Parhyale hawaiensis
  source 1..404: mol_type = unassigned DNA
gcgtggcctgcgcgttatcaggccgcccccattgtccggccaccggacgccgctttgtttgtatgagctggctttgggtttggggctctgggtagcccctgagttggaggaaatgccactctaaaggcggatgagacctttttggtccaacggcatccctgagaggagatgaacaggctggtgccatagctgggtactcagtcttccgcagtctgctcctctcttccttccctcgggtagtaccacctgatgctcttttcctttcctttctcttcttcctcttttcggccaaagcccgtactggtgatggcagggtctggggcgcgtggatagctggccgctttcgttgctatcacgactgtcgatttgcttttttgtaatttttttgatgatttcctttgctt

SEQ ID NO: 2078 - DNA, 2175 bp, Parhyale hawaiensis
  source 1..2175: mol_type = unassigned DNA
cagaaaataatcaacatttgactgtggtgtatatacaaatacaagtgtagtgctaaaatgtgttcgattawactcttattcattgctctcgagtgctaccgctagatattttctccattgcttttggttcttttggttggattctgtggtcgaacttagaagacgctgatcctgagttactaagtaatattatattctatcaaattttcctctatcaatattttttccatcttcctcctcattgacttgcctgatcctcgccaaagggacaagtatgactcctgaacttcccgagtggctataagtttgccttactataggtgggattaaaaattgtgtgcttcggtctcaacttttttttagttttcaagtagataacaccttttcaagaacgctaatattttttttttcaaacctttctagagactaggaggtacactagcgaatatttattctcaaactccttacgttttggatcttcataaaatattattttttatttcttttttttctctcattcattttcttttctaacagactgtaggtttagttcagaaatgttctacatgaaatgaaaaaaaagagcttgaaacatatgataattgagttcattcctaacattgccaagataaacagttcggagctataggcccgatgttcgatctattgataattaccaatcttagcggcgtgaggcaaaacaaagtaacactccagagttcctggcaatttttgtttaattcttgtttctctactcctcccaaaactctcaaacgacttccaatagtcttcattttatttcaagacttttaatacatcttattgtagttttcttttattttgacatgttaaaatgcctaawtcgttgctgcaatgtacgtaaaaattagaacttgatctttttttgttcatctttctaggaacatttgtgtacggtgcaacgggttatatgttatatattatatacagttcctttgtttacctcgtcaaggaggttatgtttttctcgtgtttgtctgtcccttgtctgcctcttgtaagtcaccaagattactctaaaactaatgaacggactcttatgaaatttacagggattgttagacatgttgacagtaacagatgattaacctttggtaaaaatccgttcacctgtctgtctgcctcttttttcgtgcgccaactcaaaaggttccggacggatttttatgaagtttatatgatttgttgggtataaaacgtagagtaattgaccgaaattttggtgatatgtttgttcgactctgtgatgtgtttgttcgtctctgtgatgatatgtttgttcgtctctttgtttctcgctgtgtttgatcttgatattatgcttgttagcacaataactcgaaaagctgtggatggatcctcatgaaatttacaggacatgtagtaatgttaaaagaaataaaggattaaactttggtgaggatcggtatgttcgtttgggtgttgaacggatcttcatgaaaattacaggaatttttttaattctacagaaaggcacagctgattagattttggtgttgatacaaagaaattcatggtttcagagccaatttgaatttttcgtcaccgttgccttgcttggcggaggtatgcgctctagtttgtaatgaacttgcatgtagggcatcttattttactccttatcaaattatgtcctttcttgcatgtaggtttcttttcctttaatacattgtaacttactatagctatatctaggtagccttatttgcattttttacttgtttcataggaattgcttgggggcaggataacacgttaagatattttctttgtttttcatccttgtgtttgtaatttaactgccaagttcttatgtacactgtttaatcagttaagcatatacagtatttgcgatgtacagtatacggaggtgctactttgcatgaggaaacttattaacaaagttcattaatctagttcaaactgttcaggcgatttcgctcgaatcttgggccatagctttagtaacggccctatcgatggggcacgcgtgacgtttttgcattgatgcccctgtcccgaattcccggtaccgagtaactgttccatttctgtttttctccctttcctcttctcctttcatgtcctcttgtgccggcagcacaggcctacaat

SEQ ID NO: 2079 - DNA, 420 bp, Parhyale hawaiensis
  source 1..420: mol_type = unassigned DNA
ccacccgatgcctgtgcgtcttcgtcgtgggtggaccctgcgggagctctctgcgcggctgcgacggggacttccgcgggccaaacgcaggcactcatcgttggagtggctacgcgggtcgctgtggcgctccctttcttcctctcttactctcttctcccgctattctttctcgctgtctcgtgtttttttccttcacggacaggtcctttctgccgacgacctgcccgctcttgtctaggcagccttttccttacttgtttccccctcccgctgtcccttttctccccctatccattctactaagcggtgatcatccaccccaaccccggccccgcctgtccctgctcagtctgctcgcggaacgtcacccgccgggggtggtcttttctgtgttccgcctgcgcgcgctgggtccac

SEQ ID NO: 2080 - DNA, 568 bp, Pelodiscus sinensis
  source 1..568: mol_type = unassigned DNA
gggtggtggtggtcggggactccctcctaagagggactgagccatccctctgccgtccggacctggaatctcgagaggtgtgctgcttaccgggagctcgcattcaggatgtcactgagaggcttaccaagctgatcaaaccttcggatcgctaccccttcctgcttctccatgtgggaactaatgatacggccaagaatgaccttgagcgggttactgcggattatgtagcgctgggaagaaggatccaagaattcggagcgcaagtggtgttctcgtccatcctccctgttgaagggaaaggactgggcggggatcgtcgaattgaggacgtaaatgcgtggttgcgcaggtggtgtcgcagagagggctttggtttcttcgaccatgggactctgttccgggcgcaaggattgttaggaagagatgggatccacctaacgaagagaggaaggagcatcttcgcgggcaggcttgcaaacctagtgaggagggctttaaactaggttcgtcgggggacggtgaccaaaaccctgaggggagtgggaaagtcagataccgggaagaa

SEQ ID NO: 2081 - DNA, 458 bp, Pelodiscus sinensis
  source 1..458: mol_type = unassigned DNA
ctggtgccaagctgtactggctttcgcctttcccttgggttacatcagtggcgtggagagggggatcctgctgctgggcatcagccggttctcaacttacttgcccaggcctacgccctggagaggacactccggcatcgctttctgagcagtgacacaacacgggaagcagcggttaccggtattaagccactgcacttgattggcgtagagtgaggcgccaggggttgcttccgacggtgggagaggtcttcggatctcattgggcagctaccgcccgcctcaagctgggcagcccccagccaaataggtgctgcctcgccacggtccacttgctccattgggtgtgtggggcttagggaatcaccaacaggtggatcgttaaccttacaccaggcaaaacaaacaagcgacaaagtaatccagccttcaggctgggcacatggaatgtaaggacc

SEQ ID NO: 2082 - DNA, 395 bp, Pelodiscus sinensis
  source 1..395: mol_type = unassigned DNA
ggtttagacagttatgkgctattcctkttccgggtcctgtccccagcctcaawaactctgggaaccttaacgcctgkccatcagccctgagcgtgctgttgctgaatgccaggtcagtatcccagaagacagctgtcatccacgatttaattctgaatgaaggggctgacctggcttgtatcactgagacctggctgagagtggagggaggcgttgacctttcccaattgtgcccggctgggttctcagtacagcatcagctgtggcttaatggtcggggaggtggggtggcaattgtctatcgagataccatctcactggctagggtcttggtccaacaaagtgtcagattcgagtgtctgtacttgacgttgggtggccgggataggttgggt

SEQ ID NO: 2083 - DNA, 204 bp, Petromyzon marinus
  source 1..204: mol_type = unassigned DNA
cccaggtcgacgtagccctsagagkcttgggacacatcccggcagacgttsctagatctgaaatcgctgctaccctcaaaaacgctaagaaacccattagcaacatcagcaaggacgagcgtkttgaactctctcaattaaaaaacagagatgacataktcatcctctcagccgaaagggcaatgccactgtcatcatggataa

SEQ ID NO: 2084 - DNA, 10 bp, Petromyzon marinus
  source 1..10: mol_type = unassigned DNA
ggggaagaag

SEQ ID NO: 2085 - DNA, 344 bp, unidentified
  source 1..344: mol_type = unassigned DNA; note = Description of Unknown:Phanerochaete chrysosporium sequence
atgatctgtgcatacaaaaccttcgtacttttgccgagaaagagtcccttaaggggattcgttgctcccgacctcggggagacttttctccacaccaatcgcattacagccgacgagcgacatttcgcctctcgtcggcccgccagtcccttcgggcctggcggttgcaaggggtatatatcccagtaggaaaccgctgatgagtcttcacgacgaaagctcagcgcgacacaacagtgtcggctgccttcggttttcctgtgaagcattccgcgctcgccgctcactacgctcgcgtctcgcgccccccaaaccctaatcaaatcgagtaagcactcttcacc

SEQ ID NO: 2086 - protein, 31 aa, Gammaretrovirus sp.
DIHPTVPNPYNLLSGLPPSHQWYTVLDLKDA

SEQ ID NO: 2087 - protein, 31 aa, Gammaretrovirus sp.
TIHPTVPNPYTLLSLLPPDRIWYSVLDLKDA

SEQ ID NO: 2088 - protein, 31 aa, Gammaretrovirus sp.
DIHPTVPNPYNLLCALPPQRSWYTVLDLKDA

SEQ ID NO: 2089 - DNA, 273 bp, Rhodnius prolixus
  source 1..273: mol_type = unassigned DNA
cacgttgtcagagacgatcgtgaggatggatatggtggaagtgccatatttatcagtaaaaaattgcctttcgacccaatagtgctgaataatccattaaggggcagagttcagatatgtggggctaaaatcctatttaggagcgtcagtattacggtccttagcacttactgccgtcctgggcataaagcctcagtagaggaatggagtaatgtactaaatcaggtttcgggtcctcttattcttggtggcgactttaatgcgcttcatcca

SEQ ID NO: 2090 - DNA, 195 bp, Rhodnius prolixus
  source 1..195: mol_type = unassigned DNA
gaatccagaaatagagtatccaaagataaatttattaatagtaacggttataaacttttggattttttcgatagcttcagtcttatagtccttaacggtagatttgaaaatgatttggaaggcgagttcacctacattagcgaggttggctgttcggtaattgactattcctgcattagtattaaaggtattgac

SEQ ID NO: 2091 - DNA, 197 bp, Saccoglossus kowalevskii
  source 1..197: mol_type = unassigned DNA
aacagtggctatgcaataaacagtggctatgcaatgaatagtggctgtgcaatgaacagtggctatgcaataaacagtggctatgcaatgaatagtggctgtgcaatgaacagtggctatgcaataaacagtggctatgcaatgaacagtggctatgcaataaacagkggcagaggagacacaggctggtggaatga

SEQ ID NO: 2092 - DNA, 39 bp, Saccoglossus kowalevskii
  source 1..39: mol_type = unassigned DNA
aaagcacagataccatataattaaaaaacaatatactag

SEQ ID NO: 2093 - DNA, 48 bp, Saccoglossus kowalevskii
  source 1..48: mol_type = unassigned DNA
aagttaaatctagtgagtacttatggtgtaaaattgatagtaatttag

SEQ ID NO: 2094 - DNA, 126 bp, Salmo salar
  source 1..126: mol_type = unassigned DNA
ctctcccgagctttcgctcgcctccagcacacacacactgttggggcgagtgactctgaacttacaatggctagccccaagtcgttatatatttaattttttcttgtgcattttgctatttgcctc

SEQ ID NO: 2095 - DNA, 1034 bp, Salmo salar
  source 1..1034: mol_type = unassigned DNA
ctgtatccggtacaaagacaacaaaggaaggatggtaggcgtgcctttatcattgtggacaaactctttatagatggacagctattccgagacagctccataacaccgtggctgtactaaattctacagggacttcaggttacgaaaaaaagaaggtatgggaactgtaaaaatatctgaacattatgaagtggatatgaacacacacgtactcaattacatgcttgcttacacatacggacttatacatacacacacacacctgatctcgctctcttctctcactctctctttctctcttctctctctcttctctccctctctctctattgtcgagaactgttttataatttaatgtgtttattgtttgtctatcttttttatgtatttgtctacaagtttatatatgtttacaacaagcaaggggaagatatcagaataggggcattggggaataataacatattgtacggaatacatttgtactgtagtgaagccgtctctagagtaatgcaaggtctctttcatgatcatgtgaaacgtcaattgctatggaaatgctgggatgtgtttttcaattatgttaaaggtaattatgatgcaactatgatggtgatacgatatggattacaattatcatatgaatattaaggctatacgcactacatgttacacacatagacactcaaacatgcaaattggcagagttattatttatttggacatcacacattatagtcttactcttatacagacatcatacacactctcattatatcatatccaatatcatacacatcaacctactcagatttgctacacacataatatcttgtctcaattttctaacatctgtggcattggctcacaggcaaacaggcaagggaataaaacaaatattgctagaacctatttcttgaattctaaatatcagacatttgaaagctctagttttgaccttcataatacctctgatggcagtaactttacaagcactaattatggtcaatttagactgagaatagtatctagtt

SEQ ID NO: 2096 - DNA, 607 bp, Salmo salar
  source 1..607: mol_type = unassigned DNA
taaaaaaaatgtattttttattattattattttttttgattggggggtacgttcaatttakcaaaatccttgttccsatctcctaacccacaatatgtaattgtactgctgtctatgtcggttgctgatggtttatgtttagaccggcattgcttagcaatgtaatcttgtgatgctatatcttgcttatctcagggattgacccaagatgamgcttaagtgcgcaatatgtttaagttgcaacttattctgtttaggtttaatagatgctaattgaacactttaatcgcgggagcctcctcagttcagatgttagtagaagttctaggatagtgagaggtgaacgtacagttgggattttatttttgttttacctcttgttcgaggtcgcgccgtgcttttttggcatcggccagacaatgtgtttattatttttattttcatgtttttttctctcctatttgtgtatgcctgttaaatgtgggttgatggggggggtaaatgttggggaaagtagggggacagggtggagagtaaaggtgcttgcagggggggaggggtgggttggatactgctcgggtgtaggtgctacatatgctgatcgtga

SEQ ID NO: 2097 - DNA, 85 bp, Salmo salar
  source 1..85: mol_type = unassigned DNA
atgcttttttttgctatcgtacctaacattttaacggtttacamcgacaggagctttgtatttcattcattttttacsaggaacg

SEQ ID NO: 2098 - DNA, 133 bp, Salmo salar
  source 1..133: mol_type = unassigned DNA
agatggcgccgacagacatggcagctctgcttctagctcctaagcaactttgcagtatttgtttttttgtgtgttatttcttacattattagcccagaacgttttttgtgttattacatacagccggaaataa

SEQ ID NO: 2099 - DNA, 97 bp, Salmo salar
  source 1..97: mol_type = unassigned DNA
gcgccggaggagatggctgccgttttacggkctcctaaccaattgtgctattatgtggggtttttttcgcgttatttgtaacttattttgtacataa

SEQ ID NO: 2100 - DNA, 333 bp, Salmo salar
  source 1..333: mol_type = unassigned DNA
gcccacaggactggaaaacccacmacckgcccaggtgataggcccaggccgaggtwgctkttctggawagagccaagaacttgwgaggaacgtatatcttcctcaacgaggactgtcctgaagctgtgcgccagaagaggaaagagctgatcccagccatgaaagctgccagagtgcgtggggacattgcktacatccgctacgacaggctcattgtccaccctccctcccagaagcctggaagggatgagagagccaagcctatgggttcgtagcctcaaccccacacacacacacacacacacaccaattgattaatggactgctgaatgt

SEQ ID NO: 2101 - DNA, 650 bp, Salmo salar
  source 1..650: mol_type = unassigned DNA
tggcgccggagaagaaggcagacgttttacgtgtccccaaccgattgtgtttttttgttcgtttatttgcgttgtttgtaacttatttttttacttattttgtacataatgttgccgctaccgtctcttatgaccgaaaataacttctggacatcaggactgcgattactcaccacggactggcagaatcctttttttcctttaacgagtctgacgagcccgacgcgaacgatatactgctttctcgggaacaggcccagatccccgtgatttgcgtgaagaggaggcggagaaaaaggggccagagggcgggctgccttctgagaattcgtaggcgatcgaataaacccccacttccttccattctgctagcaaacgtgcaatctttggasaataaaatagatgacctacgcggaagattaaactaccaacgggacattcaaaactgtaatatcttatgcttcacggagtcgtggctgaacgacgacactatcaacatacagctggctggttatacgctgtaccggcaggatagaacagcggcgtctggtaagacaaggggcggcggactatgtatttttgtaaataacagctggtgcacgatatctaaggaagtctcgagctattgctcgcctgaggtagagtatctc

SEQ ID NO: 2102 - DNA, 447 bp, Salmo salar
  source 1..447: mol_type = unassigned DNA
atccaagatggtagccaatcagtctgtccgtttgtatgtgtgatccttgagatcagagttttaagagtttttatgttttaatgaccctgatcctgtttacagaagcaaatactttttatgtgaaggtggatgctgtatataacaactattatttttagatctcagtctctattttacgaaatttacttgtacaaagatttcggattgagaaggcctttatttttttctacacctttctggagttggagctcgccgagtcaggagcgtctgtctgcgcgcaaggcctgctacgcgagcgcaggtgcgcactgaaggctaggagcggagaagcggttatcggattggaaaacctgatgcaccgtgggcggtgggaaaatctacgttgttctacacaacgtctactggtcgttgcacacctgtgctgaaatacctctaaaaaccggcatt

SEQ ID NO: 2103 - protein, 31 aa, Epsilonretrovirus sp.
PLTAVVASPTTVLSNLAPSLHWFTVIDLSNA

SEQ ID NO: 2104 - protein, 30 aa, Deltaretrovirus sp.
PIPALSPGPPDLTAIPTHLPHIICLDLKDA

SEQ ID NO: 2105 - DNA, 81 bp, Schmidtea mediterranea
  source 1..81: mol_type = unassigned DNA
tatacaaacaccgataaactataccttcccaatcccgatccagaattaaattcaacactttcgaaggtttgtcgaaagatt

SEQ ID NO: 2106 - DNA, 146 bp, Schmidtea mediterranea
  source 1..146: mol_type = unassigned DNA
tttacacattgacattcgatagcaccgggccgaaatccggatctgataagttattttattcaaaacaaccattactttattttccagataataatgaattaaatgctgatcctatctttgagaaaagtttgcaagaattacgtctt

SEQ ID NO: 2107 - DNA, 10 bp, Setaria italica
  source 1..10: mol_type = unassigned DNA
aactccgcct

SEQ ID NO: 2108 - DNA, 593 bp, Solenopsis invicta
  source 1..593: mol_type = unassigned DNA
tttttgtgttctcatctttttttgtctggtcttgatcatttgtggtgatgggtgtcatttttgtattgaatagattttttattcttattttaatatatttgaaaataaattctagaggatatccgttttatagaagtagtccaataattaattccaaatttttttgttggaaagtaggatgagatagcaatagcgctctatccaccatgttatagattgttccaattttatggcatattgggtggtgagaaaaaaacgataaataacgaccagagaaagtttttttatggaaccaatcaatgatgattgtattgtcggttatttttaatgacaggtccaagaaacttaggctacggtcctgttccaattcaatggtgaattgtaatctattatgaaaactgttaaatgtctcgaggataaaattgagtgagttcggaggtgctgccataacaatgtcgtcgacataacgataatagaacggtatttctagatttattgactttaacgctttttcttctaaaccgtgcaatacgatattcgctataatgggtgataagggcgatcccattggtgtaccaaaagtctgtttgtaa

SEQ ID NO: 2109 - DNA, 371 bp, Solenopsis invicta
  source 1..371: mol_type = unassigned DNA
  misc_difference 242: note = a, c, t, g, unknown or other
  misc_difference 254: note = a, c, t, g, unknown or other
ggactttgcggcggggctcggcctggtccttctgaaccggggccgggtcagcacctacgtgggggccgggggggagtccatcgtcgacgtgacgtgggcctcccccggcgcccttaacagggtaaagggatggcaagtggagaccggctccttggaagaactgtctgatcacagacttatctccatggagctggtctcccccccccccccccgcggaggtgcgtgagcaacgccgccgcaancgggccggaaancgatgggtcctgaagaaactcgaccccgaagccctcgaggtcagtctcctcgcctccacttggccggagggaggagctgacctcggagccgaggaggaggcggagcgcctatgcgag

SEQ ID NO: 2110 - DNA, 365 bp, Sorex araneus
  source 1..365: mol_type = unassigned DNA
atccactacccagccaccgccaccctccaggtcgctctccggacacttgggccgaacctcacgcacgagtgaagccccgcaaagccaggtaagcagaactttgcgaccttgagctctaggttcaacgagacctggaaacaagatcctctgtctgcctcctccaatctccggcatctgagggaggggtccaacccagacgccccaccctacccaagataaatacctcactggccgacccccactacatccactacccagccaccgccaccctccaggtcgctctccggaccgcggacacaccataaaacacttaatacccattattcccgcaccatatttgatagggttcaaatttggtgtgaacc

SEQ ID NO: 2111 - DNA, 174 bp, Strongylocentrotus purpuratus
  source 1..174: mol_type = unassigned DNA
ggggcacgcaacaagagtcctatctcgcaccccggggcaacgtgtctgacacggccggttgtagcaactacttcgaagatcaagattaagattaagattgagaataataataatttagacttagacttagagtaatattaagattacgattaagatcaagaccaacataacata

SEQ ID NO: 2112 - DNA, 354 bp, Strongylocentrotus purpuratus
  source 1..354: mol_type = unassigned DNA
  misc_difference 50: note = a, c, t, g, unknown or other
tgaatgcgcctagcaggcagccgtctctgtttttgctctgaattttaccntgttttaccactgataatctgagtgtatgctgttttattgttgatcaactgtcatcttatgtacttgtgacactgcatgacatttttgaggtgatgtatttatatattagatactggaaactgtttttctaaattttgattcaacggatgtgtacacagtacatgcaagtaaagccattttacactgggctgttacacatgtactatactgcgtggatgtgtgaacgtcgttcgtgtgtgactgatttgcctatccgtggtgtgacattcatctacatacaatgaatagtcttgatacgcactg

SEQ ID NO: 2113 - DNA, 153 bp, Strongylocentrotus purpuratus
  source 1..153: mol_type = unassigned DNA
ggtatgcggctctttatgtaggtaaccccttttaattagctcagggaaaatccacctcccctgccttgcatagatggcattggaaggtgtagcgagcctccattgtagctatactttgaatttattcttattagcaagctaagaaacactgaa

SEQ ID NO: 2114 - DNA, 538 bp, Strongylocentrotus purpuratus
  source 1..538: mol_type = unassigned DNA
ggaataccatcagagttggaacatggaatgtgagaacactgtatcagagcggcaagctggaaaatgttaaacaagagatgatgaggctaaatgtcaacatattgggactaaatgaaacaagatggctgaataacggcgagtttgtgatagatgagtacagattgatttatgcaggaggtgaaaagcatgaaagaggtgtggggttactgctggatccagatatctcaaagagtgtgttgggacactggtgtgtaagtgatagggtgctcctagtgaaattacagggacacccttttaacatctcaatcatagtggtttatgcaccaacggcagatagtgctgacgaagttattgacaccttttatgattccttagataaagctaaatctcagtgcaaatcgaatgacattgtcattgtcctgggagacctgaacgctaaagtcggtcatggtacagagggcaagcagtaggtccgcatggaattggtgaaaggaatgaacgaggggacagatgggttcagtggtgtgagggggagaac

SEQ ID NO: 2115 - DNA, 434 bp, Strongylocentrotus purpuratus
  source 1..434: mol_type = unassigned DNA
ttctctactataatcagtgtttttatcacagcactgaatagacataatcaataaagtaaagtaatatttggttggttcaattagtactcttatcataagagtaattgtaatcgcctcattcttttattaaatgttaattgtttttgccatgcttagttgtaaccactgccttgtggttcaggttctctttagaatctaactaaggctaagggagcaaaccctaacagaaaaccatgccaccgtgacagcattgagggcgattgacgatacggaactcccgacatccttcgaccagtcactgcagggtctagtggttcacacccgtcctggcttgtcctcgccggtgtgaaactgccaccagttccccgagagagtgccgttagtaacttgcaagagctaccggtacttatccacctttgcaagcagccttcatt

SEQ ID NO: 2116 - DNA, 847 bp, Strongylocentrotus purpuratus
  source 1..847: mol_type = unassigned DNA
tagtatgtgacaattatcatgatggaaaattcgattgtccaaatgggtaaagcatttgaatcttgaaagaattgtacggttgtcactaatcctaaattgtcatgattgtattccttccaggggacatgcagtagaactttgtatcatgcaggaatgtattctttaccctcaaatgggcttgagacaagtattcgttatcctttgatcttgacgactgggattatcaagaccgaagtcctcactctttatcaatcattattatctgtatagcattccaaaaatttgagtctatctgttatattgtaattgactgaacttttttttgttttttgagcgggaatgtcaaaaccctctttgccatttaatattattgtactccgaaatgacgttattgctattaagcatcatctcagagtctgcttacatgcatacatttttctcctccgcacaacaaatctctttgttttgcaaaactcctgtgtcaatcacagaatccattgttatagactgaactagttttgatgagcgggaatgtcaaatccctcttttccatttaataatcgtactccgatttgtcattattgttatcaagcattttgtttcttcccagcccctctattttgcgtgtcaaaaatacaccctttactcgggcggtcgggctccgctctgttgctcctaagcaattattgtaactgtgaccaagatgggtcttattgtattttcatttgtattatattttgaagttacccgcacacttgcacttcgtacacacacaaacgcaccagcatcacacatgcagttgttcatcctccaaattttcggtactttacataatacgtatcgttaa

SEQ ID NO: 2117 - DNA, 101 bp, Strongylocentrotus purpuratus
  source 1..101: mol_type = unassigned DNA
  misc_difference 28: note = a, c, t, g, unknown or other
gctgtagtagtctacatgtgtactgacnctactgatctgttcctgccagcaagtaatgtatgtattattagtagtagttcttcataattagatattgtgta

SEQ ID NO: 2118 - DNA, 134 bp, Strongylocentrotus purpuratus
  source 1..134: mol_type = unassigned DNA
aactaaagcaacaatttgaagtctatcatcgcgatcttatcgccagtaggcctacatctctagccctctatcatcagaagagtttcctacgcagttcctggaagcacgtgtccttttcaggacaagccatcaag

SEQ ID NO: 2119 - DNA, 96 bp, Strongylocentrotus purpuratus
  source 1..96: mol_type = unassigned DNA
gaccatatttttgttttgaaatccctgcttgacatttacttgtctaaacggaagagaatttactgcgcttttatagactatagaaaagcttttgat

SEQ ID NO: 2120 - protein, 30 aa, Deltaretrovirus sp.
DLSSSSPGPPDLSSLPTTLAHLQTIDLKDA

SEQ ID NO: 2121 - DNA, 947 bp, Tribolium castaneum
  source 1..947: mol_type = unassigned DNA
ataatctttaacaaaaatttgctttaaaataaaatgtttgaaaaaccgaaattaaactaaattaattgtgtctaacactttagtagaggaaaaaggagaagacataaaagtcaccaaagtcttcagagtcgtttttagtactaaatttgcttatatgcaagcgcttaattaaggtaacagttttttggtttcttgcttatatctcgaaaacagttactcctatcaatttttatctttttactaaaattaaagctgataaaatttcctacaaaatagttatttgcatttttcatgtaggactaaccataagcgagatataagtttgaaaataattaatatttaaaaaaagtgctttaacagaaaatgccttgtgatttaaaatacacttaatttattgggtccaatactttattatttactttatttttttggtgctatgctaggcttgtgctaatgtgctataaataaggtgttacaattttgtgctgtaaataaggtgttgtgcattttgtgctataaacgtcagttttttaatttttcgttaattatttgtggtaataacttaataagtgactaaggtttaaggttatgttaaactgtagtcaatagcgttttgcatttcttttggactttcaaacatttatactttacacaaagagttatactgatataaatgacgtgatcaatgctcgtactataaccaataatccaattttgtgctactttttatgaacattagtttttacatgtaaatttcatatcagaggcgtacgcttctagaattgctgataataattattattctatcctctgttccttttgtgtcctttccgtggcctacctgtgcttgtttttttattttgagtcactacgaacggccgcgtagtgtgaagcgtgtgtccttgtctttattcccttgcctgattgtatttatcaactcactcata

SEQ ID NO: 2122 - DNA, 484 bp, Tribolium castaneum
  source 1..484: mol_type = unassigned DNA
attctaagcattgtaaaagtattttttatcatataatatgtatgaaatggttcaagaaaacacaagaataaccgcacgcagtaaaacaagaatagacaatgtttttacaaatatgacctttaataactttaaaatagaagttcttgaaccacacatatcggatcacatgggtatacagctaactacgagcataaaaaataatactaataatactgatgcagtaaaaaacgttagaattttaaatgtatatgcatgtaatcgcaatgatatcaatgctcagtggagcaattttataaatattttcaatgataaatttaacgaatgttttcctctaaaacaaataaaagaaaaaaaaacaagaaaatatttataaaaatgatcctaaagtaaaatattataaatattatctagatttgttatctgtgataagtaagtgtgacgataaatatgttattctttataagtatttgaaaaaaaatacgac

SEQ ID NO: 2123 - protein, 31 aa, Spumavirus sp.
NKELPYWKSNGFVNNKKKPLKHISKWKSIAE

SEQ ID NO: 2124 - DNA, 423 bp, Xenopus laevis
  source 1..423: mol_type = unassigned DNA
caccctcccccagggaagacacatctgcaagggctcccagggcactgttaaaatctgcacccatccgtgctttacaagtccccttctgccaacatctcccacaccagcagcctaaaagggacatccgctgcctaaaggaggaaaaactggctctctagcacacacagagccggagaacaaaacggggcctacctcctcgacagaagccggggactcgagtagtagaggtacccgggaccgagctggggcctgaactgcagggcagactgctggcctggtgacgtggggcacctcgggggagactgtgggcctagtggcggacaagatggcggcgcgacagtagattgcagcggcctctccggatcacaaggtgctttcttttttgtgttttttgtgcttttttactttgttttttgtgaagct

SEQ ID NO: 2125 - DNA, 927 bp, Xenopus laevis
  source 1..927: mol_type = unassigned DNA
ccccagacctgtgtgcagcagctcccagcttttactctccctatttattaagacctctttaggggagagcatttgctggggtgagcatttgcaagggtgctattcgaagtgattcatttacaagtgatctggaagagtttaacaaggagttatgaattgacatctctcttcctcttctgtttattacaggtaaatctgctaaaactgctattcccatctctgctgtggccctgttgtctgcatttttgcacctttattggtaaatctgctaaaactgctatgcattcccttccatctctgctgtggccctgttgtctgcatttttgcaccatttattggtaaatctgctaaaactgctattgcattccttccatctctgctgtggccctgttgtctgcatttttgcaccatttattggtaaatctgctaaaactgctatttccatctgcattacacctacactgtttagtgagttatatttatgcattgttcatttgccacttctaaactagtcacataatattgattataagttctccctgtagtcttgtaacttgtacattttacgaccccctataaactcctctccaaacaaactttgtaagtcaggttatctctgtattcatcctgagtcttgctctgctctcactctctgtcacagctgggtgatcagtttggtgtttgatcaattagaatcagttgtgattccccagacctgtgtgcagcagctcccagcttctactctccctatttattaagacctctttaggggagagcatttgctggggtgagcatttgcaagggtgattcgtttcgaagtgattcatttacaagtgatctggaagagtttaacaaggaaagctacaaggagagacaacacagaggactccattaaggacataacactgctaccggctagaaactgca

SEQ ID NO: 2126 - DNA, 24 bp, Xenopus tropicalis
  source 1..24: mol_type = unassigned DNA
ttgttttagacttaattctactag

SEQ ID NO: 2127 - DNA, 785 bp, Xenopus tropicalis
  source 1..785: mol_type = unassigned DNA
agtcctgtgttcaggagtggcccagcttgctctccctatatcttaagaacctcatttgggaaagcagcgcaagggtagcagcgcacaagtgaatccttccaaagtgaatcattcacaagtgaactggaaaaggagtttaacaaggagttaggaattgacaccctctctcttctgcttattctacaggtaattgctgcactatttccatctccactgtggccctgaatactgcatttttgctagtttattgggtaattgctgcactatttccatcttcactgtggccctgaatactgcattttgctagtttattgggtaatttagctagttctatttccattctcaattcccaatattgcatgccccctattcctgtgctccaccaatttgttgattttatgacccccatcgtaaactcctctaaacaaactttgtagttcagtgtatctttgggctgatcttcacttgtgcacttctctcatcctgggactcagctgattgatttaatttgttatttaactagctgcaatcagctctgattccccagtcctgtgttcaggagtggcccagcttgctctccctatatcttaagaacctcatttgggaaagcagcgcgggtagcagcgcacaagtgaatccttccaaagtgaatcattcacaagtgaactgaaaaaggagtttaacaaggagttcaacaagaggagcaacaggaggagcaacagcagaagaccggccagcctctgtccatttgaatcgggacccagtttactggatatacctgcata

SEQ ID NO: 2128 - DNA, 1348 bp, Zea mays
  source 1..1348: mol_type = unassigned DNA
gggaaaccataactgtggaacaattgcttaatccctttgctagtgttcaccaggttcatcctgacaccctggagctaaaggatgtggctgtttaccgatgttctgcttggtgtttagacccgtccttggtgcctgcttcaagggagctttggatcgtcgaacctccctttgccgttgatgggatgtcttctggcaggagaacgctgatgtatccaatccgcatcacattctcgtctgccccacggagggatggatccgatcctaagcttcatgctattacttcgggcggggatggttctggtcacgtgcagcagggatcccctcctttttcaagacctccccattcgagtgggagaaggggagaacatggtcattcgggacgtctctcagttcatgagcgtttgggcccaagagatgagaacatgcagcagcggagcattagctccggggtggcagtttcagatttgaggagaactttggaatctgatggggggaccttgtctcctaggctggtagagatgactgatgacatggttcttgtttcaccggtgaaggcgaagcagctgaaagtttattttcgtcaaagattcaagaatgtcctgaaccaggaggaagctggaactcccaattctgtcactgtgcttcctccatcccccacagacgtggcagctgctgacacagatccatctgagtatcctgtttcagatgttgacgctgtgttggcaactccgtctagaacattacctccctccctgtctgatgtggcagcagcacacgcggctccgtcggaggctaatgccttagacgttgatgctgagttggctgctccatctgaggaggacatttcagcaacaacacatgctgcgttggctgctccatctgaggaccctccagcaacaacacaagattctgtggagatttgtgctcaagagcaattcatcagcaaattgtcaaaccagatcacacgcgtattaccaatcccaaaatctgtcagacgtcagtcctctatccccctggcagttccaagacgcagccgacgtgtggcgggggttggagttgaatttaaaattcaggattggggaaaaagatctaagaaacaagctatggtggctctaaatattattgaggacaatgaaggattcagccgtcaagctttagatgactacgccaagctcttcaagaatactctttctcgtagtcatgtgcaggctcttgctgccctttttgggtggtctgtcccagataatttagaatatataactgggactggggatattaccgcaacaagcttattttagctggcgatgttgctgatattgtttgtcgatttacctctcattgtttctac

SEQ ID NO: 2129 - DNA, 353 bp, Zea mays
  source 1..353: mol_type = unassigned DNA
aatggcaagggtcttcgcatctgtctcaacgggtgcgaggggtggaagctagttgagccgactaggatccgtgtaggtagttggaacgtagggtcccttacaggtaagctaagagttagtcgatgcagcgagcaggaggcgtgttagtatcgacaaaatggaaggggcaaaaagcgaaggaggtggagaacactggtttactttggtactcaggaacagtggcaaacaaaaatgagtaggtatcctgattgataagaccctcaaggatggagtggtggacgtcaaaaggcagggagataggattatcctagtcaaacagtttggggatgtagtcttgaacattataagtgcat

SEQ ID NO: 2130 - DNA, 144 bp, Zea mays
  source 1..144: mol_type = unassigned DNA
  misc_difference 107: note = a, c, t, g, unknown or other
gtctagtcagcagaatcccccaaccctagtgaaacttgacagagtatttatgcacactggactgggtggatttgtttccaaattccttgcttcagagttctgcctcnaatgactcagaccactgccccctccttttgggcctga

SEQ ID NO: 2131 - DNA, 272 bp, Strongylocentrotus purpuratus
  source 1..272: mol_type = unassigned DNA
tgaatggctcagccgtacatacactacgtgcatgttctgtaatatttacatgtcttattcacataattgcgacttaattaatattttcctattgacattactgcttactaggttaatgatatatgttaattttgcaaacgagtattatttttgtaactgttctgtataaatgttataaacgatgtaaatatgttcattcagggccccatggaagaccactacttgctggtgaatgggctaccctgtcaaaagatcagaaataaataaataaa

SEQ ID NO: 2132 - DNA, 275 bp, Ixodes scapularis
  source 1..275: mol_type = unassigned DNA
tgatcagttgaagcgctgatgtagtatttgctttttgctctcacacctggtgatgtctctgttttgtgcttttgatttcccttgttaatctgagtgtttttcatacttgttaatatttttattctcagactggagaactacgttctccttctgcactcgtgtgtatgcgtgtttgtatgtgtgtgtttttgctcatttttttttagtgtgccagcactaagaccgattggttgttcctggacactttaataaacattgattgattgattgattga

SEQ ID NO: 2133 - DNA, 42 bp, Drosophila simulans
  source 1..42: mol_type = unassigned DNA
taaaattaaattatatacatacattattatatacatcataca

SEQ ID NO: 2134 - DNA, 428 bp, Melopsittacus undulatus
  source 1..428: mol_type = unassigned DNA
tgatgaagggagtggaacacctcccttatgaggagaggctgagggagctgggtctctttagcttggagaagaggagactgaggggtgacctcatcagtgtttacaaatatgtaaagggtgggtgtcaggatgatggagctaggcttttttcagtgatatccagtgataggacaaggggcaatgggtgtaaactggagcataggaggttccacgttaacatcaggaagaacttctttactgtaagagtgacagagcactggaacaggttgcccaggggggttgtggagtctcctacgttggagatattcaaggcccgcctggacaagttcctgtgtgatgtactctaggttaccctgctcttgcaggggggttggactagatgatcttttgaggtcccttccaacccttgggattctgtgattctgtga

SEQ ID NO: 2135 - DNA, 232 bp, unidentified
  source 1..232: mol_type = unassigned DNA; note = Description of Unknown:Blumeria graminis sequence
taagtcctggcgaaatagaggtttttcaggacaaagagttgtgaggaaggagggaatgcgcagggcgcttaattttcttggaacttatttctttatttatgttttacgtatagatttgacaagcaaactatgtacttaggttgtagtgtgtcccgagggagcatagacccgtatcacgcctattgggtgtagggcgtaagcctgatacgaaatgaaatcaaatcaaatcaaa

SEQ ID NO: 2136 - DNA, 27 bp, Esox lucius
  source 1..27: mol_type = unassigned DNA
taagcggaagatgatgcaatgcaatgc

SEQ ID NO: 2137 - DNA, 538 bp, Aedes aegypti
  source 1..538: mol_type = unassigned DNA
tgatgcgattcagaacgactggagttgaagaagagaggagagaagatcaccatattgtgcattgccagaataaaggtattgtaagtacaaatcaatgttttaaatatgtaaaatggaagtcaaacaagtatacgttatactgggaaggtttaatttaatggtaagtgaaattattacaaaacataatcaatagcaccaatcgtaattttcatatattatatatcaaacaggacacccaattgaagcaatatggatgaggagagtggaattgccaactccttatcgctaacatactgttgatagagggatggtccttaaaccccactcattgagacatccttttgtatgatgaaatgaccggtagatcggtgaccagtatctaggttataatttttggaatgccttaggtaaaccttaaataatagcaaagaactgaaacaatcaactggataacatcatataaaacggacagtctactgtctaacggctgtgccatgcaacaatgagtggttacccttacatacatacatacatacat

SEQ ID NO: 2138 - DNA, 89 bp, Oryzias latipes
  source 1..89: mol_type = unassigned DNA
taatttatatctttttactttttattatgtatactgtatttgtatcttttttctatggaccacatctgagtctgaaataaaagtgtgtt

SEQ ID NO: 2139 - DNA, 465 bp, Solenopsis invicta
  source 1..465: mol_type = unassigned DNA
taggttcatcaccccttctccttctattcctttcgttcgggccaccgaggctatctcgtttcggtctatattatttgtatctattctcaccgagatgtaacatcccatctcaaggctgtgacacgagttttggtgcttagaggtaatttgtatttgattttcgctttgacttatctcctctttttcccttttttgttgaatttacattactttatagaagtgtattttttacaattttatatctaatgacttgtacagcttccatttttattcttatttatttatttattgaattttttacttatattccgcttattcttcttttttaactatttaattttcattgttgtatgccacaagttttatagtcatcattttaacatctttctcttatttatttatttatttgttagcaaccaatcgatgttgtttcacaaaactcttgtctcggcacacgctctgtga

SEQ ID NO: 2140 - DNA, 216 bp, unidentified
  source 1..216: mol_type = unassigned DNA; note = Description of Unknown:Virilis group sequence
taaaataatgtatgtaaaatgttcgaaataatgtttaatttattgtattataattgttaattgttttttgtatcttggtgttagtgccctgaagacggtttgccgatgtgcaaccgaaatatatcggaagagaattgaataaaattgtttttcattgtttgttttaacaaacacggacctcgagccagccaacaaataaatattgaaatatggaaa

SEQ ID NO: 2141 - DNA, 322 bp, Strongylocentrotus purpuratus
  source 1..322: mol_type = unassigned DNA
tagcttttaaagctatcagggatccccttaacttatgtcgatcctgtaataatatataaaatgaagtatttgcggtttttccatgaacaattgcaactaactcccatctcgccttttatgtgcattttatgcaattttaatattgcagctttttttttttttttttttttataaaaccatatcactattaatttcatttcaccaaggaaagtcgctcgtgggcttgatttccgaagcccacgccaaagctatacacgaaattgactggcgcaaataatctttgagattgaagagcgccatctaaacgaagaaccaaccaacc

SEQ ID NO: 2142 - DNA, 243 bp, Xenopus tropicalis
  source 1..243: mol_type = unassigned DNA
tagcaataccctgtgccccacctctcacaactctggtcatgcccattcccacaccttgtgtctcaaccctttctccttgtagattgtaagctcttttgggcagggccctcttcacctcttgtatcggttattgattgctttatatgttactctgtatgtccaatgtatgtaacccacttattgtacagcgctgcggaatatgttggcgctttataaataaatgttaatgtaatgtaatgtaat

SEQ ID NO: 2143 - DNA, 150 bp, Vitis vinifera
  source 1..150: mol_type = unassigned DNA
taagggtgtggatagggtggctcttcgttccttggcaggctgctagggagcgtggggtgtttttctttctttttcttttctccttcttgtacttttagccactgcttcggtggtttttaatacaatctctttatttatcaaaaaaaaaaa

SEQ ID NO: 2144 - DNA, 257 bp, Schmidtea mediterranea
  source 1..257: mol_type = unassigned DNA
tagaagggaaacaaaggaaaaacgaaatgactggtaactatgaaggatatagctgaaagccgaaaggaaggctaagtcctgaaaccgatctacatcttcgatcccaagaggaactgtgggttaagcttgagccgacggaaaaagcgaatgcatgttagacgacgaggtacagtcacctcctcgtggtatttggcgggcaatgctcactaaattaactgtgagtagctgagaactgtatgtgtatcatgaaaaaaaaa

SEQ ID NO: 2145 - DNA, 257 bp, unidentified
  source 1..257: mol_type = unassigned DNA; note = Description of Unknown:Nasonia vitripennis sequence
tagtggggccataacacctaggccccacagtgtggcgatgtccatgtgtgtcgtccttatttatttatttatttgtcctgtcgagctgtttaatttattcacatgtatgtgttgtgtgtgtcgtccctcgtagcagttttattccgtccaaccagaggtcgaccaagattaaaataagcatggcttgaagcaggccaagcgccatgttctaaccccgttttaggggaagttacttaacctaaaaatacaacttttcc

SEQ ID NO: 2146 - DNA, 500 bp, Schmidtea mediterranea
  source 1..500: mol_type = unassigned DNA
taaaagggcaaaaagatatttcaagatgaattgtggactcatctaaaaaatgaccacctcgagcccaaataagcctagctatcatggttgctgatggaaacagtaaggcacctgatagctaactcttcaccgtgggtgtcttcagacactcacggtgacaagaaaggacaccactagtaaaaaccactagttttctgacacctcttgctacaaactctgtaaaaatcaaaaggatcgataggccgcgctttcacggtctgtattcgtactgaaaatcaagatcaaggaagcttttcccattttagtcaacaccaggtttctgtcctagttgagcttcccttgggacatctgcgttaccatttgacagatgtaccgccccagtcaaactccccacctgtcctcaaaacagttcaattgcatccaaagatcgcaattttttcactaaaaaaaattaacaaaagttaattatactgcttcattgagtaagtagaaaaacaatc

SEQ ID NO: 2147 - DNA, 328 bp, Taeniopygia guttata
  source 1..328: mol_type = unassigned DNA
taattcaggttatttagatgcttagtttatgtacctttcttgatttgtctaggattttgatagtgttattatttttatatttttgtacgattgcataatgttcttttttatacagctctgttttaataaaatagacgatacctagagacgttagggcagccacaagccagttaggtagcggatagtaggtaggaacagacttttactatttcataacgcgtcaattaccacctgatttggaccaattcacgggatttgtccaaggtggacgggccacctttacttaaccaggaaaaggaacatatataatttatgtgtgttcgataaa

SEQ ID NO: 2148 - DNA, 4172 bp, Aedes aegypti
  source 1..4172: mol_type = unassigned DNA
tagtaaataattgaagaagtatcaaaaaaaaaaaaaaacatacacaaaaacctacaaaatttacacacacgcataaacatattggaaaataacacatatgagtatgcacaaatacgaattatacatataaaaagatacgaaaacaaatatacatacacaaaaacatatgataactcacacgaaacactaatacactcaatcactcataaacacatacaaaataatcaataatgaaaattactctgaaaatacacaaaacatagatactaaaataaacacacacataaattacacataaacacatatacagtattgaacagaacatttgcaactttttcggttttccatacggaatggccggttttggtaggtttgatctcggttgtttgtgggccgaattgagtgagattttcacggagcattggatttcggcacgtgtttttgaatggtttttccgattatgggtttggatgtagtggcggtttgactgaagtgaaatttgaaatttaatacccctacacaaaaactgtcttcagcaaacttgttcatagcgtcaaaatagacaactttgctgaaaatatcatcaagctattctgttaacgtgttgagttatgtcaataaaaaaaaaatcgtaataagggtcgctttggtcaaaccattaatgcttttgaactcgtggttggggggatcagtcggaggcatgtgttgaggttcgggttgtgcctggtgttctgtgggggtttcattcggatcggtccgtggatagctggggtctggcttgccggggttggtcgtttcgtgtggggaccggggaggttgcgagtgttttgtcaaatactgtaaatacatacaagacaaaataacacaagcacatgtatatatatatgagaacacatgcagaaatagacattgacttataacacaaattaaagctgttttaaaaagataattactcaattttaataataaacacatagcattagtacaagaatgacatgcagtcatcagtcgtttgagttggttaaaagaaaataaaattgttcgatttaaaaaatgcaaggaatttgaatatcatataattaactagaaataataactacacttgtttactttcgaggaatgattagaatatctcgcgttcggtatcgtggctgtggtgatcggtttcacttcgtcgattttccttttaactaattacttggccgggcgactgtttttgactgctatttagattgagattgtccattgtcatgctaaatcgtaaagtgttaccaaaatctattgaacttcgtgtattaacccttactcgacgaagagagatcgatcactgcgggtacgcctgtatgatgctgaacgcaagttatgaatatagaaaactcttctcttcacttttgcatgggatgttttagattagcagtgtttgttcgttttactggtgattttagtgatgtcattgtgttgtgtgggtttttcttttatagccagtagattgttgcagagcgcccaaaggggttcagattatgatcatagtggaatttattattttcttgttataaataatataagaatataaagaataattacaattatcttcattgtacaatgcaaatcataaactgaactccttaataataaatgtctagttattttttatatgttaaccaattagaagttttgaagtagtacaataaagtagattagtaaatgtgtatatgccgaaaaaaagtcttaatgccaaccaaagttataacaaggttcagtcgtagcattaaaattcagaataacttgtcatgccgactgaatgttgtttataaaaatcaaagaagaataatcataataataaaaataaacatggtggagggaaatgatagcaacgagaagcatcataataattctatgagaaacttatagcaggttataaataaatatgatgattatttctactgttaacttattattcaaatctttaaaaatagttatagaatgaaacattgctattgcctgatatgaaattaaaataattgaaaaaacattaataaaatcaataattagttttgaattcaaaaaaaaaaataaataaatacaaatattaaaaataataaagatacataatgatttggatgatgtgagggaggatgggaggtcgttgctatcatttgtctgtatgtataaacataaaataaatgttaaaataaacaagtatgtataattttagtcgctattaactgatggatatactggtaagaatacatattcgtcttgtttgcgagcagtgaacagtaaattatacatctattgcagtttaacctgatgaaactacagagtataatgaccgttacataaccgaattatattaacactagtatgttaaattcaaatttctaatgaattaaatttcatttctattaaatttatagagaacaaaataggaataatcgatggatcgatgttggagctgcaaacagactaaagctgcatattgcacacggtcctctatggagttatatttcataatttcttctctctatatataaaacattttaggggcagcagcaggaaggtgtgagcatttaaatagtgttaaaattgaagctctgaaccgtatttctcttaggtacgaaaagcgttaaaaacaaaacgtaggatgtacggagtatcataatggttatattatattgtagtttattgtacgagaccttttagaacaataaatcgtcaattgggaaattcggatatgaagtggtgttgcacgaaagtaacatcagtagcaacagtgttgtcgtttcatacaagggactagtgtgtaatgttattttatgttatattgtgtagcgttgtactatatctactgttcataggtaataaataggtatacaaataattcctttggcgcataaaataacagataattcttattccttatagctactagtccagtggaggtgcacgaattacttatttataattgttttgttatactaattcattggcagaaattccagaagcgtcatggagtcatcggagatactaacataatcactgctattaatatttcagcagttctattccgaaaactgtaattcgtccttactctggagactacctaacgaggttcaattcatcacaatttaagaatggaaattctgaaacatctatattcatatcatatacaactataaattccattctatatattttattatagttatttcatttattatatgctgggtattgagagggtgcattagggcatcagagaagtcacagatggacgatgtagtagggtgtcagccgaaatctaggagaatgtgccgtaacatccttacactacatgctgctacttataaatgactttaatgtaattatctttgtttactacagtaggctatagcgaatgaaacgaagcgtcggatgtattattattttgtttgtactccatgaacatatggaagctggaattttgtttttgatgtatccggaaactttattaacatatcactgatttttttatttttattcaaattatttgtttattcttatcattcttctgtcgaccagcctaggagcatctgtagcacaaatattcaaaagaaaattatatgtcggccgatataatactgcatgctgtttcactgcgtcataatttattgtaactaccattttattttcatattttattatcatattattatatatatatacattataatcttatctactatataacatatcaatataattgaatttttcatgatttgggaagggagggagcatcagggcatcattgaaattacaactggacaatgaagtggagtgccaatcggagtcaggaggaaaagtggtagtcgttcacgtctagtacttttctctccaacagttgtgaaagatttgacgcgcccttcttctaacaaacctttccgtggaaagctcgacaagtaatgcaaattctaatactcaatctgttggatcatatggctggaaggagattctctatttcccgcgggtttcgcgtaagtgtttctacttacgggtccgccaccccccttttggcccttcatacagcgatatgttgaatgcagattggtaataaaatttgaccttactgttgagtggagccgcatgcagagcaagactcaagcaaggattggtggctacctacatacatacataca

SEQ ID NO: 2149 - DNA, 45 bp, Folsomia candida
  source 1..45: mol_type = unassigned DNA
taagtgtatttcatactttatcaatgtttatgttaataaataatt

SEQ ID NO: 2150 - DNA, 321 bp, Nematostella vectensis
  source 1..321: mol_type = unassigned DNA
taaaaccggatatccattctcatgttaattgttattgcatgttaattaatgtttgtctgtttgcacttgtttctatgttgacgtctgcctgtttttgtagttagttttgtcgttagtttttagttgctttatcaagatgtagtattagtgatgtcttgtatagtttaatttccaagtttcccctttgtatttccgtaaatgtctaacatagttttttttattattatcataggtacttagatatagggagggccatatattataaaactgtaaaaggttaatatgaaaccctcgttaaataaagtttattgtattgtattg

SEQ ID NO: 2151 - DNA, 181 bp, Aedes aegypti
  source 1..181: mol_type = unassigned DNA
tgagatgtccatattgaattactgaaatgtaatgagttaatgttagtattaagtagaaaataagaaacattgttagattatatgcttgctccctcgaaatattttacttttcgagtggctggacacagttaattatgtaacttttaaagctgcgttgttaaataaagcaaaaaaaataaaa

SEQ ID NO: 2152 - DNA, 59 bp, Aedes aegypti
  source 1..59: mol_type = unassigned DNA
taagtaaatcagtctgtaggaaatttatccaagacgttgcaaataaataaataaataaa

SEQ ID NO: 2153 - DNA, 70 bp, Caenorhabditis sp.
  source 1..70: mol_type = unassigned DNA
taacatgtaactatttgtttgatgtataagaggcctattggtctttcactcaataaactcatcatcatca

SEQ ID NO: 2154 - DNA, 219 bp, Caenorhabditis elegans
  source 1..219: mol_type = unassigned DNA
tgatctcatttcctcactcatttgtacatgatgtcatatttttttatttatttttttattattttctcatcaacttttcttggaaatcatttgtatcatctgacctcggacatgttccaatcgtgtcaccttatcattcacatttcttacctcatctcatttttattcctcattttgctcttaattttcaaggcaagaaatagtgaataaataaattaa

SEQ ID NO: 2155 - DNA, 43 bp, Caenorhabditis sp.
  source 1..43: mol_type = unassigned DNA
tgagcgaagaacggatcgactaagtaactaagtaagtaagtaa

SEQ ID NO: 2156 - DNA, 635 bp, Caenorhabditis sp.
  source 1..635: mol_type = unassigned DNA
tgaataccgtcagataagcccccaacataaaaataaaagtcggcgttagctaatcactaaaccggctcctcattgggggagagtatcattccggtgctctccgtttgggcggtagggaggagttgggtagcgacccggaagtatggatgcccaaccaccgcaatctgatctggcaatgtgtttcggatggtctctgtctctagatctgaaatagagctctggcctgaagaacacacgcgcggaccggttggatgccgacttgatctggagggtgcaaacctgaaagggaaagttgaaggccgtgaggctcctggcgggaaactccgtcatagtcagtggtgtgccaacacccgacgactatgacatagttggaggaatcctgatctgataataatcattgttcatataagggagggggatggtaaatacccagggtccgaaaccatcaaagcagctactgaccagcatagtagtgatgaacacatagaccctggggttccctgaactcgacccatctgcacaaacccactttgtacaaatgaaccaaactgatgaagagtttaatgatttcttacatcacagctagcggacctaccgtgaggtagactcccgccgctgtagcaggctcgccattg

SEQ ID NO: 2157 - DNA, 161 bp, Caenorhabditis sp.
  source 1..161: mol_type = unassigned DNA
tgatttttttttttctttctttattctccctcccccttgcccaacacctattttataattccttattcccggtttcctttctcaggtttagtctcgtgagggactgtacctgacctccagtgacattttctgtatatttaaatagttaaataaaatatcaa

SEQ ID NO: 2158 - DNA, 456 bp, unidentified
  source 1..456: mol_type = unassigned DNA; note = Description of Unknown:Copidosoma floridanum sequence
tagagcaacagatttactgtaatttaaatttgcgagttcgttgacttgtactggggtggggtggctgtagcgttgtgtgacttaaatatactcatgtacagtgtcacacttacactgaccgatagtatataagcacgatcgtaacttaagaagtgcgtatttttcgatctaccatctatcgtgatgcctatagtcgctattgtcgtggctatgtgagtgttcattattgtgcgattttcttgtaaagtattgatgacttgaaatataattgtttcatatttttatatttttataattgttatttagaaagttgtacctgatgagggccttgtaacgtggtttactgtacgggccggaacgttgtttacagcaataaacgattttgatggcatcacgaagagagtcattatttcttgataaaaattatctgcaatcacgagagccactgacgaacta

SEQ ID NO: 2159 - DNA, 153 bp, Crassostrea gigas
  source 1..153: mol_type = unassigned DNA
tgagtttcactttgtataacttttcctaactctataacctttatattaatatatgtttacctctgatcaatttatatgtatattttaatgttatttttgtcctcatgtaccatatgtttgaaatggttttgagcgaataaatgaacttgaact

SEQ ID NO: 2160 - DNA, 129 bp, Culex quinquefasciatus
  source 1..129: mol_type = unassigned DNA
taaatcatgttttgtttaaatttatgttttgataacttgactatatgtatgtttgtaaagttcttattagttttaagcaaccaaacttcattgagaccaccgggtcagatgatttcaaataaacaaatc

SEQ ID NO: 2161 - DNA, 314 bp, Culex quinquefasciatus
  source 1..314: mol_type = unassigned DNA
taattattttgttagttaattctccgattcattccctcgtttgtatttgtatccatcttgaacacatttatcttggtagttttcttttatttattttcagccgctaatcgccagaaaccgaactccttaaaaggtctacgccgatggagttctggagccagccgcatcaactttgtcgttacatttttatttaattttcaatgacatgtaatctacttaatttgtattgcacattgaaaagaaacagttttttcagtcagcactttgctggctttttctgtcaaataaaaacaatcaatcaatcaatcaatcaa

SEQ ID NO: 2162 - DNA, 64 bp, Culex quinquefasciatus
  source 1..64: mol_type = unassigned DNA
tgaagtggcatcccataggtgtggctgtgaaggagagcatgtcatgacggtcggcttctctaca

SEQ ID NO: 2163 - DNA, 27 bp, Culex quinquefasciatus
  source 1..27: mol_type = unassigned DNA
tagcgccaataaaagtaaagtaagtaa

SEQ ID NO: 2164 - DNA, 165 bp, Culex quinquefasciatus
  source 1..165: mol_type = unassigned DNA
tagatccagattagattttagttttttttttctcacccgttcagagaattgacaatttctttggctccaaatgtacaatctccttatcccttccttgccctgatacaaagtgtaaactaacaggatatcgttaccaaataaattacaattacaattacaattaca

SEQ ID NO: 2165 - DNA, 208 bp, Danio rerio
  source 1..208: mol_type = unassigned DNA
attgtgctgaacttgaattagatattggatatgtacaagtgtttactcgttgtttttggaaccaaggtgtgcagtatgaaatgtaatcttattattgtttttatatgtatgtaacttatttatctatttttagtatggagagctctgctgtgacatgtgaatttccctccggggattaataaagtcaaactaaactaaactaaactaa

SEQ ID NO: 2166 - DNA, 535 bp, Danio rerio
  source 1..535: mol_type = unassigned DNA
gaaaagagatcatatctcccctgtccttgcctcattgcactggctacctataaaatacagggttgattttaaaattcttcttttcacttataaagctttgcacaattctgccccggcctatgtcagcgagcttattaggccatatacagcttgcagattcttaagatcacatgatcagtttcttttgtctgtccctcggtctcgctgcaagtcaaagggtgatcgagctttcagtgttgcggccccaaggctctggaatagtctccctctgaatatcagaatctctccttctttggatgcttttaaatctaacttaaagacacatttttactctcttgcctttgactgatgcatgcatgttatttttgtattatttatattttagtattacttttaaatatattttattgtatttttaataccagttatttttagttttattgtctagtttattttattgtaaagcactttggatcaactacggttgtgttaaattgtgctctataaataaagtttgccttgccttgccttgcct

SEQ ID NO: 2167 - DNA, 140 bp, Danio rerio
  source 1..140: mol_type = unassigned DNA
tgtatggatgttgtatagtagtatttttttatttttattttttaatgtgtacatggaacttcgcctgtgtatggtaccttgttgcaatttagtttccctaacgggataataaagctgagtctgagtctgagtctgagtct

SEQ ID NO: 2168 - DNA, 523 bp, Danio rerio
  source 1..523: mol_type = unassigned DNA
taatttatgcaatatcttgctgctcgtgccatatattaattaattattacgggttttaatgcgtggaagtctgtgcattatgttctatgatgtgcaatagtctattaggtgcaatatttgtacgtttttttactgggtcttaaatatttttagtgcaatatctttgttttttaaatgagtgctgaatgactttactacttgaattattgtatgtgtaattgttttatgtgtaatattattggttttggttaatattattttcattacttgatatatgacttattagtattagttaccactgattcttttaagtgtaatatcttatataatagtttgtatacttatgtattgtggctgttttcttttatagattggttggatttatgtgacttatttcacttacttaatttatttattttgtcttgtggttttgtgtttctgtgttctgtgtgttatggcagtcattacataagcaatttcctgcgggataaataaagttttctaagtctaagtctaagtctaa

SEQ ID NO: 2169 - DNA, 147 bp, Danio rerio
  source 1..147: mol_type = unassigned DNA
taaaaggcttttgtaagacctatagcactcaactaattaacaaaattttaattatttattgagacatattcgcatattaatataaatgagtaaataaataaaatgaatagtataaatgaataaaatgggtattaaacaagatataat

SEQ ID NO: 2170 - DNA, 165 bp, Danio rerio
  source 1..165: mol_type = unassigned DNA
taatctttattgtggttgttgctgtaatacttttattcctattattacttttattgttatcttttactcttttagagtgtgtgctatggttttgttcagcactttggtcagtgccaaactgaagtaaatgtgctttataaataaactttacttacttacttactt

SEQ ID NO: 2171 - DNA, 46 bp, Danio rerio
  source 1..46: mol_type = unassigned DNA
taggatacgtcatccatggtcaacactgaccgacggaggcctacta

SEQ ID NO: 2172 - DNA, 492 bp, Danio rerio
  source 1..492: mol_type = unassigned DNA
gatgcaggactgccagactcaagaactctttcttcccatcagccatcagacttctaaacagataaccaacgcacataacagtctatttttctgctcagtacaacactacatactccatcccattttgcactattttattttttattctttttttttgcacataatccaattgcactaggcacttttttgcataataagcacaataaaaaacaacaaaaacaaaaaacactgtacactgtttacatctgtttcattactcaaatcaggtttacatattgtttactttcatagatatttatatacttatattttacattcaatcttcggtcacttctgtgtatatatgtgtatttatgtgtatgttgtgtatgatgtgtatgttgtgtgtttgacttcactgtggacggcaaagtaagaatctcattgtacagggagacgtgtttccttactgtgcacatgacaataaacagttgaattgaattgaattgaatt

SEQ ID NO: 2173 - DNA, 31 bp, Drosophila ananassae
  source 1..31: mol_type = unassigned DNA
tagggttgtgatggccatttatatattatat

SEQ ID NO: 2174 - DNA, 817 bp, Drosophila ananassae
  source 1..817: mol_type = unassigned DNA
tgataccacacctgacctagtctccattactacctcacagatggccataactacagaacccgacgccatgacacagcaacgccccgccaatagccgtgcagcaacagcccactaatacgacgcacagacgcccgatccagccgccactgctccgattacaaaaacaagcgactgcgtccaggcagaaaccccgctacgcagcaacggcacatcaacacgacgctcagccacccggaccagccgtcaccactctggccaccagaccaaacccccgacgacgcccagcagaaactccgccgcgcagcatcgcctcatcagtatgacgcacaaccacctgcatcagccgtcactactctggcctccagaccaagctacagcaaccaggcagcaaacccgccacgcagcaacggcttgccaacacgcacacatgatcctggaacagccgctgccgacttggcctccaaaaccaacaacggcgtccaggcagctacatcgcagcgctgcagcaacggccagccaacacgtcgcacaagaacctagaaaagcagccaccattctgaccaccagaaccaacaatggcatccaggcaaccaccccgcacaaagcacaggcccaccaaccactgaagaaaacacctgaaagcgccgccaatggattgaccaccaaactcccgacgacgcccagcagtaaccccgccgcgcagcaacggctcaccaatacgacacactgatacctggaccaaccgccactgccctggccaacagaccaaacgacggcatccaggcagcaactccgccacgcagcaaaggcttgtcaa

SEQ ID NO: 2175 - protein, 30 aa, Deltaretrovirus sp.
DLSSSSPGPPDLSSLPTTLAHLQTIDLRDA

SEQ ID NO: 2176 - DNA, 1597 bp, Drosophila willistoni
  source 1..1597: mol_type = unassigned DNA
tgaggaaaaaatcagggacaaccacttgtcattcaaaggctatcctgccccccttgggccaaacgaacaaattcaatacacggaaaatgtactactcgctctaaacatggctagtctggaatctgagttgctcaaattaattgataacagcacgaatagcactgatgctctaaaaaaaaaggaaaactgatactgcacccatgatggccctaactaacaatcactctaacaccaatactaatacttctgcaaacattcacttacctaaccataaagaaatatgattttaggcggcccctgcaaagccagaatcctgcccactattcagctgccgtcctggcctggccagagggccagtcctcgacagctgtgcctccagtagacgcgcctcctgcactctctgcctcgttctcagcgtctgcaccatctcgtccatcgtcctgtccagatttccgctcgcctgatgcaccaatacctgaaaataaaacaaatctaaaaataaaaccaactaaaaagtacaaatactcacctgaaaatacacaacagcaaacagtagctccttgtccagcgtcgtatgcatcgtctcatctgcgtcgtccagaatctcgtcaagctagtccgtctgcagctcctgtatctgaaaatatattaaaattattttctaaatcagcaataaaacacaaaaactcaccttaaaatctacgtcagagagcagcagcatcgtctgcgaatcctcgtccagcatctggccaatcatctggtccatctcgtccttcactagcgcctgcacctgaaaaaaaacacaaatcgtcagaaaaatctctcaataatcacgtaaacatacctgcaaattctcttcagtcacctgcagcaataccagctggtccttctggccctctacctaaggctgcatctgaaaaaaaacaaaatatcaacaaagaatcaagctaatttacctaaatacatatctaaaatccagccgcagccgctagcagtttcaactggagctcctcctgcatcttctgctgcaccacgtggcccgtcatctggtcctaaacgccataaagctgctcctacacctggaaaaaatataaaaatgctaaactatgctactaaatcaacaaattactcacctgccatgcaaatgccgccagtagcatcgcgtgcaaatcttcgtgctgaatctggccaatctcctggtccagctcgtccttcactagcgcctgcacctggaaaagaacacaaatcgtcagaaaaatcaatcaataatcaggtgagcttacctgcaaatcctcttcagtcacctgcagcaacaccagctggtccttctggccctctacctaaggctgcacctgaaaaaaaacaaaaaatcaacaaagaatcaagttaaattaactaaatacatatctaaaatcgagccgcagccgctagcagttccaactggagctcctcctgcatcttctgctgcaccacgtggcccgtcatctggtcctaaacgccataaagctgctcctgcacctggaaaaaatataaaaatgctaaactatgctactaaatcaacaaattactcacctgccatgcaaatgccgccagccgc

SEQ ID NO: 2177 - DNA, 49 bp, Folsomia candida
  source 1..49: mol_type = unassigned DNA
taagtgtatttcatagtttatcaatgtttatgttaataataaataatac

SEQ ID NO: 2178 - DNA, 221 bp, Lottia gigantea
  source 1..221: mol_type = unassigned DNA
taaagtagcacatcagaagagcgccccgctcctctgtaggtgtggcgatcattggggacttagttctcgatagatcgccaagaagaaacacagaagaagaacgcagtatcaagactacagaagaagatcaagaagaaaccatgggagcaacccgttccctactcaacgtctgcgatatggaatttctccgaagcggacaccatccaccaacaagaagaaga

SEQ ID NO: 2179 - DNA, 160 bp, unidentified
  source 1..160: mol_type = unassigned DNA; note = Description of Unknown:Nasonia vitripennis sequence
tcagatatatgtatctccgtattattattatttttgtacattcgaatctaatgaactatctgtcacttgttgtatatttttcaaaacttgtatttattatagtatctttctaaaggacgcgtcagccgttaaattattaaatcaataaatatataaatat

SEQ ID NO: 2180 - DNA, 234 bp, Nematostella vectensis
  source 1..234: mol_type = unassigned DNA
tagatatgattctactttatttcatcaaatcagccacatgtaaatttaataataaggattccttagtcaaatcaagaacattcatatatattttagtagagacgctacttagtctgcgacaggggtctacacctcataagcattgtgcttttagtagactcctcatcatcactattttttgcattattatcattatactattatttggtgaaataaacttgattgattgattga

SEQ ID NO: 2181 - DNA, 195 bp, Oryzias latipes
  source 1..195: mol_type = unassigned DNA
tagtgggacttgttcattttattaatttaattcttttattgttttttgcttttattgttcaattgattttattgttttattgtgattgtttctttattgcatcatattgtttgtgattttattggattttatgttaagcactttggttgccttggcttttataagtgctatacaaataataaattgattgattga

SEQ ID NO: 2182 - DNA, 266 bp, Oryzias latipes
  source 1..266: mol_type = unassigned DNA
taacctttgcacattttttttattatctctttatttagttttttctattttgcacatttcttttgcacatctctttacctgcactgttctgtaaatagctctttaaattataataccttgatgtctgcatttatcctacattttcttgttcttatttttatttatattattcttactctttttttccctctgctgtcagttgttatggtaacgaacaaatttcccacgtgtgggatcaataaagtatttctgattctgattctgat

SEQ ID NO: 2183 - DNA, 44 bp, Pelodiscus sinensis
  source 1..44: mol_type = unassigned DNA
taatgctgcatcccaccgtcttttgagacatatggaggccatga

SEQ ID NO: 2184 - DNA, 346 bp, Phytophthora sp.
  source 1..346: mol_type = unassigned DNA
tgaagctacacaagcgcgaggctcgacagctggaccttcagctgtcgagccactgcatccgcgccagccaccgcatctggggctggcactgccggcgccaccgcgaaggacaacggagcggcaacgcctcgcgaacgccgcgtgggtctgggggggccccgcggcgcacatcgcaggctcgggcacagcggtaagctggtcatttgaccaacagggcactacccaggtagggaaccgcccttcaaaaacccaggaagacacaaacaccctccctttagtgacatgcatattttagcctacatttcagttacggagaggttactaactggtaaacacgaacacacat

SEQ ID NO: 2185 - DNA, 320 bp, Phytophthora sp.
  source 1..320: mol_type = unassigned DNA
taggaacctagccgattgcagcagcacctgcgccccgccagcacgcacaagcgccccagccaagacaccaggggcagtcgggtgacggagaccggggggactccgtcgcgctccggccgccgctagacggcaaccaggcccattgcggccgacagggccacacccatgtagggaaccgccctcggaaaccctgcaccggctcacatggtccgaccccccgattggttcaacccgtacaccaactacacaccaattagggactcccaggtagtcactaccaggacgcaacggactaaccggcaggtaatacattaaccctt

SEQ ID NO: 2186 - DNA, 106 bp, Strongylocentrotus purpuratus
  source 1..106: mol_type = unassigned DNA
ataaataactgtgtattattgatgttccattgatttgctaaattgtaagcaaaattatgttactgttgaatattgaataaacacctctaagaggcaaagagaaaaa

SEQ ID NO: 2187 - DNA, 10 bp, Strongylocentrotus purpuratus
  source 1..10: mol_type = unassigned DNA
aagaagaaga

SEQ ID NO: 2188 - DNA, 140 bp, Strongylocentrotus purpuratus
  source 1..140: mol_type = unassigned DNA
taggtgttgtctattgtctcatgttattacacaacctcctccctccacaaaatagcagtaatcacggaagaatcctggatcgatgaacaggcttagacctacaacatcgtgttttaaagtaaagtaagtaagtaaagtaa

SEQ ID NO: 2189 - DNA, 425 bp, Strongylocentrotus purpuratus
  source 1..425: mol_type = unassigned DNA
taaatataacccaagtactcgcaaataagtagccactatcacaaacttcaatatttagtaaattaccaattgcagatcactgtatttctcataaatatcctacaaattacaaataattatgtttagacacactgtcacctcaatataatattttttcttcttcaaaatttgtttatgtatgatttcttgatgacttgatttttttggattttttttgtttacttgctgagtttaaatttacatttgagatttaatctgtaattctttctggtatgtttactactcaccatgtgatgatgttttcatgtatatgtatgtcttatatatctattttatgttatgtagggcccccaagaataacagtattttaactactggtggggctaccctgttgaaataaaacgaaataaataaataaataaata

SEQ ID NO: 2190 - DNA, 282 bp, Strongylocentrotus purpuratus
  source 1..282: mol_type = unassigned DNA
taactcaccaggctctttaccccccccccttgttttccctctttttgtcatgcttccaatcgtacaacaattaatttaccttttatttacattatactgagggatgggctctagcataaggaccacactcctttttagctcatcccttcactcccattatgttatgttattttgttgttgttgaatgtatgatattttatgtgtgattattcctcatttaattgtatatgttcttgtatttttaatgatgagtgtaaataaacgaacttgaacttgaacttg

SEQ ID NO: 2191 - DNA, 413 bp, Strongylocentrotus purpuratus
  source 1..413: mol_type = unassigned DNA
tgacaaatctcttaaattaacacatgatatcatatatgtttgtcagcatttccttgatatagcaggaaaatccccctcccatgcaccctctatcccattttttttttttttggttgcaagtcactgtttattttttgttattttcccccaattatgttctgtaatttactttactttacaatcgttatgattttaaatgtttctgggctgcaagcgtatcaagctgtcacgcttaggctgtagcccttctgtatcatcacctcttcgagcgtatgtatctatgatttactgaatgtggaaatgtaatttaacttatgttttatactcatgtaaagacattgtcacattattgttataacctatgatgattcagtaaccaataaatatttcaactatttcaactatttcaacta

SEQ ID NO: 2192 - DNA, 187 bp, Strongylocentrotus purpuratus
  source 1..187: mol_type = unassigned DNA
taagcttactagcttggtttttacttgcactggacttagcatattttactgtaaattgacaagtgctttgtccacacaccattccagcaattcatgacactccttgtagtcacttgcctcacctaccatcccagtatagcttcctgagtgagctgccaaagggattacccaaccaagtaccaagtaa

SEQ ID NO: 2193 - DNA, 303 bp, Strongylocentrotus purpuratus
  source 1..303: mol_type = unassigned DNA
tacctgttcataagagaataatctataaagtttcactatttgtttataaatccatgtataaccttatcccatcctatatttctagtctgttttgtcccatccagcaatcaagatatccattacgttcaaggtcagacccccttcttctgcaaatcccccgcatcaattcaaagaagggtcaacaaaatataattttttctggtcccactatttggaatagtctccctttaagcattcgttcttgcacctcagtcgcattatttaagaaacatttaaaaacccatttgttttctttgtaattgt

SEQ ID NO: 2194 - DNA, 313 bp, Strongylocentrotus purpuratus
  source 1..313: mol_type = unassigned DNA
caagaccctccaggacctgcccatgcacatagctaccaagtcctccgttcaagaactgagcagcataagcagtccttctttcccaggactgtgagagtggaacaacctccatcagaaacagtatggcctcatccgtcaatgccttccgtcaatgcctgacgggaggcagcaactaagtccgggaactttttacttgcaccatgtaaatagcattgcaccatgcaccttgctctcgtaagcacacacacactcatcagtctgcaagaatcttcaactgtgaaggaggtagacttaacccaaagaagaagaagaa

SEQ ID NO: 2195 - DNA, 421 bp, Strongylocentrotus purpuratus
  source 1..421: mol_type = unassigned DNA
tgatgttacttttaataattactgtcgatgttcaaactgaatgtttcttttagtttgctgttgttaccctgtgaattgccattgcgtacgggtagtgaaaatgttatacaaatattgctaagtgtatgaatattgtttatttttcttcataataagtttcaacttaattaaattacgtttttttaatatacacaagactatgtcattgttgtaactttcggagcctatgacctacaagcattgctttctctttaggctccatcatatttcttcccttattcaacttagtcttatgtatcattctttttttttttttgtataaacgcatcctaaaatgagttcaaaatgtaacatgctatatgtaatgatgtactatacaacatgtgagaaatatgaaaataaactgaaactgaaactgaaa

SEQ ID NO: 2196 - DNA, 289 bp, Strongylocentrotus purpuratus
  source 1..289: mol_type = unassigned DNA
tttatatatacattaatttttcatatttgttttgaacttgtaaccattctgtaccaaaatgacaatatttaacgtaatacgcaatttatctcgattcaattatacactattcatttatgtatcatgtatggggatcttctagcttcctcaccataatgttacaatcttcttcttttaccctgttctgtactataccacttctgttttcctctccttttctccttttctccttttcacatccttttccctctctctttatcccggtgctccttgttatcacatatattat

SEQ ID NO: 2197 - DNA, 650 bp, Strongylocentrotus purpuratus
  source 1..650: mol_type = unassigned DNA
tttcaacatgcagtaggcaattgtcaaatttcggtcacattgcaactcagttttgcaaattttgttttctatttcgtatttcttaatttcctttattgtaaaggctgtatttgtttctactcgactataccacacagagctacgtacacttccactatttgttacaaacacatacaaacacgcacgctcgcgtgcacgtgcacacacacacacacacacccacacacgcacacacgcacacacacaatatatatatatatatatacacttgcacaacacactcaccaactcatacacaaagatcgcttgaacactttttcattttaagttttaccttaagatttttttttgttttgttcttgtttttttttaggccgccatccttgtcaagctttgcttatgattgcggtctcctgcacttttccaccagaatagttaggataatactttaaatttatgataatatgttatggaaataataagtttcgttattataattatgtacatatattatgtaaaaaaacattttgacatgaagaaattattgtttgtttatgttgtattataccttacatgtatattatgttatttgttattcagttatattttatttggaaaaaatgcagaaataaaatcaaatcaaaatcaaa

SEQ ID NO: 2198 - DNA, 17 bp, Strongylocentrotus purpuratus
  source 1..17: mol_type = unassigned DNA
gtcaagtaagtcaatta

SEQ ID NO: 2199 - DNA, 305 bp, Xenopus tropicalis
  source 1..305: mol_type = unassigned DNA
tgacattctgcccaaaccaacacacactccccataactactggactcttcgcagtgtcactttaagcaaagccactttaaatcctcactgcacaatttcaaatattgcattgcattttattattgtaaatacttgtacctttattgcacacttttattatatttaatatttgtattttttttttttttgttttttgttttgtttgtctatgtaaagttgggaggaacacgggtcaaaaaaatgtcattacagtaatgatgcttcattgttatttgtatatgacaataaacttgaaacttgaaact

SEQ ID NO: 2200 - DNA, 277 bp, Zea mays
  source 1..277: mol_type = unassigned DNA
tgagctcaggatgtggtgtagtgccggggcaaaagggttgaacctgctttcaactcttatgtttatgcttgacccagggggatagtctagtggcttgttcagagtggttgtgtgtggttgctgtgttgcgtcttttggtatgttgtgtcttgtgatgtgtgtgtcgtgtcaggtggtatgttgtgtgcggcgtgtgtgtgtgtgtgtgttgtaccttcttctatctatctattaatggaatgatacgcagatctcctgcgtgttcgagaaaaaaaaa

SEQ ID NO: 2201 - DNA, 2231 bp, Zea mays
  source 1..2231: mol_type = unassigned DNA
taattctccagggggactcttccaagctttatctccttaactcggcgtatgtgactctcttaccaaaaaagctgaggctgtggaggtaaaagacttcagaccgattagtttaattcacagttttgccaagattctcaccaagattctggccaataggcttgctgcaatcctccctactttggtctcccccaatcagagtgcattcatcaagggaagaagtattcatgacaattttatgatggttagagaaactgcaaaagcgattcacaggcagaaaattcctagaatcttgctgaagttagacattggcaaggccttcgactcagtttcgtggcctttcctccttgaagttctggaacatgtgggatttggtctattctggcgtaatttaattgctaagctattgtgttcctcctctactcgagtgctagttaatggggaaccaggagatctcatttgtcaccagcaaggcctgcggcagggagatcctctctccccaatgctctttatattagtaatggatgtgctgaactctctttttcagaaagcaaatgagttgggctcttgggacctttattaagaaggggagggggccagcgggtctctctttacgccgatgatgttgtattatttgttcagcctaacagaaatgagctgagtgtggtcaaggagctgttgagggtgtttggcaaggcatcagggctgattacaaacataaataagtgcagtatgacacctattcagtgcaacgagcatatcattgctgctgctcgacagatgttactctgcaatgttgttccttttccatgtaaatatctaggtcttcctctctctgttaaaaagctccctagaagatcctttctggagcttattgataaggtggcagcaaagcttcctggctggaaagctgctaatcttaacctggccggaagggcaactttggttaaagctgtgctcactgctattcccatttatcatctaattgcttcaatgtccaaggtgggtaatcaaggcaatagacaagattcgcaggggttttctttggaaaggaagaactgacattagaggaggacattgtgtcgttgggtggtccaaggtctgtcgtcccctctctcttggtgggttgggaattcacaatttggaagttatgggatggtctttaaatttgagatggctttggctccagaaaactgaaccagctaggccttgggcagattttaaaataaaggtgcacagatgcttcagctctcttcgcagcctctgtgtgttcggtggttggtaatggggcaaacactctcttctggacagataaatggcttcagggccaatctttctcagattgcccccgctctaataaatcgggtgcccgcgaatataagaggcgcagatctgtccaagccgccttaacagccaatggttgggtgcatgatatctctggaagccttacggcgcaggtgctgtttgaatttttattggtttgggatttactccaagaggtgcaactgtaccctaatgtggaggatcaacatcggtggttgccatcctcctcggggctgtattccgccagctctgcttatttgcgcttccatggtggtgcaacaacctttgagcctgctacaagaatctggaagacttgggcccccccgcgctgcaagtatttcatttggcttgcatctctcaaccgatgttggacggctgatcgactggcacgtcatggaatggatcatccagatagttgtcccttgtgtgatcagcaggatgagtcagtgcatcacttgctggtggattgtgtttttacgagggaagtttggtttacaacactaagcaggctaggtttgcaacatcttgctcccacgtctgatgctacagggtttcaagattggtggagtgaggcagaaagacaagtgtctaagcataagaaaaaaggtttcaactctattgtaattttagtagcttggcagatttggaagcatagaaatgcgtgtgtgtttgacaatgcttccccaaacattcacgcaattttgctgtccatccatgatgaggctttattatggggtcttggaggggctgctgctcttaggcaggtttggttgtagtttttttatttttggtttttttaattttttggggtgcttcctgggcacctttgtactgggtcttttctagaccctttttcttatcttcttaatatatttgatgcgtggttctcccacgtgttcgagaaaaaaaaa

SEQ ID NO: 2202 - DNA, 112 bp, Zea mays
  source 1..112: mol_type = unassigned DNA
taattacgtaacctctatgtacccttcctgcggtgtctcttgggcactgcttcactctcttctttattaatagaaacgtgcacaatctcgtgccgttcgttcaaaaaaaaaa

SEQ ID NO: 2203 - DNA, 181 bp, Zea mays
  source 1..181: mol_type = unassigned DNA
tagctctggttttgttttcaggatctgtttgctcttgtttttgtttttttcctcttcttttttctttggtttttttatcccctccggggaggtcttttgtactatggtctattttggaccctctttttcctctacttaatataatgatgcgcagttctcctgcgctttcgagaaaaaaaaa

SEQ ID NO: 2204 - DNA, 199 bp, Zea mays
  source 1..199: mol_type = unassigned DNA
tagcagttttcctgctggtagtcgtttttggtcgggttgttaccttgtgtgtgtgtgtggtgcgttgtgttattgccggaggggtctcggcctaggggcctttgtaattaggggttgacaagtcttgtctctcctatgttctttttttcttcttaatataatgacacgcagctctcctgcgtttgttcaaaaaaaaaaa

SEQ ID NO: 2205 - DNA, 354 bp, Zea mays
  source 1..354: mol_type = unassigned DNA
taacgttcctttttctatggaggtcattattctcatgacatggagcatttggaaaagtcgaaatgaatggttgtttgaaaacaaagacccttcagtgcatcactgtacgaatgaattcagtaaggaactacggttggttattcacagagcgcgagggaaatacgacatctccattccaagctggttggatcagtggcagtcataagatttgttttgctctgaccaatctttgtaacttttcaattagatcttaccagctaacctctaactcttgtaatcaagtcgagttgtaccttttcatatttaataaaattttacagtaggggtttcccctcctgatctttcaaaaaaaaa

SEQ ID NO: 2206 - DNA, 1528 bp, Zea mays
  source 1..1528: mol_type = unassigned DNA
taatgtttttcctatccgatgttctgaggcggatcttgcttgtgttcaggagctccttccatgttccatttcggaatttccctgtcagtaccttggcctcccgctttctcttggaaagcttaagagaagtcaaattcaagcaattgtcgataaaactgcagcacagttacctgggtggaaagctgatctgatgacaaaggctggtagagccatttatgttcaatttgtgatgacatcaagaatgatttatgctgctctggcgttggacatcccttcttgggcttttaaagcaattgataagcttagacgaggctttctgtggagagggaggaaggaggtgaatggtggccattgtctgctgacttggcccaaagtcactagacccaaggacctggggggtctgggtattagtgatcttcggatcatgagctgggcactgcgggctaggtggccttggctgcaaaaatctgataggactaagccatggtcggacttccagattcaaacttgcgacattgtgcaaagcttgttggctgcggctgttatcactcatttgggagatgggtctgatactctgttttggaaggatcgttggctgaatggcaaatgtattaaggaggtggcacctgctgtcttcggtatggtgcccaagcgtattgcttctagacgcctggtcaaggatgccttgcctgatctcaattggttggctgatctgagaggggctatttctgttacagcccttgctaatctcatggacctttgtgacttactcgaggggatggttctgcagccggatgttcctgatgtgcatacctggaggttcagtgaatcgggtgaatactcggctagttcagcttacagggctttgcttcttggctctgttagctttgagcctgctgaacgcatttggaaatcctgggctccaggaaagtgtaaattcttcctctggcttgtggagcacgatagatgttggacggctgacagacttgctaagcgtggcctggatcacccagagtcctgccctttatgcgaccagatggaagaaactatcaaccatttgctggttcagtgcagttttgcaaaacagttttggttcagccttctgcggtcgggtggtttccaggagctctgcccttcccatgatgacgtctgttttgaaacctggtggaggaatagtgctgccagggtgggcatgcctttatccaagggattcaattctcttgtcattttgggtgcatggactttgtggaagcatagaaataggtgtgtttttgataactgtaaccctagcgctgcggtggtgttggcagctgcaagggaggagttgatgggttggcgtatggctggagccaaagcgctctctttctttcatttagaagaggtgtcttaggtgtcttagttgtttggggagtgttttttggttttggtttgccaaatgtaacacctttgtactggggttttttctccccattttattcttcttcttaatacaaaaatacgcagctctcctgcgtattcaagaaaaaaa

SEQ ID NO: 2207 - DNA, 154 bp, Salmo salar
  source 1..154: mol_type = unassigned DNA
taggataaagtaatccttctaaccccccccccccttaaaagatttagatgcactattgtaaagtggttgttccactggatattataaggtgaatgcaccaatttgtaagtcgctctggataagagcgtctgctaaatgacttaaatgtaaatgt

SEQ ID NO: 2208 - DNA, 121 bp, unidentified
  source 1..121: mol_type = unassigned DNA; note = Description of Unknown:Mesobuthus martensii sequence
taactcacaattaaacatcacaagtagctatgtcttgactcttgtccgacatagcactttgccccggagttattccgtgctcacattgatgtaccataatataataataataataaataca

SEQ ID NO: 2209 - DNA, 147 bp, Schistosoma mansoni
  source 1..147: mol_type = unassigned DNA
tgatttaccaaattctttttttccctctattatcgttcatatacctaggttcttgcctggaggtattggtgatccactgctaccagacacggaagcccgttaagcgaaagcttcttctattccgtcctcaaccatttgaaccatttg

SEQ ID NO: 2210 - DNA, 102 bp, Anolis carolinensis
  source 1..102: mol_type = unassigned DNA
tgaatgcgatttcctgcttcttagcagggggttggactagatggcccatgtggtctcttccaactctactattctatgattctatgattctatgattctatg

SEQ ID NO: 2211 - DNA, 388 bp, Pelodiscus sinensis
  source 1..388: mol_type = unassigned DNA
taacaagtctttgaactttctcacccattatcaagacagtttccccaattatcacctgtaataccattaactcacaaacatcccactctccctacctctaatatcatcaattcacagacacttaccttccttcctcccccttcccacccccccgcctcctccttctgttctgcaatgtgatttgtccttttcatatttgttcattttttttaattgtatcctttggtatatatggttgtgactactttcttccactatttgatctgaggaagtgggtctggcccacgaaagctcatcatctaataaaccatcttgttagtctttaaagtgctacattgtcctgcattttgcttcaactaccccagactaacacggctacatttctatc

SEQ ID NO: 2212 - DNA, 56 bp, Xiphophorus maculatus
  source 1..56: mol_type = unassigned DNA
taagcggaagaagatggatggatggatggatggatggatggatggatggatggatg

SEQ ID NO: 2213 - DNA, 142 bp, Ixodes scapularis
  source 1..142: mol_type = unassigned DNA
tgaacaagtgtaaaaaaagggtttgttataagtgactagagctctgtcgctgccctacgcacaagccgcttaggcttatgtggggtatgaatctctgtaaaattgtatgtggaaaagatgaaataaagattattattattat

SEQ ID NO: 2214 - DNA, 241 bp, Schmidtea mediterranea
  source 1..241: mol_type = unassigned DNA
tttacgtatgttaaatcatgtttgtttttttaatattattaaaataattgaaaattttaaattgcattaatttttaaaaaattagaatataagtaaaaaatttaaaatttaaaattaatttaaagtgaattgaatatattttaaaaatatttatttattaaaaaattaaattaataaaaaataatttgtttaaattaaatgttaattcataatatttttagttggttttgagtacctgaag

SEQ ID NO: 2215 - DNA, 1348 bp, Monodelphis domestica
  source 1..1348: mol_type = unassigned DNA
taattattaagaactattttgcccaattatatggcaataaatatgacaatctaggtgaaatgggtgaatatttacaaaaatataaattgcctagattaacaaaagaggaaatagaatacttaaataatcccatctcagaaaaaagaaattgaacaagccatcaaggaacttcctaagaaaaaatccccagggccagatggattcacaagtgaattctatcaaacatttaaagaacaactaatcccaatactatacaaattatttgacaaaataagcaaagaaggagtcttaccaaattctttttatgacacaaatatggtactgattccaaagccaggcagaccaaaaacagagaaagaaaactacagaccaatctccttaatgaacatagatgcaaaaaatcttaaataaaatactagcaaaaagactacagcaagttatcacaaggattattcactatgaccaggtgggatttataccaggaatgcaaggatggtttaatattaggaaaaccatccacataattgaccatatcaataatcaaaccaacagaaatcacatgattatctcaatagatgcagaaaaagcctttgacaaaatacaacacccattcctattgaaaacactagaaagtataggaatagaagggccattcctcaaaataataaacagtatatatttaaaaccatcagcaagtatcatctgcaatggggacaagttagaagccttcccaataagatcaggagtgaagcaaggatgcccattatcacctctattatttaatattgtactagaaatgctagcagtagcaattagagaagaaaaagaaattgaagggattaaagtaggcaatgaggaaactaaactatcactctttgcagatgatatgatggtatacttaaagaatcctagaaaatcaactaaaaggctagtggaaataattaacaactttagcaaagttgcagggtacaagataaacccacataaatcatcagcatttctatatatttccaacaaaactcagcagcaggagttagaaagagaaactccatttaaaatcactctagacaatataaaatatttgaatctatctgccaagacaaacacaggaattatatgaacacaactacaaaacacttttcacacaattaaaactagatctaaataattggaaaaacattaattgctcatgggtaggatgagctaatataataaaaatgacaatcctacccaaattaatctacttattcagtgccatacctatcaaactaccaaaaaacttttttatagaattagaaaaaaatataacaaagttcatctggaagaacaaaagatcaagaatatcaag

SEQ ID NO: 2216 - DNA, 348 bp, Petromyzon marinus
  source 1..348: mol_type = unassigned DNA
tgattgattgttcacgcttacagtggctttcagacagcatacataaaaaatttcgtctcccccctcctcttttcaaaaaatagatggactagtcctgctgggcaaactgccaaatcgttgcgcgtgacgcaaacgttttttttaaataaataaatatgccgttttcaaataaataaatttatgcaaaccgacacacctgatgatgaccgtttgagttatggtcgaaacgtcgtgagaatttttattgttttatatatattttgttattttgttgtttctcttcaacgtgactttaccgaaaaaactaagaatatgaattactgcagtcacgaaagctttaaatcaaaa

SEQ ID NO: 2217 - DNA, 1053 bp, Petromyzon marinus
  source 1..1053: mol_type = unassigned DNA
taattaattgtattttacgatgaccttcagaccgcagctctttcgccagcattgcctcttaatacctctcacaccacggttaatggtatggtttacaacatggagtatactagggcttcgcagctgtctctctccccctcctctgttccgaccatggacgaactcgtccgtctgaacggggcccgtagctatccgtggtacgaaatttgagggtaagaatccacccatttttttcgccatatagcattgtgatatataacgacttatggttggtagcttagctgattggagaatatagagtttattgataacatgaaggtaatttatattttagttttttattggttcactatatagtactgtgaatagctcagatgtgtaggccttgacttcaacatagtcatttctgtgaccagtcactagcaaatcacccagttatttcaatgctaaattcgcctagttatttcaatgctaaattctcctgtttgatttgtactaagtgcctcggtgaatgtgtatgctctgacttcaacgtaactatttctgtgagcagttacaagctaatcactcagctatttcaatgctaaattctatgctaattccattgtcaaggggtgcctctgcggatgtgtatgccttaacttagctatttcaatgctaaattctatgctaattcctttaacaatgggtgcctctgcggatgtgtatgctttaacttttaacatagctatttctgtgaccagtcacaagctaatcattcagccatttcaatgctaaattttatgctaattcctttgtcaaggctctttgtttcctctcacacagcttaaaagccgtgatctgaacgtggctctctcactccagcgctgtcctaccagacagtctcgctcccttcacctgatgaaggccgcttgtgttgtggccgaaacgtcgtgagaatattattgtgttattttattttatcaatttattattttattctcattctacgtgactttaccgaaagaaccaaagaagatgaatcattgcagtcacgaaagctttaaatcgaaa

SEQ ID NO: 2218 - DNA, 776 bp, Petromyzon marinus
  source 1..776: mol_type = unassigned DNA
taaactaattttcaatggtacagtaaattatttttcaagtagtggtaccccaaactttcgcagctgcttataaatctcccctctttcacaccactcaataggtaaactcactcccctccctccccccccccgcgccacacgccaactccacgcacgtactccacgcactcactctctcactcagtcaatcaatccaatcaatctgctaatttatttatgccactttctttttcactccacccattcgttgctctcactcagtccatttactaggtgcgctcggtgactggatttactgctctgactgtcttaactagctgatttcactgagtgcactcagtgaatgtaatcactcactaacttcactaattctactaattcctgtcagtccactcagtctactaactcactcaattcaatctaaattcaattctaattcctcaaggggtacctctgcggatgtgtcatgctacatacccgcttatggtccatcatggcccattcacctcccagtttcatcatgctaaattatatgctaattcctttgtcaaggcgctttgtttcttctcacacagcttaaaggtcgtgatctgagcgtggcttttttcactccagcgctgtcctccagacagctcggtcccttcacctgatgaaggccgcttgtgttgtggccgaaacgtcgtgatttttgttattttattttttacctacgtgactttacccaatagaaccaaagagtatggatccttgcagtcacgaaagctttaaatctagaa

SEQ ID NO: 2219 - DNA, 388 bp, Petromyzon marinus
  source 1..388: mol_type = unassigned DNA
taactggctgtgatgtttccatcctacctaccgatgttagcagttattttcgactctctgagttacattcactaacacagccaaccgttagctgtgttagtaaatggcggcttgccactgcctcgtccatgccctggccgagcttggccccctccgatcttacatttacatgcaaatttctctcctactagccccgcccactcgctcctacatgacccttggctgctacacccatctctaaacctttataaacagcctgcctcagcagctttccctcttttttcacctgatgacgattgcttgtgttgcgatcgaaacgtcgtgatttttaatttttattattttttctatctacgtgactttaccgaaagacccaaagaatatgaat

SEQ ID NO: 2220 - DNA, 293 bp, Anolis carolinensis
  source 1..293: mol_type = unassigned DNA
gatacggtcgatataatctgatgtattcgctggattaatgtgtaattgaatacagactggctctgacttttggcccaatgctactggccctgttgtaatggccacacagtgctttactgttttaaatggggtataatattggtttttaagtgtgtttttacgatcgtttgttttactatattttgtattatatgtggcattaatcttgccattatgtaagaccgctctgggtccccctgggggagaagagcggtatataaattaaataaataaataaataaataaataaataa

SEQ ID NO: 2221 - protein, 30 aa, Deltaretrovirus sp.
TLTSPSPGPPDLTSLPTALPHLQTIDLTDA

SEQ ID NO: 2222 - DNA, 114 bp, Capitella sp.
  source 1..114: mol_type = unassigned DNA
tgattaagctacctttatgttgcagttttgatttgtttgttcgtttgtttgattttctttcacctactataatcctgtatatttatttatacgaataaattattattattatta

SEQ ID NO: 2223 - DNA, 94 bp, Anolis carolinensis
  source 1..94: mol_type = unassigned DNA
tagacacttgggaagtgttcgacttgtggttttgtgaaacgaaatccagcatatctatcttgtttgctgtgtcatacaacgtcgttgtgttgat

SEQ ID NO: 2224 - DNA, 94 bp, Aedes aegypti
  source 1..94: mol_type = unassigned DNA
tagatttttatgttttttttttcattaagacaaacagatgtcagatgaataacaacttcaataaataaataaataaataaataaataaataaat

SEQ ID NO: 2225 - DNA, 153 bp, Aedes aegypti
  source 1..153: mol_type = unassigned DNA
tgagaagctcatccagcagactcattaggataagttaaaccgaccaatgagatccacagagcctaatcccctttggcatacagattgcccggggtaggtgaaagtttccagcattttttgctgagaagtgccaaaactctataataataataa

SEQ ID NO: 2226 - DNA, 27 bp, Aplysia californica
  source 1..27: mol_type = unassigned DNA
tgatgcgatcgagaagaaaaagaagaa

SEQ ID NO: 2227 - DNA, 39 bp, Aedes aegypti
  source 1..39: mol_type = unassigned DNA
taattgatgtaaagccaaataagtaagtaagtaagtaag

SEQ ID NO: 2228 - DNA, 55 bp, Aedes aegypti
  source 1..55: mol_type = unassigned DNA
tagattcaacgcaatagcaaggaattgttgcccatcaagtatcaagtaagtaagt

SEQ ID NO: 2229 - DNA, 46 bp, Aedes aegypti
  source 1..46: mol_type = unassigned DNA
tagattcaacgtagcggattgtagcccatcaagtatcaagtaagta

SEQ ID NO: 2230 - DNA, 39 bp, Aedes aegypti
  source 1..39: mol_type = unassigned DNA
tgatgctacgctgtagccatcaaggtatcaaggtaggta

SEQ ID NO: 2231 - DNA, 25 bp, Aedes aegypti
  source 1..25: mol_type = unassigned DNA
tagcccatcaagtatcaagtaagta

SEQ ID NO: 2232 - DNA, 35 bp, Aedes aegypti
  source 1..35: mol_type = unassigned DNA
tgaaggacgtagagccagcaaaagtaaagtaagta

SEQ ID NO: 2233 - DNA, 24 bp, Aedes aegypti
  source 1..24: mol_type = unassigned DNA
tagatgttaactaaataaatgaat

SEQ ID NO: 2234 - DNA, 266 bp, Aedes aegypti
  source 1..266: mol_type = unassigned DNA
taggctctctttacgctcatgcgttttgcagtgccctttttagggcgctgttcgaacccattgtggtatggagctacatgctctcatttcgcttatgcgatcttccctcttcaagggaccccactcctatttcctcccatctttcccttccctttcctctcccatcgggtagatgatgaaataggctcaaatatggcgatggcacaaatctcccaactggtggggaacgtgcctttggagccggccttctgatacctgatacctga

SEQ ID NO: 2235 - DNA, 18 bp, Aedes aegypti
  source 1..18: mol_type = unassigned DNA
tgactggtaaggtaagta

SEQ ID NO: 2236 - DNA, 94 bp, Alligator mississippiensis
  source 1..94: mol_type = unassigned DNA
tgacccccagttgtctttcctgcctagtgcagggggctggacccgatgatcttccaaggtcccttccagccttacaatctatgaatctatgaat

SEQ ID NO: 2237 - DNA, 130 bp, Alligator sinensis
  source 1..130: mol_type = unassigned DNA
tgagtcccgtttttgtttttagggtgagtggttttgtttgtgtttttgggttgttctcccgccctggcggggggtcgggctagaagatctattaggtcccttccgaccctgaaactatgaaactatgaaa

SEQ ID NO: 2238 - DNA, 250 bp, Anolis carolinensis
  source 1..250: mol_type = unassigned DNA
taagaatatatgacctcaactgacagacccagtcacatgaacatggaaagcgccttaaatgtatatttaaatgtataattatgtatattttaatggctattcttaattttattgtaatttttaatcttgatggatttttaaatttgatgaaaactgtttttaatgtgtatggttatactgtaagccgccctgagtcccctgatgggtgagaagggcggggtagaagtgatgtaataaataaataaataaa

SEQ ID NO: 2239 - DNA, 91 bp, Anolis carolinensis
  source 1..91: mol_type = unassigned DNA
tagttgcttgtgatttcttttcttttttattttatttccattatttgaaatgtatttgttgtagcaatgcttttgacacgaaataaataaa

SEQ ID NO: 2240 - DNA, 26 bp, Anopheles gambiae
  source 1..26: mol_type = unassigned DNA
tagcgccggataagtaagtaagtaag

SEQ ID NO: 2241 - DNA, 18 bp, Aplysia californica
  source 1..18: mol_type = unassigned DNA
tagtaagtaaataagtaa

SEQ ID NO: 2242 - DNA, 13 bp, Bos taurus
  source 1..13: mol_type = unassigned DNA
tgaactgaactga

SEQ ID NO: 2243 - DNA, 1975 bp, Choloepus hoffmanni
  source 1..1975: mol_type = unassigned DNA
caatagtacagacagcccaattataaaatgggcaaaagatatgaaaagacagttctctgaagaggaaatacaaatggccaagaaacacatgaaaaaatgttcagcttcactagctattagagagatgcaaattaagaccacaatgagataccatctcacaccaattagaatggctgccattaaacaaacaggaaactacaaatgctggaggggatgtggagaaattggaactcttattcattgttggtgggactgtataatggttcagccactctggaagtcagtctggcagttccttagaaaactagatatagagttacccttcgatccagcgattgcacttctcggtatatacccggaagatctgaaagcagtgacacgaacagatatctgcacgccaatgttcatagcagcattattcacaattgccaagagatggaaacaacccaaatgtccttcaacagatgagtggataaataaaatgtggtatatacacacgatggaatactacgcggcagtaagaaggaacgatgtcgtgaaacatatgacaacatggatgaaccttgaagacataatgctgagcgaaataagccaggcacaaaaagagaaatattatatgctaccactaatgtgaacattgaaaaatgtaaaacaaatggtttataatgtagaatgtaggggaactagcgatagagagcaattaaggaagggggaacgataatccaataagaacagataagctatcgtgggtaaatttaacgttctgggaatgcccaggaatgactatggtctgttaatttctgatgggtatagtaggaacaagttcacagaaatgttgctatattaggttactttcttggggtagagtaggaacatgttggaagtaaagtagttatcttaggttagttgtctttttcttactcccttgttatgagtttgtttgaaatgtttttttattgtatgttttttttaaaattttttttatatagttgatttaaaaaaaaagttaatttaaaaaaaaaaaaaacaatgaaaaaaatatgcagagcccccttgaggagctggtggagaatgcaggggtattgggcttccccacctcgatggttgctgatgtgctcacagacataggggactggtggtttgatgggttgagccctctaccacaggacttgcccttgggaagactgttgctgcaaaggagaggctaggcctccctataattgtgcctaagagcctcctcccgaatgcctctttgttgctcagatgtggccctctctctctagctaagccaacttggcaggtgaaatcactgccctcccccctacgtgggatcagacacccaggggagtgaatctccctggcaacgtggaatatgactcccggggaggaatgtagacctggcatcgtgggatggagaacatcttcttgaccaaaagggggatgtgaaaggaaatgaaataagcttcagtggcagagagattccaaaaggagccgagaggtcactctggtgggcactcttacgcacaatatagacaaccctttttaggttctaatgaattggagtagctagcagtaaatacctgaaactatcaaactacaacccagaacccatgaatcttgaagacgattgtataaaaatgtagcttatgaggggtgacaatgtgattgggaaagccatatggaccacactcccctttgtctagtttatggatggatgagtagaaaaatgggggaaggaaacaaaaaaacaaacaacaaaggcacccagtgttcttttttactttaattgctctttttcactttaattattattcttgttatttttgtgtgtgtggtaatgaaggtgtcagggattgattttggtgatgaatgcacaactatgtaatggtactgtgaacaattgaatgtacgctttgttttgtatgactgcatggtatgtgaatatatctcaataaaaatgaattaaaaaaaaaaa

SEQ ID NO: 2244 - DNA, 337 bp, Clonorchis sinensis
  source 1..337: mol_type = unassigned DNA
tgaatgtacattcttgccattgaatctcacaccagacccagtatgacggacactttgtgcctgatgtgcgagtcttgactgtgctagcgcttaccgcgccttgaagagcattcagcattgtttgtcctttcttcggttgttagactttacacgcatgtttccttaccaaaattcttacgtacgttgggattcatcctatctgactggaactgttggttgcatgacttcgaatgagacatttctttcttttatctcatattctcctgtaaccctttcgcattcatcgcttgcattcactttttatgtctgtgaccatgctcttcaaaaataaacgata

SEQ ID NO: 2245 - DNA, 797 bp, Cyprinus carpio
  source 1..797: mol_type = unassigned DNA
taacatactaatacacttctaatatccaaatccgttaaaggatttttaggctgcattaattaggtaaaccggaaccgggaacacttcccataacacccgatgtacttgctacatcgttagaagaatggcatctacgctcatattagtctgtttctctcttattccgaggtcaccgtagccaccagatccagtctgtatccaagtcagagggtcactgcagtcacccggatccagtatgtatccagcccagatggtggatcagcacctagaaaggacctctacagccctgaaagacagcggagaccaggacaactagagccccagagacagatcccctgtaaagaccttgtctcagacgaccaccgggacaagaccacaggaaacagatgattcttctgcacaatctgactttgctgcagcctggaattgaactgctggtttcgtctggtcagaggagaactggccccccgactgagcctggtttctcccaaggtttttttctccattctgtcaccgatggagttttggttccttgccgctgtcgcctctggcttgcttagttggggacacttcatttacagcgatatcgttgacttgattgcaaattattgcacagatactatttaaactgaactgagctgcatgatgacatcactgaattcaatgatgaactgcctttaactgtcattttgcattattgacacactgttttcctaattaatgttgttcagttgctttgacgcaatcttttttgtttaaagcgctatataaataaagatgacttgacttgacttgac

SEQ ID NO: 2246 - DNA, 233 bp, Danio rerio
  source 1..233: mol_type = unassigned DNA
taatctgcaattgcctctttgaatatcacactaattgtacacaaaaaaaaaaaaaaaaaaaaaaaaaataaaaaaactactaacacttcccttcttagactttacagacctgaaacttgcctttagtacttattcattgttgctcttagttgtgtaaattgcttccttgtcctcatttgtaagtcgctttggataaaagcgtctgctaaatgactaaatgtaaatgtaaatgt

SEQ ID NO: 2247 - DNA, 33 bp, Dendrobium sp.
  source 1..33: mol_type = unassigned DNA
tagtgggataaaggcttgatgttgttgttgttg

SEQ ID NO: 2248 - DNA, 232 bp, unidentified
  source 1..232: mol_type = unassigned DNA; note = Description of Unknown:Locusta migratoria sequence
taaaggaatttctgaatggcaactccttctacactttagatgaatttttagataaaaattagtaatttaggaaaaaaattaaaaataaaaaaaaaataaaataaaatattaaaatattgagtgtcaagtaataatatgtatagacacatttcactaaactgacacgttccacatcattacgaaatgtcgtatttatgatctatggaacaagtattaatctaatctaatctaa

SEQ ID NO: 2249 - DNA, 14 bp, unidentified
  source 1..14: mol_type = unassigned DNA; note = Description of Unknown:Locusta migratoria sequence
tgaagaccacaaca

SEQ ID NO: 2250 - DNA, 20 bp, unidentified
  source 1..20: mol_type = unassigned DNA; note = Description of Unknown:Locusta migratoria sequence
tgaagaccacaacaacaaca

SEQ ID NO: 2251 - DNA, 221 bp, unidentified
  source 1..221: mol_type = unassigned DNA; note = Description of Unknown:Locusta migratoria sequence
tgatgcatgcactcatactatattagtattattatattatcagcaaaaaaaacctaaaaattatgtatctgtattttattataagtgtatgtatctgtatttatattattagtattatctattattcagcttgtaaattttgtttcttgacatgttccacatccacgaggatctcctcaacatggatctacggaacgaataaactaatctaatctaatcta

SEQ ID NO: 2252 - DNA, 84 bp, Melopsittacus undulatus
  source 1..84: mol_type = unassigned DNA
taggttaccctgctcttgcaggggggttggactagatgatcttttgaggtcccttccaacccttgggattctgtgattctgtga

SEQ ID NO: 2253 - DNA, 51 bp, Monodelphis domestica
  source 1..51: mol_type = unassigned DNA
tgaaactgcacaaagacaatagtcattctcgatcaccgagagactaccact

SEQ ID NO: 2254 - DNA, 379 bp, Nicotiana sylvestris
  source 1..379: mol_type = unassigned DNA
taggggaagttgtgagatatttctacagcgcactagagtgagactagccagttaggagttagtcttaggatgctactggtcagctactgatgcagggctttatctgttggatattagtataccttccatctttttcgtatttcctatatttcttatattgctgttattttgtttttatgtattttatgttatgttatgtattttatgttattttattatgagtctattgatagtactaatatatcgtctcttgttgctttcttgagccgagggtctcctggaaacagcctctctgcccctcggggtaggggtaaggtctgcgtacatattaccctccccagaccccacttgtgggattatactgggttgttgttgttgt

SEQ ID NO: 2255 - DNA, 15 bp, Orycteropus afer
  source 1..15: mol_type = unassigned DNA
taacaacaacaacaa

SEQ ID NO: 2256 - DNA, 30 bp, Oryzias latipes
  source 1..30: mol_type = unassigned DNA
tgatgggaaaagccgaaagagaaagaagaa

SEQ ID NO: 2257 - DNA, 30 bp, Oryzias latipes
  source 1..30: mol_type = unassigned DNA
taagcggaggaagatggatggatggatgga

SEQ ID NO: 2258 - DNA, 612 bp, Oryzias latipes
  source 1..612: mol_type = unassigned DNA
tgattttaactgctaatttattctattagttttagtataggctattttatgtatttattttaattttatgcatcttattttcaattttatgttttttttttctttttatgtttttaattttagcatcttatgattttagccccagtgtttcttgaggggatcttttcctccagggattgccggcttggtcagcggttgttgctgcagttgttgcccttgctggggcggcaggggtctaattttacagcttcttggctgtgaaggggaccctggtgttgtcccggtctgggtgggcactgtggcgatgttccggtggccgggctggctcctggtatgaaaggattcccagatactgtttcctcgcagcagagctaagccatacttgtttatttatttatttatttatttatttatttaagttacatagtcatatttcattgtacgtgggagccatgggtcatgtggtttaatggaggggagtgggaagggtgaagggtgggttgggtttttattgtaatgttgtgtgtttactgtttttagtgttaaagcgcttcgagctgcacaaagtgcatgagaagcgctattttataaatttgatttgatttgatttga

SEQ ID NO: 2259 - DNA, 213 bp, Oryzias latipes
  source 1..213: mol_type = unassigned DNA
tgaaaggtcctatctgcacttttctttcctttccttcctttatttttaaatcatttttcaatttttttcttttcttttaaagtaaattttacgttgattatttctatgatgtattgtgattttaatgcatttttctgttttgtgaagcaccttgaattactttgtgtacgaattgtgctatacaaataaacttgccttgccttgccttgcctt

SEQ ID NO: 2260 - DNA, 99 bp, Parhyale hawaiensis
  source 1..99: mol_type = unassigned DNA
tagcagcgttttgggcttcccggtgttgcaagatgcttcatttgggttgtattacctgtccgtgggagctcaagcgtgaagttttaataataataataa

SEQ ID NO: 2261 - DNA, 46 bp, Pelodiscus sinensis
  source 1..46: mol_type = unassigned DNA
tagatgtcaaggtcctcttcgaatacgatggacgaacaacaacaac

SEQ ID NO: 2262 - DNA, 452 bp, Petromyzon marinus
  source 1..452: mol_type = unassigned DNA
taatacacattacattttgatttaaagaattactaatctacaactcattactaatcataaccaatgactgattactaatcgattatataattacattacccccccctccgcctctaatcactgcacctgaatgagttaagtgatgacgtcaccctgctgctctatataaaaccgggagcaagcgagggctttaccattctggcgaattgcccgatgatgctggaagtatttaccagcgaaacgtcgtactcaaactgtaaatgtggattaactcttcaacacaccggtgggctgaagtagtgaattatttgtcttttgtcaacgtgacactttttttgctgattggccgtgtcgggtggtggagggttacgacacatttataaataaacgcgatctaacccaaaaacctttattatgaataatattggtcgcgaaagcctacgtgttaaact

SEQ ID NO: 2263 - DNA, 682 bp, Petromyzon marinus
  source 1..682: mol_type = unassigned DNA
taatacacattacattttgatttaaagctttcgtgactgcagtgattcatgttcttcgctctttcggtggagtcgcgttggggggaagcaataaaataatagaatatatatgtttgttgttttgttgtttcccttcggcgtggctttgccgagggagctaagaatatgaatgcacattacaattccttataggggaaacacatactaattaacggattactaacgtagcatataatcactaacacacattacaactaattactaatctacaactcattactaatcataaccaatgactgattactaatcgattatataattacattacccccccctccgcctctaatcactgcacctgatatgagttaagtgatgacgtcaccctgctgctctatataaaaccgggagcaagcgagggctttaccattctggcgaattgcccgatgatgctggaagtatttaccagcgaaacgtcgtactcaaactgtaaatgttgtggattaactcttcaacacaccggtgggctgaagtagtgaattatttgtcttttgtcaacgtgacactttttttgctgattggccgtgtcgggtggtggagggttacgacacatttataaataacgcgatctaacccaaaaacctttattatgaataatattggtcgcgaaagcctacgtgttaaa

SEQ ID NO: 2264 - DNA, 303 bp, Petromyzon marinus
  source 1..303: mol_type = unassigned DNA
tgtttttaacatttgatctacataacgacaccttgccgatattaactatgttaccctatttgtattttttatttttaaattatatcttaaagctattttatattcgatatttatttaattttatatacttcagccccttggtgttagttagacttttaacccttattatagtaagacttgtttaaaacttatttaagattttagattcctatatgttgaatgtatgcaccatcctgccaaagtaaattccgtgtcggtgtgaacttacatggcgaataaaaccctttctgattctgattctga

SEQ ID NO: 2265 - DNA, 522 bp, Procavia capensis
  source 1..522: mol_type = unassigned DNA
tctgctgcaaaggacctcttcaaagtattcaaaagtaaggatgtcaccttgaagactaaaatgcgcctgacccaagccatggtattttcaatcacatcatatgcatgtgaaagctggaccatgaacaaagaagacagaagaagaattgatgcctttgaattgtggtgttggagaagaatgttgaatgtaccatggaccgccaaaagaacaaacagatctgttctggaagaagtacaaccagagtgctccttggaagcaaagatggcaagactgcatcttacatactttggacatgttgtcaggaaagatcagtccctggagaaggacatcatgcttggtagagtggagggtcagcgaaaaagaggaagaccctcgatgagatggattgacacagtggccgcaacaatgggcttaagcataaaaacgattgtggacatggcgcaagaccgggcagtgtttcgttctgttgttcatagggtcactatgagtcggaaccaactcgatggcacctaacaacaacaa

SEQ ID NO: 2266 - DNA, 375 bp, Salmo salar
  source 1..375: mol_type = unassigned DNA
tagcccatctataattagcccaaacaactacctcatccccatactgttatttatttattttgctcctttgcaccccagtatctctacttgcacattcatcttctgcacatctaccattccagtgtttacttgctattatttcgccaccatggcctatttattgccttacccctatcttactcatttgctcacattgtatatataactttttctactgtattattgactgtatgtttgtttactccatgtgtaactctgtgttgttgtatgtgtcgaactgctttgctttatcttggccaggtcgcagttgtaaatgagaacttgttctcaacttgcctacctggttaaataaaggtgaaataaaaaataaataaa

SEQ ID NO: 2267 - DNA, 642 bp, Salmo salar
  source 1..642: mol_type = unassigned DNA
taacattgagtggctgctgccaacatactgactcaactccagccactttaataatggaaaaattgatgtaatcaatttatcacttagccactttatattatttatattagataatgtttacataccctacattactcatctcatatgtatatactgtacgctataccatctactgcatcttgccatcttgatgtaattagatgtatcactagccactttaaacaatgccactttatataatgttttcataccctacattactcatctcatatgtatatactgtactctataccatctactgcatcttgccatcctgatgtaatgtatcactagccaccttaaacaatgccgctttatatgttttcataccctacatactcatctcatatgtatatactgtactccataccatctactgcatcttgcctatgccgttcggccatcactcatttatatatttttatgtacatattcgtattcattcctttacacttgtgtgtataaggtagttgttgtggaattgttaggttatattacttgttagatattactgcatggtcggaactagaagcacaagcatttcgctacacttgcattaacacctgctaaccatgtgtatgtgacaaatacatttgatttgat

SEQ ID NO: 2268 - DNA, 227 bp, Salmo salar
  source 1..227: mol_type = unassigned DNA
tgacagaccaatcaacctgcacatgtcctctactgtatgcttattgttattgttgaatgtatggttattttgacccttggttattgttgttactgttgtcccgttgacaatatttgattctcatttttatttatttttatattgtaaatatccaaaataagctttggcaatatgtacattgttacgtcatgccaataaagcgaattgaattgaattgaattgagaga

SEQ ID NO: 2269 - DNA, 391 bp, Salmo salar
  source 1..391: mol_type = unassigned DNA
tagcccatctataattagcccatctaactaactacctcatccccatactgtatttatttatttattttgctcctttgcaccccagtatctctacttgcacattcatcttctgcacatctaccattccagtgtttaattgctatattgtaattactttgccaccatggcctatttattgccttaacttacctcatttgcacacactgtatatagactttttgttttcttttgttctactgtattattgactgtatgttttgtttactccatgtgtaactctgtgttgttgtatgtgtcgaactgctttgctttatcttggccaggtcgcagttgtaaatgagaacttgttctcaacttgcctacctggttaaataaaggtgaaataaaaaaa

SEQ ID NO: 2270 - DNA, 108 bp, Salmo salar
  source 1..108: mol_type = unassigned DNA
taatcaaatggctacccagactatttgcacccccccccccccacgctgctgctactctctgttattatctatgcatagtcactttaataactctacctacatgtacat

SEQ ID NO: 2271 - DNA, 164 bp, Salmo salar
  source 1..164: mol_type = unassigned DNA
taggataaagtaatccttctaaccccccccccccccttaaaagatttagatgcactattgtaaagtggttgttccactggatatcataaggtgaatgcaccaatttgtaagtcgctctggataagagcgtctgctaaatgacttaaatgtaaatgtaaatgtaa

SEQ ID NO: 2272 - DNA, 170 bp, Schistosoma mansoni
  source 1..170: mol_type = unassigned DNA
agagtggttctaactttcttaactgaaagagtcttctggttgtacatttcagtccgccttatcttttcatcccttctcttcctactttcattattttgtgtggcgcatatgtatctggtgcccttttgtaccaatatatatgtgtttaaataaataaataaataaataaa

SEQ ID NO: 2273 - DNA, 1340 bp, Schmidtea mediterranea
  source 1..1340: mol_type = unassigned DNA
tactaccacaagacgggtattttggtaaatcttgaaaaatttcgatttaattaatgtttgagttaaaattgccatttgacttgtgtatgtgatttattgtgttaattaatgaattccaccctcttccagggaaaggtttaactttgcataaaattaaactctctgtctacacttagtagcaaattaatctagaatgaagaagcctgatggtatttttcccaaatctgctgaaaacttagttctgaaggatggaaataaaagcagataaagattcaatattcgataaagaaatggacctcaacaatcaatgtcaattatcaataataaatctgggcagatgtcagaaggcgataatcaaatgctgaattccaatgaccgaatctactttgatgtcttagatttgtgatcagcttccactacaaaggtgctgcatcaaaagccaatggagattcaatgccggatgaaaatgccgatgaaagagaatcagagccgaggacaatttagagaaaattcgattgcaactgcgtcaagagttcctcaacaataagatgaaatatcgaaactcaattggatcttttgcttttggagagtctcagaacggcaagctccatgtagagctgtgtccgatatgaaaaattcaaaattgttatattaataaatttttactatagtactactgagtgattttgttaagtctacgacttagtcgtagacgtagttgtaggcgttgttgggcgctgatgggagctgatgggcgatgatgggtgcggatgggcgatgatgggtgctgatgggtgcggatgggtgcggatgggtgcggatcggtgcggatcggtgcggatgggtgcggatgggtatggatgtgtgtggatgggtatggataggtacggatgagtgtggttctagaatgtaggtaggtgtggaagttggtaggtgtgtggaaggttctagaaggtaggtgtgtggaaggttctagaaggtaggtgtgtggaatttggtaggtgtgttggtccacaactacgtgacataataacagttaggtaatgtgttggtccacgtgacataataaagttaggtaataagtgtgtctccgagtagtgactgaccagtaagtacgtgacataacaatggtgacataataagtgtgtctccgtgtagtgactgaccagtggtcaagtgatgtaatcatgaggtcactgaccaaaggtcaattactaggtagcaactgagtggacaaaggtcaatctccaggtagcaacagcgcgtgcagaggtcaaatgttacgtaataattacgtaagccaaggggggttgtatctgacgggctcacatcctactact

SEQ ID NO: 2274 - DNA, 427 bp, Strongylocentrotus purpuratus
  source 1..427: mol_type = unassigned DNA
taatggatgtgggtattattattattattagtattattaattctctctcgtgtacaggtggacaaaccggaacaggttgcatgcagtgtgtgtgtcggcgtgaagggggtatgatgagatgggtgggctagggggggggggggggtaagagtttgtgtggtgtgagttgagggaacaggttgcatgcagtgtgtgtttgtgtttgtatggttgtttatgtgtgtgaaagggggtgtggtgtgggtgggctagaggggagggggggggggtgtgagagtgttgtgataggatggtaatatgtaattttaaaccttcctctactgttattttgattattcactgttacatgcaagacttttttttcccctttttttttctctatgttcattgattgatgtaacttatgaaatgtcttgtatcaaagatc

SEQ ID NO: 2275 - DNA, 127 bp, Oryzias latipes
  source 1..127: mol_type = unassigned DNA
tgactggagtctggaaaaacaaactgcacctttgctcatcctaattgttcgctactgtcattgtcacttttgcacatttgcacttttagaactgccactcgacatcttgtgtttttgtgtgtatgtt

SEQ ID NO: 2276 - DNA, 273 bp, Daucus carota
  source 1..273: mol_type = unassigned DNA
tgagggttatggtgtatgtttaaagggagggttcagctcagtcattaccagatgcattagcgccaatcaaaaatgtttgggtaagtcccatgtgaagaaggccatgggctaaggtattatattcttattatagcacacactattttatttgttgtgcactaagccgggggtcttcacggaaacagcctctctactttaagggtaggggcaaggctgcgtacatcttaccctcctcagacgctgctcactgagtatgtttggtttggtttggtt

SEQ ID NO: 2277 - DNA, 402 bp, Lottia gigantea
  source 1..402: mol_type = unassigned DNA
taattattcatattcaaacaatttccaactttaagcatagttagttatatgaacaatgtaatttctattaataaaagactccaataccagcaatagttgtttatttaatcttcaattaatcttttttaattcatttactttatttcaattattttacttaatcagcctgtatgttattttaagaattatatacctcttattgtacctgttaaaatttaatgtaatgtatcaataaaccatttatctcttgtgtgttcttaataataagcattaatgtatatatagtttgcccatcacttcttctcattatgtgcctgaggacgacgggggaaacacgtcgaaacgttgcataaaactttaaccagtgattgttgttccataaagctgtgtctatatatcgta

SEQ ID NO: 2278 - DNA, 852 bp, Strongylocentrotus purpuratus
  source 1..852: mol_type = unassigned DNA
gtctggaacgctcttgttcattgccgtgcaatatgaatgctgcaatctcctttaacattttattttaattagcacacgccaataatgaatcttgcttacttattttatcaatatgctaaacaacattatcattgatgtttttttttttaaacctcaatcaaggaatctttgaaattgtatttcatgtacttaagcaataccatgttatgaattgattatgatactaacatatgcatgttattatatttatgtgcataatatgtcaactatttgtttttataattaatagtttaaagtattaaatgggaaagtattaatagtatatatggtataacgtaatggtgacggcaaacttttttaacattgaaatatattgcaataatttgttttgatatttataccatactttgttttaactttaacctaatactatgtgttattgcgtacaaatgtcaactacatgtatatatatatatatttcaattgtgggtttttgttgttgtttgtttacaatagttttaattataaactgggaaagtatttaattgtatacattttataattactcaatggtgacggtaaactttttttaacattgaaatattcgcaacaattttataaatatctatagcataccttatcttaatttgaacttcgtatactatgaaatgtactatatcgcctttttattgcatgtccgaattatctctcatattataatgtgcatttattgttgttttgattgacattattattgaaccatgtatgttgtaaagggccctgatgaaaaccagctcatgctgatcgggctaccctttttaaagatgtgaaataaataaataaataaataaa

SEQ ID NO: 2279 - protein, 29 aa, Betaretrovirus sp.
LMGALQPGLPSPVAIPQGYLKIIIDLKDC

SEQ ID NO: 2280 - DNA, 90 bp, Aedes aegypti
  source 1..90: mol_type = unassigned DNA
tgactgtatgtttagcttaagttatttatttatacattcattaagacaacttcgtgtcagatggattaaatcagaaatacaaatacaaat

SEQ ID NO: 2281 - DNA, 160 bp, Drosophila ananassae
  source 1..160: mol_type = unassigned DNA
taaaattaaaataaatatactgttaacttagctaattataaaaataaataaataattaaaatacgtagtcgaaggcctcgtagctagcactacaccccaaactgttagtcatagttttgtaaactgtactatcatatccaataaataaataaataaatat

SEQ ID NO: 2282 - DNA, 121 bp, Hydra vulgaris
  source 1..121: mol_type = unassigned DNA
acattttaaatactaactttttttatgtttgtatgttagtgtgttacagctgttaaagttacaaactctacgtagtttggactcatcactctttaagtgtacagcactattatattatatt

SEQ ID NO: 2283 - DNA, 298 bp, Strongylocentrotus purpuratus
  source 1..298: mol_type = unassigned DNA
ataaatataattcataattcatattttacattattagtttgtatattgtaagacattgttgagtactgattcttgttttttttaaagtatcgattgtaaaagtaaattcattattttttgttttgttacgttctctaaactgatttgtaccaaaatactttgtttagctgtttaaggggttaggctcgactagcacatgtgctattatctggccccttttaccaaccaatagtttctcttcctgtatatgtaattattgtataaaatgtatgaaatgtattgctgttggtaaataaaa

SEQ ID NO: 2284 - DNA, 318 bp, Strongylocentrotus purpuratus
  source 1..318: mol_type = unassigned DNA
tgatattagctacagattttaacggttgttaaattcattatattttacatgtaattgttgtttgtttcactttttattacagcttaactttttatatttgattaattggtcagccgcatacaaggaccacctcctttctggctgctaccagcattagcaatttcctttgtattattcatgtttgtaaattgattctgtgtatttctgtgtttatctatgttagtaattgtaattgtgtgaaactttgtatactgcttttgttttaccctgtatgttttgtattgcttggcaaaataaattgaattgaattgaattgaa

SEQ ID NO: 2285 - DNA, 1884 bp, Schmidtea mediterranea
  source 1..1884: mol_type = unassigned DNA
tgagtagtggtatatttataaatataagtagcgaatttataatatttatctatactatctttatatatttcaagtggatcttttatgactaattaaaaatacttttttatatttttaacttttattactttattttctatttttatattctatgattcttataatgtaattttattgggaaagagagtaaacggggggcaatggggttagtctcagtatggatccggaccctccggaatcgggattcaatgactggggcagtagatgcgggatggaaattaagagtactttggcattagggtttctgggactgtgagtggtgaaaccgtaaaaagggagtaagaatccgggctattacctgtacggctagagaaatctagttcagccttgatgccgtatttttttgggaagtttattcgcactgccgtggtttgcgaccaagtttgatgggaagacacaaatagatttagttttggttcttttgccattactgaaatctacaacgaagccaccggctataaagagtggtactcttgtggtataccttttaagcacggtaaggaagtggaatggatgggttgctcattccggactgcgcgttggagcaattatattgatcgggtgatactaaaaagccgggaaatatcaattactagttttctggaatactgctgctcacttacagtttctggattacaaatttacccataggtaattgatatatagctggctgtaaggggtatgggacccttacaggtatcattattaaaggcttggatgatcagatgggtatataagggagggctatcaagttactggttttctgaatgatatttggattacatttctatcaaggtaacagcgacgtctataacttatatatccatacgaaatggaacgatcagatggataaacaagggatggattatcaagttactgggttttctggatgatattcggattacatttatcttaaaggtaacagcgaagtcttgaacttaactttccatacgtctagggaaattcgctaatagaaatattagtgattaataaccacacgggctaacaacctctaaggttgggcaagtgagttggattcatccagcttgcgcgtattatattttcgatccgatgtcacctgaggttacggggaattaaaccacagcttttcttatattactgaatcaggatataaggattgcatattaaaacgttggtgggttaatgaactataactgaggagtaatcaaatagtaatgatttgaatgcaaaaggtttcatttgttactgattaacttgcgggtttcatttaaatatcttattttatacatgggcaagaataacaatgtgaagtaattcagctctagtaatctaatgataaagcaattaccaaggtataacgccctattttgtagggttggccaaatataacttgataataaatgctgattattgatctactaggtatcagggtgcaatgccttacgaaggtaaggttggacaaatgtaacttggtaacatgtataactataagacccccgttcaggatagtggtgattgatagtggtgatgtagttaatacaggcgtgtatgaatctggtgaaggtgggaaaaacttcataactccggttatgatttgaaggtcaggtttggattgggtctgatcggctaatcaaggtagtgatgaactcaaagtaggggtctatggagagggagcacttgataagataattcacgataagatggttagtaaaaactcgcgatccctgcgttggaaagttttgaagtgctgaaggttggttagcaataatcaacaatgctcgttagcgaagggagaataattccgggctatcattcaaaactgtattttatcaatgaattatt

SEQ ID NO: 2286 - DNA, 23 bp, Strongylocentrotus purpuratus
  source 1..23: mol_type = unassigned DNA
tagtgactcgataagaagaagaa

SEQ ID NO: 2287 - DNA, 164 bp, Drosophila persimilis
  source 1..164: mol_type = unassigned DNA
taactctaatataaaacctatggaatacatctcacatataataaacataatataataagcataacataataacaacatagccgaaggtcgtagtaaccagtgctatcattaataagctaggttaatagttttaactctaacctcgctgtaaataaataaataaa

SEQ ID NO: 2288 - DNA, 108 bp, Drosophila sp.
  source 1..108: mol_type = unassigned DNA
taagattctccaggaccatgtgaaaaacaacatccggataaataagggccatactggcctatgattggccccctcaggagggccgtccggtttaacctaacctaacct

SEQ ID NO: 2289 - protein, 903 aa, synthetic construct
  source 1..903: note = Description of Artificial Sequence: Synthetic polypeptide
MIDDSELYIDDYILLRRDRTRHGGGVAVYISKRFNYKRRDDLISSTLECLWFELHYPNKSPILVGEFYRPPNSHVDFFEELDGNLDSALSEDMSCIILGDFNCDCMPHQLDLNAEKLMFYTNMYGLSQLIDTATRVTNTSSTLIDLIFVSDKELYNEWGIFETSISDHYLVYTVRDFSAKIHNKSEYAEFRSFKNLDEEKFYSELRSTPWQVIKDIDNVDVAWDMWLTLFNNIINKHIPVCKKRIRKKACPWISDEIVKLMTERDKVLKAAKANKSDDLWDTYKYLKNTVIHLMRKRKREYNADQISQNHNNSKQMWRCLRNLVPKSLPISPNSINVDGANVSDNANIAEAFNDFFISNATKITKDLRRNKSQLRVDEDNNIGPTHSQFNLNLITEDFVLKQIDNLSIDKATGEDHISCKLLKMTKNVIAESLCDIINKSLSTGVVPREWKKARVVPIFKSGDISSLNNYRPISILPIVSKIIERAVHQQLSEFLDVNKLLHPNQSGFRPKHSTATALAKLVNQWSLNIDNKEISGVAFIDLRKAFDTVDHELLLHKLACIGCSNRTIYWFKSYLGDRQQVTQFKGAKSHPSTIKLGVPQGSILGPLLFSIYVNSLPECTPEGIIDMYADDTTLTVSANDATVVEEKLTVALNRVMAWIKENRLVLNTEKTCVMLIGSPANLKKIESFTISLNGNLIKRVQFTKCLGLLIDEELKWSKQIENVSKLTQKNISMIKRAKSFLPQKSLKLLYNSLVLPRLDYCSVVWSNRFHSHTTKLQKIQKRAARIILNKTYDTPSADLFTSLKWMTLDKRFELSRVMMIYKCVHNLAPSYLQVGLINPNDVHEHHTRQIDSGCLRVPRFHTDCYKCSPIVSSIFEWNKLDNSLRTASSVNSFKRLFKQSCNL

SEQ ID NO: 2290 - protein, 765 aa, synthetic construct
  source 1..765: note = Description of Artificial Sequence: Synthetic polypeptide
MRQHNNILNDQGNALDLCFSNTDGIHVARSELSMVPEDSYHPALDVVLSIFDPPVLSPSNGPSPHTSYKYSAGDYTGMYHHLSGVDWASILESSDINGQVYLLTTVVQEAMDMYIPLKTSKKSRFPIWFSRELRTLLKRKDFLHRRFKKSGLPKWEVEFKICRKRCKKILNRDRQAHSDSVESDLVKNPKKFWRYAKSRLGKNIESEIVLNQHSDSAKGMSELFADHFASVYINNNNCSSSILPHSDVFGDSLGSVVVDEECVRLCIKKMKPTLSAGHDGIPAAIVKAYHELLTPILCTIFNNSLTSGIFPDDWKLAVVVPVLKSGNSGDVLNYRPISLLSSFSKLFEMVIHQFLSFKFRSIVIPNQHGFMSGRSTSTNLVSFMSAASEVVCNRGQLDVFYFDLSKAFDVVNHNILLYKLSSYGVCGSVYNLLKSYLSDRHAYVRVNNTTSSLYKASSGVPQGSVLGPLLFNIFVNDVSRVILNSSFLQYADDIKLYKKISTLEDCIALQNDAYSFGRWCLDNDLRLNHSKTKIMTYSRKTHDIFFPYSYHGELLSRVSELRDLGVVFDSTLRFDTHVIKVVQSALRTLGAVSRITKEFKSPSAFFTLYCSLVRSQLEYASVVWNGISKTNSSSVERVQNKFISIFKYRYLENGDPCLNGVCNSQLVNLLSLQQRRVKADLLFLFKTLHGSINSPSLLSEVSLRVPRVPTRLQSSFYIARHFSNLNPIQRSAECYNRYSDTIDIFNSCGSKFGNAVQIFLLQEKG

SEQ ID NO: 2291 - protein, 846 aa, synthetic construct
  source 1..846: note = Description of Artificial Sequence: Synthetic polypeptide
MPRVSHPPEWFSILIRSSIKFDTQPPIQEDWVQCARISVSTTHGDITLAAAYCPPRFRATDDCFSSLLDSLGPKFVIGGDFNAKHTWWGSRVCNPKGRALCRQVLSRNLNCHGTGTPTYWPTDPAKTPDILDFAISGGLDPARIQTREVEDLLSDHSAIAVSVYASAMLRSAGKKLIFKTSDISKYHHWLNNSTVTNPPLDTPELIDAAVVNLTSQIQEAATYAAPRFSNQTRDRSRDVHFWNPRVNELKSEKRRLRRVWFLSRNPRDKTALNRATKELKETLVRLRKEALDSFVGNLAPGDPHHNLWNVTKRIKRPLKRIPPIRRQDNSWCRTETERANAFAEHLEEVFTPANRCSPNEAAETARLLSEPLFDSESIPQATEEEISNLIAAMGNHKAPGDDAINAIALKLLPPISKSLITTIINKCLQLGHFPSSWKRAEVVMILKPGKHEANPASYRPISLLPVLSKILERVFLTRVLPVIEEAGLIPDHQFGFRRRHGTPEQGHRVAQYILDAFENKKYCLAVMLDIKQAFDRVWHPGLLLKLKNGLPQPYFKFLKSFLEGRRFAVRCGEARSDVKEARAGVPQGSVLGPLLYNAYTADLPVIPSQYIMAATYADDTAFLTTADTPAEASQTMQEQLDLLNTWHTRWNISVNSDKSTATTFATRRGTCPPVSFNGFPIPEVANPNYLGFTLDRRLTWRPHLLKKRKQAENRVREFYWLMGRQSKLPTSTKLLIYKAIIRPIWTYGIQLWGTASKSNINIIQTFENKTLRTVTNAHPFHDNATIHEVLSFPWVKDEIKKSSRQYMQRLQDHPNNLAQDLLDTSQRTRRLHRSHPLDLSGIRHAN

SEQ ID NO: 2292 - protein, 165 aa, synthetic construct
  source 1..165: note = Description of Artificial Sequence: Synthetic polypeptide
MAFDTVSHSILIDKLRKCGLDDQVVRWIKNWLKGRRQRVVVNGAESSWRSVTSGVPQGSVLGPVLFNIFINDLDEGTECTLSKFADDTKLGGVADTPEGCVAIQRDLDRLESWAGRNLMKFNKGKCRVLHLGKNNPMYQYRLGVDLLERVKGKGPGGPGGAEPQR

SEQ ID NO: 2293 - protein, 637 aa, synthetic construct
  source 1..637: note = Description of Artificial Sequence: Synthetic polypeptide
MKIAECGVPQGSPLSPLLFLLYIAILLQDENKNTKFGYADDIAILSIGNTASEAVAEAQKEVDKLVQLASENRIDFDSTKSELLVIGGGPKKKLDTSGLSVQIQGHSVPTSPYVRWLGVWLDSQLNFKQHVQEWCGKAQRITQFMRQTNSVQRSAAPGPMIKVVQACVLSTALYGAEAWWPGLTRITTQRGKKVCTGVGWHTDLLDSTILKAVRAALPVWRTTPNMALHRESGITPSAVILQQRNILAAARIQRLDDWHPLVFRSREDPKDTISRLGLCICQKNRSFKFPEWYLTRLEISAKNVPMAEGPGKLYFPEAESIRKNTGSDFQDEADYAKQWIASLSAETVCAYSDSSSCGPARSAWGYTLYKGGQVIGSDSGPLLGAEVYDAEIFGAQKALERALGKAGNCPIKVLLDNTTAVRALRTGQTKSSQEAVEVFTRLARQARSVEIRWIPAHAGVMGNEDTDRLAKEALRNLPDETDTSPSEMRDRPKYTFAALTRFVRQRCDEVVESWWRDHRPSRYEELDLQMKRKRPPELALPRWAHHRLITARTGHGDFIKYHERFGHEFENCECVCGREKRPWHFAECRIALQQWRNLKHEPPPRGREMLAEKGWERFLQFLTVTKCYERQTLHRED

SEQ ID NO: 2294 - protein, 975 aa, synthetic construct
  source 1..975: note = Description of Artificial Sequence: Synthetic polypeptide
MQPDPRTRKLALGTWNVTSLAGKEPEMVREVERFRLEVVGITSTHGLGSGTTLLERGWTLHHSGVAHGERRRAGVGLLIAPQLCRHVLEFTPVNERVVSLRLRVGDRSLTVVCAYGPNGSAEYPTFLESLGGVLESAPTGDSIVLLGDFNAHVGNDSDTWRGVIGRNGPPDLNPSGVQLLDFCASHSLSITNTMFKHKGVHQCTWHQDTLGRRSMIDFVVVSSDLRPYVLDTRVKRGAELSTDHHLVVSWIRWRGRKLDRLGRPKRTVRVCWERLAESPVREIFNSHLRQSFDWIPREVGDIESEWTMFSTAIVEAAARSCGRKVSGACRGGNPRTRWWTPEVRDAVKLKKESYQAWLACGTPEAADGYRQAKRTAARVVVEAKTRAWEEFGEAMEKDYRLASKRFWQTIRRLRRGKQCPTNAVYSRGGQLLTSTGDVVGRWKEYFEDLLNPAVTSSIEEAEDEGSEVDSSITRAEVTEVVKKLLGGKAPGVDEIRPEYLKSLDVVGLSWLTRLCNIAWQSGTVPLGWQTGVVVPLYKKGDRRVCSNYRGITLLSLPGKVYARVLERRIRPIVEPRIQEEQCGFRPGRGTLDQLYTLYRVMEGSWEFAQPVHMCFVDLEKAFDCVPRGILWRVLREYGVLGPLLRAVRSLYDRSRSLVRIAGSKSDLFPVHVGLRQGCPLSPVLFVIFMDRISRRSQGPEGVRFGDHTISSLLFADDVVVLAPSSQDLQHALGRFAAECEAVGMKISTSKSEAMVLSRKRVACPLQVGGECLPQVEEFKYLGVLFTSEGRMEREIDRRIGAASAVMRSMYRSVVVKKELSRKAKLSIYRSIYVPTLTYGHELWVMTERTRSRIQAAEMSFLRRVAGRSLRDRVRSSVTREELRVEPLLLHIERGQLRWLGHLFRMPPERLPGKVFRSRPTGKRPRGRPRTRWRDYVSRLAWERLGVPPEELEEVSGEREVWASLLRLLPPRPGPG

SEQ ID NO: 2295 - protein, 1554 aa, synthetic construct
  source 1..1554: note = Description of Artificial Sequence: Synthetic polypeptide
MMTMTFNGIRRLGWFLSVLSLVKQRLLNSSHESNSLSKLILKQICVKLNGVNFTQEDVDELNSIILSKIEGWEQDLNKFIEFFDNIQFEVFDIAEMANHCLLLAVSQIFECEVRVSNDKDDCKIIGEGYKNSWFGVLEIGMESSERVEKVTRALKGSSKIKLGKCGKDRQVNGMAGKGNEPLIVKEECLWYTTIGNWIIEIESKGEDDGKLYSGLMMNVIQKMNEGEIGEQEMMEMLKQIDLFFEMYGEILNRLEEEVMINGNALYEIWKIVSKLAVALNREIIVLMRGGEEIVLGVTERKRKFASFWLVAEFQEVGVRYYSIKSSKLIQEWKENMSIKPAIDVFEKRAEEVSYNLRFKESNQQAVIKRIDGDGSCLIRAMLDQMGRIDQNYYMSDYNVTKIRNNIASYINNSRERFNVYLYEHIEEVGTIERVIENIREKSYWLGEEAIITVAELFEKQVEVYTNQGLSVRIGVRKDNESALRIFYTGNHYDSVISIAEEEAGEIEAEMININEAEGNKMQAGGESRAVKSNKVREVNESSSHSKKITQYGKQSTNTTGDSNNHEQSKKKVEKQLRKDSEIKDKENKALKIVSWNVRGCRRKVKRDEIDDILVANDVMIAALQEVNTIGDDLSTNNYSWQVKDNHTNKARGLAIVVRKNQRIRILQAKECRKGIMWIKLTINGVKLIVINVHAPNSNQKNFLSYLNEIVTRESDRKSLIVLGDFNAQIGSEDLQPEDRVWIGTKLGHRYCNDNGELFKYFLHLSKLKNVSTKIGKSIEITWRTKDKSSQIDHVLVPQYTSFRIRYIKGCWTDLKTDHVMLTIGLVFTNNPVLKKSNKDTARINVDLLKIPEKQKCFREKLSSIPTKTDIQTDTLDKCYEEMASRLRIAAYNTLKVSTVPNTPRRKYALDRLRDALKVSKKHPDMINYKYRVANRRHEYQIAVKEHREKEITDFFKNLNDYDAGVRVRKTYNYLKDFVKRKKQKKAMISSRVWEDILKTCEGPEVEFCAEHDYTPLPNPPTNDEIKSILFSACNGKSPGSDRVVAEYIKAADEETLERIIEIIKAVYIRNDMPKEWKKSTQIPIPKKSGASEADHFRRISLCNVVYKIYAKWIAKQLRAYAGEPGLHQAAFTANRSTDDHIFVARRMMEEYWNSGQDLFILALDISKAFDNVKLQSIGKVLIDLGVPSRLVDRVLSCVKDEVTRIMWENQYSAEVKRGKGIKQGCPLSPLLFNYLIQDVLKKVVAEIPELKLMGINQLILPLILVFADDILIIARTKAELEKILHELELQLAKVGLEINRDKSQVLIRYPNDKAQHPKEILLNNKIFKVSDSLAYLGICLTATLNRKLTCKQRCLNAVKSSRIIVEFCKTFKPSWELGKLMYKTVIAPSLLYGTKVSVMTKKSRLKIGNYEKLILRNIYQYCKKPKDLKFNARKLLDGKTINRRIRVGRISYFGHVRRREKNHPLKLAYKLKFDKKKEGRPSLTWLKSLDQDFERYQNMNRSSWEELSKDREKIKKKLDEIYKNEESEISDGESSDGDQNSRYKHWKWKRRNEK

SEQ ID NO: 2296 - protein, 282 aa, synthetic construct
  source 1..282: note = Description of Artificial Sequence: Synthetic polypeptide
MVVKWGNVLSEPFYVSNGVQQGGILSPFLFNVYIHDLSTNLNLCKTGCVVGCQTFNHLMYADDLVIFSPYSAGLQTLLKVCSDYGRDFDIKYNPSKSKVMIVRTKDDRNVNFPVFKLCGTTLEQTSSIKYLGHFITDDWRDDRDIQRQYCKLYAQANMLMRKFSACSLQVKCSLFRAYCTPLYTAPLWWNYGRGTFHKFLVAYNDAFRLLLQVPRWYRASQLFVDAHIPTCEALLRKLTYSLMERLDKSKNSIIMSLTDPKRSSCRYTSALRKHWIQRLYSF

SEQ ID NO: 2297 - protein, 530 aa, synthetic construct
  source 1..530: note = Description of Artificial Sequence: Synthetic polypeptide
MEGMLSDESTYVKLSKDPIQKLTKEARSLLSIWKDKGFIEQHIYRSLLTTDGVLPRAYGLPKIHKPNNPLRIIISSINSPLHSLAYFLHNIIYNSIPEADSFVKNSFHLVNKLNGLHVESDHVLVSLDVVSLFTNVPKNLAVESVTTRWDLISKNTTVPVNEFLKALNLIIDSTYFKFNNTCYKQIFGLPMGSPLSPILADLVMQDLECKALKLLSFHLPFYCRYVDDIILAAPANSLSGILDTFNSMHDRLQFTMEREIEGKISFLDVMLINVNNRIIFDQYRKPTFSGRYLNFFSHHPLCHKKGVIFGLVDKLLLLSHPQFHCKNFINLVNILLENNYPLNFIFSMINSRLKHLFYKDDTYVEDKRVRRFFTIPYIESVSEKFSSFSCKFDCSVAFTIPSKLNKFITTGKDHTERLSCNDVVYKINCKDCDSSYVGQTKRQLKTRVSEHKADIRKASSPSVISLHRIGENHEFDWENVKILDKEPSYVKRSISEMLHIKNQMHGLNKQSDTELLSDAYLPILERIPPS

SEQ ID NO: 2298 - protein, 835 aa, synthetic construct
  source 1..835: note = Description of Artificial Sequence: Synthetic polypeptide
MSYAKIKTKYKDSKRTINKFQLTLVKLTKLKSSLKFLLKCRKSNLIPNFIKNLTQHLTILTTDNKTHPDITRTLTRHTHFYHTKILNLLIKHKHNLLQEQTKHMEKAKTNIEQLMTTDDAKAFFESERNIENKITTTLKKRQETKHDKLRDQRNLALADNNTQREWFVNKTKIEFPPNVVALLAKGPKFALPISKRDFPLLKYIADGEELVQTIKEKETQESARTKFSLLVKEHKTKNNQNSRDRAILDTVEQTRKLLKENINIKILSSDKGNKTVAMDEDEYKNKMTNILDDLCAYRTLRLDPTSRLQTKNNTFVAQLFKMGLISKDERNKMTTTTAVPPRIYGLPKIHKEGTPLRPICSSIGSPSYGLCKYIIQILKNLTMDSRYNIKNAVDFKDRVNNSQIREEETLVSFDVVSLFPSIPIELALDTIRQKWTKLEEHTNIPKQLFMDIVRFCIQENRYFKYEDKIYTQLKGMPMGSPASPVIADILMEELLDKITDKLKIKPRLLTKYVDDLFAITNKIDVENILKELNSFHKQIKFTMELEKDGKLPFLDSIVSRMDNTLKIKWYRKPIASGRILNFNSNHPKSMIINTALGCMNRMMKISDTIYHKEIEHEIKELLTKNDFPPNIIKTLLKRRQIERKKPTEPAKIYKSLIYVPRLSERLTNSDCYNKQDIKVAHKPTNTLQKFFNKIKSKIPMIEKSNVVYQIPCGGDNNNKCNSVYIGTTKSKLKTRISQHKSDFKLRHQNNIQKTALMTHCIRSNHTPNFDETTILQQEQHYNKRHTLEMLHIINTPTYKRLNYKTDTENCAHLYRHLLNSQTTSVTISTSKSADV

SEQ ID NO: 2299 - protein, 1206 aa, synthetic construct
  source 1..1206: note = Description of Artificial Sequence: Synthetic polypeptide
MCIQETWFNDFNVLSIPNYVCVCKNRPDGRRGGLVMYLKNDITFQAMDTPRNAEYQKVDIFCKNGVISIFNYYNPCKKIELIDLNNMIRNVPGKYLILGDFNSHNPLWGSNKLDTNGRTVESFIENNDLVLLNDGSPTRLDPYYGTYSNLDLSLVSKELARNTEWKVLSNNFGSDHNLVCLNFKHVYNRPGGENMGQRWSFRKVNWEEYREEIEEALRKEGYENLGAELNIQGRYNVIVKVIKETSNKCIPRVQIAKRRKVNPWWNNACKKAVQERNRLKNRLRRYYDLNDVKKYLKKKAVAQKVIRRAQYDYWLEYCRRMNRFTDIGKVWEQVKRMRDSTMNKHIFHNLFVDGNILKESEEKANAMATYFKSVDESLSVTKNENENILYNNSSTNDDDCINDDFNMSEMGNVLKEMKNSSSGKDDIYLIMIKNLPNKALVYLLNLYNDIWKISLFPHQWYEVIQIPILKSGKDPTQVTSYRPISLISTFSKIMEKMIKNRLTWFLEKNRLLNPIQSGFRKYRNVKDHLVRLETDIHISLKSKKYTVAVFLDLEKAYDSLWKTGLLRKLSILGIGGKMLLFIKAFLLSRISNVRINNYMSRHYTLENGIPQGSSLSPLLFTLMLNDLKINVSDVKLSCYADDIAIWCSNKDLELARRKLQEALHELEIWCWTWKLNVSPTKSAVLVFTNKQKKDILLQIKGHNLPICEQYKFLGVRFDSNLTWSVHIDSIIDKCKKRINLLRCVSGTPWGSKYEILMMIYKGLILSILDYGSEMYDSACISLTKKLDSIQYRALKIITGTIHNVSLEALQVLTGELPLRYRRRLLNDNFRVYLLSSTLNHPTKEVLGDDYDLNNLEWKIGEGPFKLRSFRDEVVVEGQTNLLPKIPEWRLARPQVSFEHHGKVQKKEMPPFEIKSIVLDSIGNSWNGFLHIYTDGSKLEDGKTGAAFYVSHYNVVKFFRLSHVCIMRAELVAILMALEWINTFIESSSVVIFSDALSALQMIDSYFIRCAIVNEILSIINILQFKDVCVAFEWIPSHCDIRGNEIVDRAAKKGAMKRCIDIVIPNTRSELAASRLIHYNKLWQAEWDNAEHGRFLYALHSDVSKPIHRQGLSRREECLIQQLRVGNCSLNYYLFQINQHDTGLCEVCQEDETIKHFIFYCTKYDKDRRLLKERIKLNNPNLKQLLMSNPIFTRELLGYIYDTNRFR

SEQ ID NO: 2300 - protein, 1163 aa, synthetic construct
  source 1..1163: note = Description of Artificial Sequence: Synthetic polypeptide
MFYPALLLFALSCFLKHLQPHPPSSQKGITITASLLSSPSLSAHEVFKLLCSITPVNSFSSHKTKTYKSRSHLAFLSFLLLAAGDISPNPGPYPIPVLLGTRSPNPPCTPLKYRTLTPIPKASIQISCALWNSRSVCNKLTSIHDLFIAKSLNLFAITETWLSPTDTASPAALSFGGLHLTHTPRPGNRAGGGVGLLLSPRYSFKVLPPPPSLSFSSFEVHSIRLFSPVSLRIAVIYRPPGPTSQFFDNFSAWLPYFLHIPTSWTDLTILDSFSPPAIHLKSFHLLLLFHFPHLRFTLLGSSPLFRFALRSYTDLLDRPHNSLTTFLPGFLTSFIYRPPGPTSQFFDNFSAWLPYFLSSDSPSIVLGDFNIPVNNPNAPATSKLLSLTSSFGLSLCSDSPSHSNGNSLDLIFTKCCSTSNFTNSPFPLSDHNLLTFQLSLTPSTPSAVPQTYTYRDLQSLNTSHLSSSFDSLHSNILTVSCPNQATSVYYSTLTTALNELAPAKTKRMRPKPLQPWHTAHTKSLQKQSRTLERRWRKSRSESDFCSYKSALLSYNTTLCQAKQTYFTALINSLSKKPAQLFSTFNSLLSPPPPPPCASVTAQAIAEHFKNKIDTIRSDIAQLNPHNHSPPSLHAPQSLLGSFSPVTEEEVSKLLSSSHLTTCPLDPIPTKLLRNANPCLIKALTHLFNLSLSTGIFPSQLKHALVTPILKKPSLDPSNPTNLRPISLLPFISKLLERLVYNRLTLFLSDNNLLDPLQSGFRQQHSTETALTRLTNDLLSAKAKKHYSLLILLDLSAAFDTVDHPLLLQTLRSLGLRDTALSWFSSYLSDRSFSVSYNGESSSPLPLSVGVPQGSVLGPLLFSLYTSSLGKLISSFGFQYHLYADDTQIYLSSPDLNPELLTRVSSCLSAISTWMSQRYLKLNLSKTELVLFPPSNAHIVPEVSITVNNSTITPSSQARCLGVILDSALSFTPHIQSLIKSCHFHLRNISKIRSFITQDAAKILIHSLIISRLDYCNSLLIGLPLQRLSPLQSIMNTAARLIHLSNRSSSAMPLCQSLHWLPLPSRIKFKLMTLTFKAVHNSAPPYISELISRYHPTRLLRSSTDLLLNSSLIPSSHARIQDFARAAPLLWNSLPQTVRLSPNLSAFKRSLKTHLFREAYPNLV

SEQ ID NO: 2301 - protein, 1217 aa, synthetic construct
  source 1..1217: note = Description of Artificial Sequence: Synthetic polypeptide
MKLRVLSWNVRGANDSEKRKVIKALIKSQKVDVVCLQETKMQEMSRMIVRSLGVGRCLDWKVLNSRGSSGGVLVFWDKRVLHLLEAEVGNFSVSCRFKNCEDDFCWLFSGVYGPSLMKEREDFWAELGAVRGLWSDPWCVAGDFNVVRFPVESSRGGRLSASMRRFSEIMEDLELRDLPLQGGSFTWKGGLNNQSHSRLDRFLISNEWEDHFSGSVQYVLPKPTSDHFPILLDGGGVRSGPMPFRFENMWLKEEGFKEKMQGWWVGLNFSGSASYVLVSKLKALKSLLRDWNKLEFGKVEVNKALALSQVDFWDKMELSRTLSVQEVDARRGAKEDFKKWALMEEISWRQKSREVWLREGDRNTKFFHKMANAHRRGNMLSRVKINGVWLTKENEVKEGVVNEFKAMLSSAGGWRPSLRGLSFERLEAVDAASLEEPFSEQEVMEALKGFCGDKAPGPDGFSMAFWQSSWEFVKEEVLGFFREFHNHGRFVKSLNATFIVLIPKKGGAEDLRDFRPISLVGGLYKWLAKVLANRLKRVVGKVVSKAQNAFVQGRQILDAVLVANEVLDSVLKNKEEVVMCKLDIEKAYDHVEWSFLFSVMRKMGFGEKWIRWMKWCISTVSFSVLVNGSSSGFFQSSRGLRQGDPLSPYLFVLVMEAFSSLLRKAVAGGFVSACKARSRGGEGVNVSHLLFADDTLVFCGASKVQLLHLNWILMWFEAMSGLRINLDKSELIPVGCVNNVEELAAAIGCKVGSLPTSYLGLPLGAQYRSRAVWDGMEERMRKKLARWKSQYISKGGRITLIRSTLANMPIYFMSMLSMPRKVRLRLERIQREFLWGGGALERKIHLVKWELVCLEKDNGGLGVKSLSILNKALLCKWSWRFAMEREAFWNQVIRGKYGEEQGGWSSKEARGETHGVGLWKTLRKEWEVVKSRLVFVVGNGKRIKFWKDIWCGDEPLCVSFPSLFALAVSKDAWVKDVWRCNEGGGSWSPLFSRPFNDWELEEVCSFFVALNRKQIQQGVDDRVIWRETNCGKFSVKSLYKSLVSGHPISFPSSAIWKVTVQPRVSFFGWEATWGKALTLDQLQRRGWALANRCYLCQRHEESIDHILLHCDKVRTLWVLLYSMFGVQWVLPATVKETLSGWNGSFVGKKRKGVWKASPLCLFWTVWKTRNKVAFEEEELSIQRLKASFVYFLWSETKRSIKDGPSTLVDFVGWVASR

SEQ ID NO: 2302 - protein, 1128 aa, synthetic construct
  source 1..1128: note = Description of Artificial Sequence: Synthetic polypeptide
MRKELVTIKNLIEESGATAPAPVPLEVAVEVHQSSSVPEITDQSTTTQEGSYSEPPIHRCENCGREFRTRAGVQQHRRKAHTNEFMEEKEKAAPTKKLRWTDEEKEILIESEIKIIKEGSLKEQHEINKILASRMPGRSQDGIAKIRQKQEHKAEIQRRLHGTVTTDETRGSRTSEITEPIRSLPINTKNWSEDELKRMLAEEVKLRNKNEKDINKKLAEIFPNRTMGSIKSKRTKDKEYQDLVKLTMQTISENPDNETDFNTSNTENNSTDAEKEVKNYLNMLLLSNNEEEWLTSTLKEAATLALQGKKTEASEKLNEYASKTLFPGLKITNQTRKREKKISKRETRRQEYAEIQKLYKKNISSAAEKAINGKWSIKPEEEYHNNKDLIKAWKPILEAPPFSDCRPIENIKEMDYALMEISTAEIFLAIRAMGKTAPGPDGIKYSKLKKNIQSMAILFNTCLLTSFLPLPLKIARTILIPKQENPGILDYRPLTIASVVTRVFHSILAKKLDNNAQLSQRQKGFRKCDGVAENIVILETILTNSRSEKRPLCMAFVDLRKAFDSVGHESIIRGAKRVGVPPMLLEYISSSYQNASTNLFGEILNSRRGVRQGDPLSPILFNFVIDEALENLNRNIGYLLKEEKVSCLAFADDIVLIAETKGGLENHIEKLLEKLNGAGLELNASKCATLMVMKNGKEKSTYISTKVIKIKENDIPTMKATETYKYLGLQMGFKAREQNANEVITEGLENITRAPLKPQQRIHILRDFLIPRLIHKLVLGRVAKKSLKRIDQNIRKKVRNWLHLPKDTTAAFIHADAGDGGLGVPALEHTIPLLKRERITNLRKSNDPVTKECLRMEYTKQVLGKWSRPTKIGETLATNKSQLKEAFRKQMLITLDGKGLKDHHETPTIHKWIRRGENMTGKQFITAVKIRGNLVATKSRNSRGRPEQEKLCEAQCGRPDSLGHILQGCWRTHGMRVERHNNICRRIKAIMKGKESEVVEEPRLQTNEGLRKPDLLICHKGKIIICDAQVVADSSNCSLESENQRKIDYYKKDSVVAEARKLIGRDDEDIIIMAVTFNWRGAISKTSIRDLDMLLDIKSKEVIKMSRKIIRDNSIMVEMHRNRTEKRR

SEQ ID NO: 2303 - protein, 1204 aa, synthetic construct
  source 1..1204: note = Description of Artificial Sequence: Synthetic polypeptide
MSGLTGREVKCITVNVLMEQQPHTKAIREGDFIVILLPQSDDETLCCPLCVGRGRYSGKTRVECLNRHVKEVHPDLTTTFRCWGCGFAAPGDKKYPRKIVTQHCATCVPEVSSAPSGRVDGERRVNTRRRLGIAAATEASPVRRTRRNGLASPPVEQDISQSAAPPEPARVPQHPEIVALGESADDEVFRSPVNSPPRDWRAAAPQQAASSSPPAVPGITAATPSNTTRTGNGSANSILAEHPIPTPPPTNTTEANGRADIPRSGRTPPPGQQAARRRAPTTEQRRIVGLLEAATGREQLEEATTQAMLFLARLTGRRPEPRNAIRPGPRQRHPAQEDVQAQAPDRIQEAKKLQRLYRTSKKRAVQKILAGPNMNCQIDKNTITAHFVELAARRDGGEDWPDVFDREEPTAASGEALCTPITREEVFRRLKGRNNTSPGPDGITYRDLAKADPGAHVLAALYNSIWRIEATPALWGVSNTTLIYKKGDAMDISNWRPISLGDTVPKLFAAILADRIKRWAVANGRYSASQKGFLEFEGCYEHNFVLQEAIREAKGGRKELVVAWLDLASAFTSVPHSSILQALEGHGLPSKARNIISSLYTGMTTRFHTAEGPTDPILIQSGVRQGCPLSPDVFNLTLEVVLREIQRTGEGYTIEGRRTSHLAYADDVAILADSPAGMRRLLFAAERGARAVGLTFNPAKCATLHIAGRGEEAVRPTEFSVQGTPVRALASEEAYEHLGIPTGYQVRQTPINTLRDLLADIGSIDRSLLAPWQKLDAVGTFLLPRLDFIMQGAHIDKGFLTEADKIIKKAAKSWLSLPQRASAELVFLPPSQGGGGLLTVAHSYKMLYSSDVTVSTIAGSTLRRTVSERLKKRASNIDIARFLSGDLDLPRSTSPSTFWTKVRSAALRIKTKLGLRWSWCQEGEVLLMACGDPRAPGTRVSPQTKHLVTTSLRRCLNRHYAESLLAKKDQGKVFEVTRRSGQSNHFLRSGSFTRFCDWRFIHRARLDVLPLNAAKRWQRGMDKRCRRCGSDLETLPHVLSHCGPHSAARQKRHNNIQDRLVKAASRCPGTISVNQTVVGVRGPDAALRPDIVVRDDVNRRVTIVDVAVPFENRLEAFDGVREAKIAKYTPLARQLTDSGYTVTVEAFVVGALGAWDPRNERVLSLLSISRYYAILMRRLMVSDTIRWSRDIYVEHVSGIRQYRE

SEQ ID NO: 2304 - protein, 1522 aa, synthetic construct
  source 1..1522: note = Description of Artificial Sequence: Synthetic polypeptide
MMDSRQLNTPKIRKYQNPKMTNDIMKSYNYAVLSDVTPQETTQQTTHLNVDIDKETTQPKQPLTKSGKPKSKPIAVSYKFKDATFIWDTTPQTNPPKDCTKLIDKTRPRKTIFKKSAFQTYLKKELSNETFVEVKTFLMATHKYRFKDENSRLLAYRIINRYVMETANEFKETEFDMARFAKFFTIPENWLKHLKPYSTATETSPADRIKVQKLVDLTCRYPFKTQEEQTSVANFLHFFTQRSIIGISRDYKFQKCIPFMARKTNGQETTSTINTTPPTEENRLPMVIITPLEEPKIEHRRPEKRGASNDTIVLSDEEFPLLKRRTLPTRKSKNPTGAGNVPTETECTDEVKFILNNEYQIECKECGKVWENVRNGMNHLRQKHDFPNRTDVMVSCVRCEVPIKGAECVNHIKNHKKDDKEESQAGSLVANTQDIPNESSLSQAAIEVYLRNILKMKENQERNIQYLEPSTANFLINRNLRAFYQNVKIEKLIGWEQVIWLIHWNKCHWIVYLANCDSKTSVILDSDNQMTLQQRCNIKAKFDKFLEGTFEEKAVLGTLERNVPQQPNNFDCGVYVIQYISDFLKDPQRMDYHTPDSKRIRKEIGELILEEMKNPASKIKNPNKEIQSLLQKFRLLQINVNDVFHWFAEEYQKSLPKIRTKRDGKLNKLSCSYQIQRLFGLAPKRAVKEIYFQETSTADLETRVLNEHFKKDESMMKECKIKNGNHYQDWITKAQIDNKEILEALKNSTDSAPGEDNIPLRQWIIWNNDGVLFDMFNYIKRTHDIPEMWKNYTTTLLIKPGKSQESNIPANWRPISILPTSYRIFMKVLNKRVLDWANRGELISKWQKAVDKANGCDEHSYVIQALIEKANRSYYKNEQCNLAFLDLADAFGSIPFQVIWHTLKNMGMDEKTINLLKEIYKDCSTKYKCGKNESEKIKITKGVRQGCPLSMTLFSLCIQYLIQGIAEKKKGATIAGQEVCILAYADDLVIVANTAKDMQMLLTTIENLAKQADLIFKPAKCGYYRDPRDKKSMMKIYGKEISIVDEKNVYTYLGVRIGDTKKKDLNVRFEEVKKKTTAIFKSKLRSDQKLEAYNIFCQSKFVYILQGEDIAKTKIETYDEEIKKMIKEDILKLQDKSPFTDFVIYSPREKGGLGITKIIDEQIIQTINRTAKLLNSSHRAIRAIIYEELIQVANLRGEKEINSIEEALKWLEGTNKYKKNSNAKTTWITRVREAFQTLEKKHKIKVRFVPKENGIGYKIKCDTQEKVEELDNSKELSKSLHWMIKEAYFKEWKTLKCQGYILSLKTSEFMEWKMPRGLPDPDWRFLTKVRANMLDINMKQANQGGRLGNTKCRKCEDKESASHVINHCASGNWSRVEKHNQVQNELAKELTKRNISFEKDCIPKETKGTLRPDLVIRLKDKIMIVDIKCPFDEESAIESARNKNIDKYRELAKEIQAKTVLPTTISTFVVCSLGTWDKRNNELLRQMGIRYEESKEMRINMIHKAIHGSRKTYDQHRNFNNG

SEQ ID NO: 2305 - protein, 1390 aa, synthetic construct
  source 1..1390: note = Description of Artificial Sequence: Synthetic polypeptide
MASCPKPGPPVSAGAMSSESGLTTHSVLAIERGPNSLANSGSDFGGGGLGLPVCLLRVSVGTQTSRSDWVDLVSWSHPGPASKSQRVDLVSLFPKHRVDLLSKNDQVDLVAQFLPSKFPPNLAENDLALLVNLEFYRSDLHVYECVHFAADWEGLSGLPEVYEQLAPQPCVGETLHSSLPRDSEPFVPEEGSSEKESEDAPKTSPPTPGKHGLEQTGEEKVMVTVPDKNPPCPCCGTRVNSVLNLIEHLKVSHGKRGVCFRCAKCGKENSNYHSVVCHFPKCRGPETEKAPAGEWICEVCNRDFTTKIGLGQHKRLAHPAVRNQERIVASQPKETSNRGAHKRCWTKEEEELLIRLEAQFEGNKNINKLIAEHITTKTAKQISDKTRLLSRKPAEETREEPGVCHRTRRAAASLRTEPEMSHHAQAEARDNGPGRRPLPGRAAAGGRTMDEIRRHPDKGNGQQRPTKQKSEEQLQAYYKKTLEERLSAGALNTFPRAFKQVMEGRDIQLVINQTAQDCFGCLESISQIRTATRDKKDTVTREKRPKKPFQKWMKDRAIKKGNYLRFQRLFYLDRGKLAKIILDDIECLSCDIPPSEIYSVFKTRWETTGNFKSLGDFKTYGKADNTAFRELITAKEIEKNVQEMSKGSAPGPDGITLGDVVKMDPEFSRTMEIFNLWLTTGKIPDMVRGCRTVLIPKSSKPDRLKDINNWRPITIGSILLRLFSRIVTARLSKACPLNPRQRGFIRAAGCSENLKLLQTIIWSAKREHRPLGVVFVDIAKAFDTVSHQHIIHALQQREVDPHIVGLVSNMYENISTYITTKRNTHTDKIQIRVGVKQGDPMSPLLFNLAMDPLLCKLEESGKGYHRGQSSITAMAFADDLVLLSDSWENMNTNISILETFCNLTGLQTQGQKCHGFYIKPTKDSYTINDCAAWTINGTPLNMIDPGESEKYLGLQFDPWIGIARSGLSTKLDFWLQRIDQAPLKPLQKTDILKTYTIPRLIYIADHSEVKTALLETLDQKIRTAVKEWLHLPPCTCDAILYSSTRDGGLGITKLAGLIPSVQARRLHRIAQSSDDTMKCFMEKEKMEQLHKKLWIQAGGDRENIPSIWEAPPSSEPPNNVSTNSEWEAPTQKDKFPKPCNWRKNEFKKWTKLASQGRGIANFERDKISNHWIQYYRSIPHRKLLTALQLRANVYPTREFLARGRQDQYIKACRHCDADIESCAHIIGNCPVTQDARIKRHNYICELLLEEAKKKDWVVFKEPHIRDSNKELYKPDLIFVKDARALVVDVTVRYEAAKSSLEEAAAEKVRKYKHLETEVRQLTNAKDVTFVGFPLGARGKWHQDNFKLLTELGLSKSRQVKMAETFSTVALFSSVDIVHMFASRARQSMVM

SEQ ID NO: 2306 - protein, 1584 aa, synthetic construct
  source 1..1584: note = Description of Artificial Sequence: Synthetic polypeptide
MDLFNFDINDFQTAVVQKIPAGSFITAIMLQINKINSEFKNHQLNEMEFCCLIADFIRCNDHLFSKMWEEDIKEVVHKIFSMESGVEVHMAQAIVELFQTKICFYQKKREVEVIQPNSCSNTNMLTEINILFTFEDGTEKFYSIQSITDKKSSGKKESGYNEQPRNELYKVKEYESGREMMVKKIKGDGNCFIRAIIDQMNKSEDYYRCNLSDIIELRNKIANHMNKNRERYEMYLIESLEENGFLKFIEDIRKPGVYLGHESMVAVTEIFDKCILLYQTDSETLRIGEEKDREEDVLRLLYTGENGVKNHFDSIRIVKGQTEENTGTEKTSVEEVKEKESYTSMHGKHNDDSEEISTIRYRKTQDTPITGKQIKETGKLVQEEGKQWQWNKERNNQKKSDDKKAVEKNMDERGNETRKITREKHKPINKDRAITKDFITDNRKEEILDLEEKRRRQRSKEREDRLEQLATQIKTNEERSMLINGSQRQGWEENDSQERLDREKQAKTDKNTRGRIQMDVQGKTEEPLSIVNDEQVRKENNTKDVKLGDKKENPRISTKQRNDRKRAKNERVDEEGVQENSDTMDGGTKKHRNHVAEERGETRKGQVIESEESRATGVKATGEIGEENEEVKESIMLIATLNIRGCSKLEKRQEIDNMLESFNIDVAALQEVNVKAELITTRNYEWRIGGQGQNKSRGLAILIRKDKGIDVMEWKEIGKYGLSISLLSKGRKIILINVHGPNKNGYIFYSSLGKLISQDHLRSNLIMVGDWNAQIGKDSVMPEDAECIGNRLGFSNNNDNGEEFKMFLTIHKIKNMSTVIGKNTDITWKSGKKESQIDHVLKPREGKIEIRFIKGYWTGINTDHKMIVTGIRTREKENKEKGKKKIPIDASVLKYDTIKEKYQEALKKYEIRQEKGNTIEQDFKAVAGKMKKAANEVLRSARAPLTPIRKAALNKLKTAINLSNKHPDIFPYRWKLKDRRMEFQAAIRSHNERKIKKFYKELNDFDVAVRIKKSYQFLKGFLKRKKHKNVYIPMSQWNEALKESEGPEIQLMDEHDTCPVTVPPKEEEMMQIVQQQCNGKSAGADGIRMELLKYADKQTQQELADIWKRVWIENHLPEDMEKTIQVPIPKNAKAKGVQDFRRISLCNVAYKPYAKWIKQRLREFTGEPDINQAAFTEGRSTDDHMFVTRRILEEYWNAGNPLYVAALDISKAFDNVSLLQLRSILAKLNVPSHLIDRVLQCIRKEKIRVRWQNQYTTECNRGKGVKQGCPLSPFLFNIVMQDVVRKVKEKVPELNLMNTGSLKLPLILIFADDILIITKDEEGLKRILIALEESLREVGLEINNDKSQILIRAPNATKRPPNTINLNGRNYDVKTSMRYLGAWLTDTLNRPATTKQRCVNAAKVSKLVVEFCKKFKPTWEIGKLIYNTVIAPSILYGTKTATLTKRSRVQLGKYEKQILKDIWNQCRKTDERKFNVRKELKGKTINRRVRVNRISYYGHIQRREETHPIKMAMKLKFNKKKHGRPSFTWKKSLEQDFNRYNGITEEEWSQIAQDRDKIKKKAEEIYRNNESEISDGEDSTEQDM

SEQ ID NO: 2307 - protein, 1376 aa, synthetic construct
  source 1..1376: note = Description of Artificial Sequence: Synthetic polypeptide
MPLFNRPPQCRQLCPNPLLSANNATIQVLDSPVSTHNETSRSTQLDAHRSNFVGGSQIAKVESSDLDRSSPFNGVFYRIETGKIIAQPSSSPLPPSSSPLLPSSSPLLPLSSSSSSTPLPLSSSSSPPPPSSSSSPLLPLSSSSSPPPPSSSSSPLLPLSSSSSSTPLPLSSSSSPPPPSSSSPRPHPGPRKKRNKQKKRTKPRKLPPPTSSQPLPHTTEGLNPVFEDLFCPVSGCPGPSSIGTDEWILCNACLIWYHTSCLFLQAIPEGDWFCANCPQIDTQIGPQINSNTSSPANQSYLGTHIQLTQSIPFTNPRASQPISTLSTPLSNFISSKETCTSLTLEWLNNHIVPGGVIEKAILHDAYRRDSLGIFKPINDAEMGKLIKNSFSNIRTKRIRTELHGTSKYHYVGIQFKSEHSADSVFDFQTIISSLRQNCPTLKQCPKACRIPVAQVLKSAVDKCISENTPEAWHLLLTFPYITLQCESKANIKNGQSLNSKIRNNLSIFESLDKNTYQDYLITLSSKNSAHDKPGSTIKDIGPKVISKVSEGNIRGAIRLLTSDDIIAPNSSETLETLVEKHPPQPLDNFTVLDEPNIPPFTTTVEQVISAIFSFPSGSAGGLDALRPQILKDLVSQHTGDVGTQLLESMTKFCNFMLAGKVPLDICPFIYGASLTALKKKSGGIRPIAVGCTYRRIVSKICVKVMNHVFQDYFSPVQVGFNVKNGAEAGAHAARRFFSFPHKSPTAFLKIDFKNAFNMVDRGKLLSSVHELVPTLYPYINQCYRFSSSLVWNSSLIESCRGVQQGDPLGPPLFCLILHPVVSNLGSEFNMWYLDDGTLGGDPTTVLDDFKHIISCANEVGLELNFDKCEVSVLGLQTNTQCILESFQSVAPGISCMTQENAELLGAPLTYESIEHVFRKKINAFSNMAGRLNSIPNHIAYYLLKHSLAIPRLVYLLRAAPIFKSPHLLEEFDSLLHDTLEQITNCQINPLSLEEIALPVKLGGLGIKQSKTLATPCFLASSFATTDLVSLILPSYVTALSDSLVTEAQDLWKSISCDELPRSTISSIQSSWEIPIFNQVCSRILDSSTTPINTARILASRSKESGAWLQALPSRNLGTLLDDNSFRIAIGLRLGLKLCFPHKCVCGTQIDELGLHGLSCKKSAGRHSRHTQCNDIIKRALISADIPSIREPLGCCRTDGKRPDGLTLIPYKQGRSLIWDFTCTDTFAPSYLSHTLRHAGTAAKLAETKKHKLYSELEKQYIFVPVAVETSGVWGMEGLKFIQDVGRRMKDVTGPMSTTFLIQRISLAVQRGNAASIMGAVPSQRGLEELFYILNDRSFYLQKSCKGPNGDLGRLSGSSKGFPNPPTSGFSSTPQAN

SEQ ID NO: 2308 - protein, 867 aa, synthetic construct
  source 1..867: note = Description of Artificial Sequence: Synthetic polypeptide
MFSHASSAISQQVMVLGDLNFDLLERPLPAPTKQYLSIFDSLGYQQLITKSTRPISNSLLDHIFVSSSDFVIEADTISNTASDHLPIFVAWKLKAGYTRPTGHKVLRFRSRKNFCIESFMHDLSLVPWSTLDIYDDVNDALDQWYKLFNDILTVHAPIKEHRIKRPLKLDWFNAEISAAIKARNCLHRIATSLKTDTSWSEYRRARNHVVHLIRKAKKTFYNDAIKNNLENPKNLWKIIRNISPAKHVNLPNRLTVNDTLYEDTFDIANFFNEHFSNISSQVCNDAVPEFPDRSVLTNFINFKHQPGSYFSIPPISEDFVLNSPSRLDFGKAAGLDELKVFFLKSAAPEIFRSLTKILNLSISSCVFPDPWKSAKVPPLFKDGSLFDRTNFRPISVLCILSKVLERHIHTSFYYFLTSQDLLTDFQFGFRWFRSCELATINLSDSILKNMDSGLPSGMLLIDLKKAFALVDHNTLLLKLGLYGCDELTLKWFKSYLSGRTQKTCFKGVLSNALPINVGVPQGSILGPLFFLLFINDLPLFLSSDLVTDTTMFADDTTFLISGASVPDIELKLNKLATDVHKWATLNRMVLNTKKTKSMLIGSHQKVSNLAESSLSVTLNSCPIEQVNIARVLGVVFDNHFTCEPHIELFCKYINSRISLLRSIAPFLTPAGAIHYYNACIHSQFPYCASVWGNCSQTLQLLLLRSQKRAARTILSADFSVPSVSLFSRLNWLYICDLIKQRKLWTLFSILINPDCPLCLRSKFSFVSHERRTRSSTPNNLVLPQPRTDAGKRTFSFSAISLFNLLLPSLKQLAFSRFLNLNQLPNVTSLAKKKVRDIFHSHLNSVSHLEQLFCHACRFYIDCRCYFS

SEQ ID NO: 2309 - protein, 960 aa, synthetic construct
  source 1..960: note = Description of Artificial Sequence: Synthetic polypeptide
MITLIKINYKAELINELNINFCLEEIKLDKENLNILYLNTRSCRNKEEELYQLINEFDGSVHVVVFAETWLYKNEIFNLLGYDAYHGCRDGRGGGVSIFVLSDYRSQLMLVINSEDNNFLMVELIDQNVKIMGVYNPGRSFNLFFEQLEQILHNYKRIIVCFDFNINLLDSSGELIRQYTYKIQSLGYIILNKLDARYATRISNTIATVIAHIITDIFEYDLQFGIKDTERLISDHRTLTLSMRIENHKKNKPDHKKICVNYENIIRSTSQNTFEICQQFSDIVVVLNEIMTKNRTEILSRKKAMVIRKPYINNALIAEIQNKNELYRQYRTAPGGVLKDELYILYARKRNMLKNKIKFAKEQYYGRKMHKNINNYKKTWSTLREIIFQNGSENITPQALTLKENGKIIDSAAQIAKCLNEYFINIGWNIQQNGTGNDNFLIYLNNMPETRFSFSVVETEKAKNVINSLKSGVAVGLNKISTKCIQKCVTLIAPKLTEIVNNVILSSQFEDCLKIAKIVPLYKSGDKFSKSNYRPVSIIPALSKIPECIMNEQIKHHLLQNELLNKNQFGFLPKKSTETASLELLNFIVKGLDDGEYVGCIFIDLRKAFDCISHELLIAKLSFYGFTPSAVSLLKSYLANRKQQCQVNGVLSEPLLIKSGVPQGSIIGPILFNIFINDLFNIPLKGKLQCYADDAVLKYRAKDLETLQSMMQHDLQLLPSWFSANKMQINNKKTNFIIFSLKTSNVSLDLFINNERLSQVTEVDYLGLAIDKNLNWKSHITLVKNKITPFIFALRRVRGCLSTKSCWQLYNAFILPHLSYMNTVWGSAAASHLNVLKVLQNRVIKTIRKLPFLFPSASLYSPEVLPINLLHKYNCLILVYKIKYKLVESNIRLTEFHDLHSHSTRARQNFYVSRPRTELSLKHFIYSGITQFNALPNHLKLEIHLSSYKKKLKKYLFENN

SEQ ID NO: 2310 - protein, 917 aa, synthetic construct
  source 1..917: note = Description of Artificial Sequence: Synthetic polypeptide
MWLRPDVLNSELCSNYTIFRCDRSEQTSSFQRGGGVLIAVNASFRCTSVSLNDCDSLEQVVVSVNLPMSTIYLCGIYIRPTSPPEAYSMHATAIQSICNFSSETDAIIVVGDYNLPGLSWISDEELNSYLPCNASTEAETTFVEAVMATGLYHVNSIRNVNNRILDLAFVSDVCDIEVLEAPSYLLRMDAHHKSFVLRVQIWETRNNSSSDSNDETDFDFSLCDFESLNASLSMINWTNELANKGTDEATAHFYDKLYDVLHSNVPRKRLRPKQKGKLPWWSPELRRLRNGVRKARKRYYRSKSHVVRQNLHVIESRYNKCKVFTFRNYINSIESNLKNNPNSFWSFVKSRKSKNRIPEQIRFQNRTSANVDESANLFADFFSSVNSTISPTLSTATRHSIPTHDITLSFLNFTEQDVKTTLTSLNVKKGAGADRLPPSYWKECAESMKLPISLIFNRSLADRKFPAVWKTASVVPIHKSGSINSVDNYRGISILCCIAKVFESMMHMVLYNATRHLISDSQHGFVKKLSTVSNLMCYTNFLSSEIERRQQVDAVYFDFSKAFDKVPHDLAIKKLEQMGLPDWITEWLRSYLSGRKAFVRIGDTQSRGFDITSGVPQGSVLGSLIFVLFINDLSHRLKSCKLFYADDLKIYRAITSVIDCYALPSDINELLLWCSENGMQLNNSKCKCITFTRSLSSIYFNYEINGSIIDRVTTINDLGVTIDSKLKFSKHVRVTTAKAFAVLGFIRRNSQAFQDIYTLKTLYCSLVRTILEYAACVWSPYCTTQVLHVEKVQRSFLRYALRSLPWNDPVNLPDYESRCMLLNMETLSFRRTKLKQMFLFDLITHNIDCSDLLAEVGFLAPSRYLRSRQLLAPRTHRTAYGQNSPLTSCIRSFSIVNDVFDFNLSRVEFKRRISSIR

SEQ ID NO: 2311 - protein, 913 aa, synthetic construct
  source 1..913: note = Description of Artificial Sequence: Synthetic polypeptide
MNCFSIKNKLPQLDLVSSTNNFDVICLSETKLDDSFPDSLLSLNNKFSVVRKDRNKHGGGVAILITKKVKFCPIEIPKHFSSPEISGVDILLRGTTVRVIVAYHPSHTSSLERLVQSLEFLLCSQKHCVVLGDFNMPHINWETLTACDSPCKTFLAFVTNNGLTQHVLSPTRLNPDNILDLCLSNTKIVRDVQVGELFSDHKIISVTLKLSNSAKKVVKRVQLFRKANFQLINYNLSMINWDVEMSCMSLEEKYEFFVSVLQHQIALHVPCKNINVLAKKHGPKILSLQKEKLRIWRAAGNSDNYKKISLILKEELIQEDQMNTEKSLTYGTSKKFFKFINSRYKSNDEIGVIKDSQNIPVNSNILKAELLSDAFSKVFTVDNSSSTLFPSRTNNVLESMTFEPSVIEKVLLKLVPKCNTTPDEIPAIFLKKVGTSIAIPLSIIFSESFRTSQVPRLWKTAIVKPLHKKGPRTDPNNYRPISLTSSVCKVMEKLVRKNLTDYLNSQQLFSRAQFGFRSNMSTESQLTSYFSTLISNHSLRKPTYSVYVDFKKAFDTVSFEKLTCRLMSYGIKGQLLDWIVCFLTNRTQRVNVNGVLSQEKFVLSGVPQGSVLGPLLFLLFINDIGDKFQSHFLLYADDLKLFSTNPSTIQTDLGLLSEWCDKWQMSVAPNKCENIIFNLTKSPRTLNFDFTIKGSKIPRTKKIRDLGLILSSDLPFSEHIDTILRRSHQRINIFFNILRRASFETFIKCYTIYVRPILEYGSIVFNPVLKEQIKRIESVQKSFVYRVFKKFHIPYLNYFDALSVCNLTSLELRRLHADLVFLYKVIVSKETLLYPPFFTLPSLPNIRKHKFYFRSNSKNSNKFFSQFISNRSLNCWNDLSPSVFPPTPHSINFISNISYCNFQKYLTLNPHNF

SEQ ID NO: 2312 - protein, 746 aa, synthetic construct
  source 1..746: note = Description of Artificial Sequence: Synthetic polypeptide
MKFHDLAQMVNFPTRFSKLNSGTFLDLIFTNNSGVLQNLKPGTPFINSDHISIFFSLSLPQPTPAHSAPPKSFMNFRKCDFFNLNRYMVSYNWPKQLSFFAPPDSKLNHFLNIFNELISDFTPQYPTLRVQSPKVTGRKLYRKLRKHHPDTESSVLKKRVKSRLKFLKKKNMAFENKLIHSKNSKSLFSYIRNRIKPSSSLTHFSVDNNNVDKPIEMAEVLVKEFSKSVVTHDPPFPTFPSCESTPSPVDTSPLTIASTILKLKPKIGYSLDNINFFILKKCCDSISIPLSLIFKEFITTNSFPSCWKTSIVIPVHKKGNSSDPKNYRPIALTHPLSRLFERIVLNPTRKTFSHKISKFQFGFLNNRSCITAHLNASSNYHKILSVPNQFVDIILFDFAKAFDSVPHELLLCKLRNFGFDDNICLWFKAFISDRVSKVKIGDSLSNSSFKNSSGVLQGTVTGPFLFLVYINDLLDLFPPDVHVIAFADDLKLFSNNCQSLRSSIKIIENWCKIWQLKLAENKTKVLHVGKKNPKYKYYVNGQNIECCSKACDLGIWVDDQLAYEKHILVKVNAAMFKCRQILKNFRSLNMMFYFKLFNTYIRPILEYGCEIYHPKSASLTKKLEQPLRYFSRHVFKKCKTQYDSYEHRLNQSNQQSLKHRRVFLILKTFHNIITGKYHFPNLALYLKNSKSPRFPYQMTAIGKTNNNSFLHTHLTIWNLVTKHFPVPVSGYTFSKRISCLPLESYV

SEQ ID NO: 2313 - protein, 968 aa, synthetic construct
  source 1..968: note = Description of Artificial Sequence: Synthetic polypeptide
MDVYHSKRTKLTRPKTRKTDLRICTFNCRSVATDNRLAELLEETNRIKYDIIGLSETKRSAEVHMTNRDGTGVILGKRNDSSVSGGVGFIINKSLMPKIKEIKIVNHRIGYLTLQVNKNQYTIIQGYAPTADYEEEDHSNFYENLEDVYKSCKSRYKMVIGDFNARIGERKGNEVFIGPHSMENRNDSGERLATFCEVNRVFHMNSQFIKPTHRRWTYISPDKQHRHELDHILANGKYITDVSVVPSFTNGSDHRMLRANVHINAKQAKFEQVKRRKPPRRVLDPTAALLATENLDSCEDQDIDKEYDTLVHVLKKAQDAAVTIPTNHSRNRLKDSTRLLLSKRRFTDRSDPNFKTLSKECRQAVKRDHENFAKDRLLNAANQRKSLRKVARDINEYQSYIPCLLSGETGEKLTSREKMEIEVRRFYSNLFATKQSKATTIIPQQTKALPPFLPEEIQHSLNSFQNGKAAGEDKLSADFLKSCHSSVHKLLANKFSRYLQEGKVPTKWKSSKTTLIFKKGDKENLENYRPICLLPVLYKVFTKCILNRIRKSLEEAQPVEQAGFRRSFSTIDHIHSVQRLLEVGREYQIPITMVFIDFKKAFDTIEPTALWESLKTQGIDSGYIKLLKECYNDCSTTITPFYNPVNIPITRGVRQGDPISPNLFSACLESAFRRMSWPHLKEDKDDYDNSPGIRINGRNLTHLRFADDIILISKTPQIAEKMLQELVNSCETVGLEINASKTKVLRNKFASSHQIHIRKNNTMSAIEDVEEYVYLGRLLNTKNDLEPEIHRRRRSAWAALNNIKNTTDALTCPKIRAQLFDSIVLPALTYGSETWTFTKALSERVRITHAALERKLVGITLTEQREKNLHREDIRKMSQVKDPLVFITKRKLSWAGHVMRRNDNRWTTLLQEWIPRNEKRPVGRPPMRWADSLKKEISVRQGTQLIEPWSTIAKDRKKWIAVIRAHTN

SEQ ID NO: 2314 - protein, 1723 aa, synthetic construct
  source 1..1723: note = Description of Artificial Sequence: Synthetic polypeptide
MTNVYLKPVNDNQTNKTGDNSRNTMSNSQCEMTWKPVARTYAQAASTNPADDKTVTVLGCKYNLLKLGNTPQTTKRSPPKPSRGGARISSVYTLTDELEITHREEGKITFAIDLPNKNNILCPLCRECTQTRGRGSSFTKHMKLHVKEKHQLKATFIYKCSMCNEYEPEKKCGTKWIQTHLQKVHNYKYDESAIVVPVPPNTRQQIANELNNAAPFVDIRKPKANVVEEKKTENGALLKFLTKSNKDEQEHSQSNDSPNVESPEKANQALTIDPKGNNSPSKSSMRSSQSSASSICQEIQEIITLSEDEEPKAARPKPGINVWSLINEKGKDAYIDTDIMMAFLKMRVENYDSVNIIDPLNYQFPARVDLVPLIQRNLEDGKKRVVFPICADEHWTLLTISNGIAAFYDPTGSRMSSYIEELVNELGLIIPKEQDEQPRQRDSYNCGVFVMKMAEAFIQDTEWEMEEVEEDVKNFRRNLLEELKPNYEIFAEKIKYYNSPGKSFAQSRPTSRSSQCAVCPTCSRSATPMMDVGNMEVDPVPQQQETPKSREPEQDEGWKVVGNTRKRGVVTERSPNISPEAKRQFTGPEIKVVSPGKFHPLVGETEEMEVTCDSPPTKEPTTEPKVTPSLPAMRIVSPEVTKKQTSKKKGKYGKKKQQTKKAQPPKGEPTKKAQPKGEPAKLIEQVRTWFDKQMKSYQEQGSNIQTLTWIADSLTAAIFKANNGNKYLVDKITARCPPPLLNEGEMATQTSRRTEAVKPKDRFVKESNEPLRIQYAKNRAKTFNVIIGKHSARCEIDINVVENHFRQTLKAQPVTEKALNTVCSGIKKAEVDPSIEGPISSGEVKAILAKIKDTSPGTDGVKYSDLKWFDPEGERLALLFDECRQHGKIPSHWKEAETVLLPKDCTEEERKKPENWRPISLMATVYKLYSSVWNRRISSVKGVISDCQRGFQAIDGCNESIGILRMCIDTATVLNRNLSCSWLDLTNAFGSVPHELIRRSLAAFGYPESVINIISDMYNGSSMRVKTAEQKTQNIMIEAGVKQGDPISPTLFNICLEGIIRRHQTRKTGYNCVGNKVRCLAFADDLAILTNNKDEMQDVLNQLDKDCRSVALIFKPKKCASLTIKKGSVDQYARIKIHGTPIRTMSDGDTYKYLGVQTGNGGRASESESLTQIAAELQMVHDTDLAPNQKLDVLKAFILPRLQHMYRNATPKLTELKEFENTVMKSVKMYHNIPIKGSPLEYVQIPVKNGGLGVMSPRFTCLITFLASTLFKLWSDDEYISSIHKKALSRITAKVMGLKTQTATLQEQCDYLNTKKAITKGGYNLFSRMNEASRTLSVNLGAPLKSMQFIPENGEIALEVQASENSQIKVFSKADSMKLVTKLKDLVKSAMLKNFLENKKVKSQVVQVLQHHPQSNKFVNDGKNISISSQKFVHPARLRLLVCNGNSYGKDHPKDCRRCGYECESQAHILQHCTYNFSTGITQRHDRVLNRILHEVIKGRKNNDYYDIMVDTEPGPTRERPDIIMIQKDGPEVLLADVTVPYENGVVAIEAAWEWKIEKYSHFIEYFARLGKRAVILPLVVGSLGTYWPDTSNSLRMLGLSDGQIRNLIPDISMIALESSKQIYWRHIFGDSYRIVTELYCTKNKQEARFGDEPMENVQVSDRFQPFKTREREKKSEEEKKRRSKSKKGKTWRGSKKQTDSRQSGKSYQNQGFQRSVGQGGSR

SEQ ID NO: 2315 - protein, 787 aa, synthetic construct
  source 1..787: note = Description of Artificial Sequence: Synthetic polypeptide
MSAQSLALIDHLDEYLPLKSCILAETLITHLLLESSIFNHPFSLSSSLKSLPERPFPTRILPHLQEPPLLNSDHFSVDFSLITTVSNHSSASLPTSPTFRNEHRLNYKKCDFKSLNADIANVDWDLVLSSISSPTDKFALFSKMLSDFIISHTPLSTPPKPHRTSFSIRQLKRARQRYSKLLKLPNPPADQIFRLRTLIASTSKRIKSNMVSEERKILSAPNSRSARLLIKKRTRTSLKIPPLYVNNELISSNAAKSSIFSSVFFSNYNCSPSSSLIPVSNNSSNNISPSELFLPWIIENTLRKVPPRCGFTTHHANFYIIRNCATTLAIPLSIIYSDSFLKSHVPASWKHAIIIPIPKKGSLTSPENYRPISLTDPFSRVCERILCNYIKINLFRNISRFQHGFLSKRSCSSSLVHSISEYRLLLSSHKSLDVVYFDFRKAFDQVDHQFLISKLDSFGIPSNIISWLTDFLSDRTFSVKIDDFVGTPSASIPSGVPQGSVSGPLLFLVFINDLLLKLADISSLCIAAFADDIKLYSHDPLALQMGIDLVESWASDNSLPLAHSKTALLRLGPRNSSHPYTIGGSLIDSVDSVRDLGLLIEPNLKFTRHINRAVALALLRSKQLLKSFKSNSPQFYIFLFKTYVLPLVEYCSVVYSPPPSSKLAHKLETPLRFFSRKILQRCNTPYCSYSDRLSQLDLFSMRHRRLKAQLLLLYNLIIGASYFPSLETHVRLSSSSRRPMSLICINPNCSNFFSTVIPIWNALTINVPHFLCPSEFNSLLVNNIARF

SEQ ID NO: 2316 - protein, 633 aa, synthetic construct
  source 1..633: note = Description of Artificial Sequence: Synthetic polypeptide
MIRETSYFTTNMNTHSKFEFFKLLETSLHFVPTVTDKIRTNLLKMFDKFLKSTIAQKFDNQKIINDINKTALFLKHNKELLVTKVDKGNPTVVLDRSEHINSVEEQLNNDKYYTELLKNLLNELIKSVTTFVKRWYDLGIFKDCEFDIRSSEISKNDLSKCYGLVKIHMAGNPIRIIVSAVNSPTYNLSKFFTKFLNDNIPKPNSCIKNSFHIKEKLNSFIIPQHHTIISLDVVSLFTNTSESIILKSIKNNWKYLRNKINLSSQEFCEGVSLILNSTVFQFNNKFYKQIFGSAMRSPVSPVLCDLALRCLEEDCLKKLSFFVPFYVRYVDDILICVRNNSIEETITVFNNHDRHLQLTVETPVDNEISFLDLRLIFESDGSIITNWYRKPTHSGRYLNYNSHHPLSQKIAIVYTLVDYSIKLSDSKFHKENLDISKKILFNNQYPLNFINKYIKKRLTILSINTPLNRVVSNNRGLMILPYFQGFDSIIKRYLYKNNINVIFKCIDKFSKFIRLGKDRTKHTDRCNAVYRIVCNDCDSCYIGQSSRRLKTRINEHMNDCKHRREKSALVDHIAKTNHSFNFDEVKILDTESNRFKRLFSEMLCIDSYRNNINRMHDTQNLKLCYKNVITEHT

SEQ ID NO: 2317 - protein, 923 aa, synthetic construct
  source 1..923: note = Description of Artificial Sequence: Synthetic polypeptide
MAVTCRNCSTVDYVLASANVFEILEDLDIHDFCNLFSDVHNPVSFSLSTCYLSRNISTGKNHSGVKLWCPDKADQFRSNIDVHAVKSIENYLNEISNSPGDLCSDNINKVVKDICTVFTDAARDTFGPSHFSPCIEKHNKPWFNRECKSARKQYHLAKSMHNKSKTDDNKNKLKEKSKIYKKAMDNAVKTYNTGITRKLMQLRSTNTKDFWNILNSSKRDSKSPVNIKDMFDFFKNINEGSLSPDSDTLHEPQVDGSSNELLNCEINESEITDAVKKLKNGKAPGYDNIVNEHIASTLNTFLPIYKLFFNAVFDSGLVPEEWLVGIIKPIYKNKGDPTSPENYRPITLLSCLGKLFTSILSKRLELYSEEIELIHNNQAGFRKGFSTLDHILTLQFLSNTLMKCKKKLFCAFIDFKQAFDTVWRNGLWCKLLNYGINGKCFKYITNMYKGIKSLIKMNGTVSDFFSCNVGVRQGENLSPFLFSLYINDLENYLVEKNIAGLQSFTTSIENELCVYIIMCIYIKLLVLLYADDTVILAESGDDLQNALNEFECYCKEWKLNVNIDKTKVLIFSKGRMCKRVFYFNDRVLEIVKEFKYLGIIFSRAGSFLKAKKHLCDQAQKAMYGVIRKIRQFNLPVTCQLELFDKMVVPVLLYGCEVWGFEKLDSIERVHLKFLKHILCLKSSTPNYMVYGETGRFPLSVIVFTRMVSYWCKLISSTNTSITNILYRYLLNQTENTTSTNPWIDCIRHVFNSCGLSNVWHSQFLNIVNQKWVSTAVKQRLQDQFIQKWHADINNSSKGVIYKIFKTNFGYEKYLDILPLKFRKILGKFRTSNHHLPVELGRWEGIPLNERFCPLCNTKRIADEFHYILECDAISQVRNKFIDKKFSARPNVLKFSYLMTTCNMKLLRKLCIFITKIYEVVCPP

SEQ ID NO: 2318 - protein, 1388 aa, synthetic construct
  source 1..1388: note = Description of Artificial Sequence: Synthetic polypeptide
MEDPRLFVTVVPSHSRNYAFCTSHPSRPGPVFGPRRGVFQNRSVGKYPYAENDLVSLPDARLTSSNVSTNESIRQDSAYRSQDAASQQSNDNADPGRPPTCYMEDLRLSVTVVPPHSRNYAFCTSHPSRPGPVFGPRRGVFQNRSVGKYPYAENDLVSLPDARLTSSNVSTNESIRQDSAYRSQDAASQQSNDNADPGRPPTCYMEDLRLSVTVVPPHSRKYAFCSSHPSRPGPVFGPRRGVFQNHLVGKYPYAENDLVSLPDAHLTSSNVSTNESLRPDSAYRSQDAASQQSTDNADPGRPPIRIMEDPDPPDTVVPPHCCDSSRSGHQSRPGPVFGSREGVFQTPNAGKYQAAFQVGYALDPDPRLLSSDVQTTPVHSDDPTTPVHHDSRRSSAGQPVIFEPIRFYYQNVRGLNTKVDDFFLSCCDCDHDVILLTETWLDGRVTSAQLFGNNFSVYHTYRNPANSKRKVGGGVLIAVRNSLDSVECVQAVAENLEQMFVTIRTPSKRIFVGCWYLPPEKRFETELMEKHLSCIENIRRIAGPHDVIVVAGDYNQGSLVWKHLSGNRSYVDPQLTRTRTEKERLTHGVMLDGMANCNMHQCNLVKNDRNRILDLIFVSDDDCTVVAAADEPLVPLDAPHPALVFDIDASRTVFVQVDNNDRVLNYKRTNFDELQRTLADIDWTPVTSAMDVDTAVREFSNLLNFHLAQHTPQFRTPPKPEWSNARLKRLKKERAAALKTFTLRRCRMTKLAFNAASSRYRRYNRYRYNVYIRKTQSQLRRNPKKFWTFVKSKYKERGLPATMALGDSTATTNDEKCELFARHFSSVFREPEIISSTHHLDAVPRDLVDINTFVISRDMIEKATKKLKSSFSPGPDGIPSAVLKRCANQLIEPLLVIFNLSLRQAIFPTAWKKSFMFPIFKKGSKRSIENYRGITSLCSGSKLLEIIVSDVFLFNCRSYVAPEQYGFMPKRSVNTNLLEFTSVCIDKIAEGRQVYAIYTDLKAAFDRIDHDIALQKFSKLGFSPMLCRWLESYLKGRIIQVKIGASVSLELTNGSGVAQGSNLGSIVFSGFFNDANFLFSGNCKLSYADDFKLFIPIDTLADCYVLQSRLDKFSEWCGHNRLELSSAKCYVISFNRKQSRELFTFDYHLGSHVLERLEVVKDLGVLLDLKLDFHLQLSSVIDKANRKLGFMFKAAQEFDDPLCLRTLYCALVRSHLETSAVVWAPYHQNWIDRIERVQRKFVWFALRRLPWNNPAQLPSYETRCNLLGIETLQNRRTISRAVFAAKVITSEIDSPNLLFQLNARVQPRNLRPTPGFLSRPLVRTVYAENSPIRALATAFNEFYHLFDFHEPVSRFLERLRTELRDRSRSSRTAENPQQRASRTRRSSR

SEQ ID NO: 2319 - protein, 385 aa, synthetic construct
  source 1..385: note = Description of Artificial Sequence: Synthetic polypeptide
MLDNRDDVLGLFLDLSKAFDTVDRKILIDKLRYAGVRGIALDLFTSYLSNRAQFVCIDGIHSLLTLVNVGVPQGSVLGPLFFIIYLNDFSLLPLKGDLRLFADDSSLFYNNKSTNMNDLNLRDDLTIVIEYFRLNKLTLNINKTNIINIKNSSRSIPNSLSLTTSKFPDLEVVSDTKYLGIILDNRLNWSAHINALILKLHKITGIIFKIKHKLPQKVLFLIYHSLFHSILSYVTAVWGNACGLLINKLQVAQNRILKIILNLPIRSHTVDLYVKNNILPVRGIYVFQVCSFIYLCLNNKTHSNTKFVRSNHQYGTRYHDLLNRPNVTTVPGERSINFNGAQLYNYFNNRFGKSSSLNIFKNQLKQCLSRPDIIEKLLKSVNIFA

SEQ ID NO: 2320 - protein, 847 aa, synthetic construct
  source 1..847: note = Description of Artificial Sequence: Synthetic polypeptide
MLAIEIHHQQFNGIFGGVYHSPSSSDRDFLDSFENWLQQVMADDKTNVISGDFNICWNNEGYSRDLKNIADAVGLEQKVLEHTRISVRSRTTIDLVFANVEDCTVKVLADWRITDHETLGINVEGVCKINMPEKKTEYTCWRKYSKERLQNTLLCDETLWRNNLPVDEKAQQFSRALATAVGQLTETRMRRSADTKRWFTPHLQAVKLKRDEAYKIFKTTNCAEHWERYKQFRNEYVRELQKAKNSSVQQEIQSCSGDSKKLWRCLKDLIKPGGTPEKEIIFDDKTEPCSDEETANRLNHYFIKSVKEIHDSIPTVNQPQQDPLPTVRTLDISEFSQFQPISMEKLRKIVAAMKNCAGVENISKRVLEDAMDVVGDKLLDIINSSLNLGVFPQEWKKSVVVPIPKVPNSTRAEDRRPINMLPIYEKVLETVVREQLVEYVDRAGLLIEEQSGFRKQHSCESALNLLMLKWKQSIENNKFILTVFVDLKRAFETIDRRKLLEVLRRNRIKGDVWRWFKSYLEYRTQITRYNNSVSEAEAVELGVPQGSVLGPLLFILYINDLTKALRRACVNLFADDTVIYVAGDKLDECYEIMNNELAVFADWLKWKKLKLNVSKTKYMVVTTRRSESNCTISVDGELVERVNAIKYLGVMLDEKLSFAEHVDYTIRKAARKLGVLCRINRYLSFDNKIMVYKTLIAPHFDYCASILFLATNQQRKRMQIVQSKAMRMILRCDRLTPRILMLDSLQWMSIRQRVEYSTLVFIFKVVNGLAPQYLTKTVQCGRDVHRHFTRQAGDIRLLNFKKSCTQNSLFYRGYNLFNMLPESTRATTNLREFKKLCKPFVRQRPLE

SEQ ID NO: 2321 - protein, 1028 aa, synthetic construct
  source 1..1028: note = Description of Artificial Sequence: Synthetic polypeptide
MVLRRDRGLVQATRTRRKTPVQEAHDASRTNRHGTGHHMRSHDWKLGTWNCRSLKFDGSIRILSDILRVRKFSIVALQEVGWIGAEEVQAYPRIGCTIYQSRGENKRLGTAFIVLGEMRDRVIGWTPLTDRMCVLRIKGRFFNISIINVHSPHSGSEDDDKDAFYEQLNWTYNSCPKHDVKIVIGDFNAQVGQEEEFRPVIGKFSAHVRTNENGLRLIDFATSKNMAVRSTCFQHNLRDKYTWRSPQGTESQIDHVVIDGRHFSDIIDVRTYRGANVDSDHYLVMVKMRQRLSLAKSVRYRRPPRLDLERLKLPEVASRYAHSLEAALPGEGELLEAPLEDCWRSVKAAITNAAESTIGFVERGRRNDWFDEECRAILEEKNAARRAMLQYNLRDYEEAYGQKRRQQHQLFRAKVRHQEELEFEDMEQLHRSNETRKFYKKLNGSRNGFTPRVEMCRDKNGAILTNEREVIDRWKQHFDEHLNSAEAEAGVQGGRREDFIGTAGEGEEPVPTMREVKDAIKKLKNNKAAGKDGIGAELIKMGPEKLASCLHRLIVRVWESEQLPEEWKEGVICPIYKKGDKLDCENYRAITILNAAYKVFSQILFSRLSPIAEGFVGSYQAGFVMGRSTTDQIFTVRQILQKCREYQVPTHHLFIDFKAAYDSVDREELWKIMDENGFPGKLIRLIKMTMDGARCCVKISGAESDSFTSLGGLRQGDGISCLCFNVVLEGVMRRAGFNMRGTIFSKSNQFICFADDMDIVGRTFKAVADAYTDLKREAEKVGLRVNVAKTKYLLAGGTESLRARIGPSVTIDGDEFEVVEEFVYLGSLVTSDNSCSREIRRRIIAGSRAYFGLHKSLRSRKFSLHTKCSIYKSLIRPVVLYGHETWTMLEEDLRALSVFERRVLRTIFGGVYENDGWRRRMNHELAQLYNEPSIRKVAKAGRLQWAGHVARMPERADHLSQRNQKINPAKLVFVSEPVGTRRRGVQRARWVDQVESDLESVGAPRNWRNAAMDRACWRRIVQQAKLMV

SEQ ID NO: 2322 - protein, 557 aa, synthetic construct
  source 1..557: note = Description of Artificial Sequence: Synthetic polypeptide
MKNDPAGDVDADELNAFFSSGHRQLQAVDRSDNSSEPCHRTTADHGDNGFAFRHTDVNEISRKILEVQTNATGTDDIPISFVKLLCPFVLPMLAHLFNHIIDTSSFPAAWKKAIVTPIPKSSSPIQPKDFRPISVLPAVSKVLEKVLLGQISEHLNAAEPPLLAQNQSGYRKGYSTTTALTKVVHDVYSNLDENRCTVMVLVDFSLAFNCVNHQILRKKLNTEFKFTRSACDLITSFLSGRSQIVRFGNSMSAALDVPDGTPQGSCLSALLFSLYINSLPRNLKCEWQLYADDLQVYLSGPIAEVDRIMRDVNEDLAAIADWARVNQLFPNPKKTQAIVFNKTGTVTPQENIVFCDSIIPLSSQVINLGLHMDCNLTWKAQVNDVVRKVYHTLRTFRRFGSVLSLQTRRKLVQAVIVPFFTYCDTVYFPGLSAALREQLHRGFKSALRFVHNLRRRDTTVALRNSIMGHDLPDNYQLRVCCFMKKAFEGTLPDYIMQHLQRGRQERTAGFIIPRHTTSSGKSVLVHGASCWNSLPMAIKREARFNPFKRAVITHMQN

SEQ ID NO: 2323 - protein, 980 aa, synthetic construct
  source 1..980: note = Description of Artificial Sequence: Synthetic polypeptide
MMAPYLWQPVAAALDVFNFVYLLYFLNIFLQWLRTLYLHTFQFESIRKHWIIFIFILAFLIGKSDAVNSPAIADAVIYSREQLLALRHTSTFSVPTMEVPTELKRRRRGCRAGVKRRLKKKRYKPSLPVIIMGNVRSLGNKTEELTALVRTQREYRECSFMCFTETWLNDKTPDSVVALDRFHLVRADRCAKQTGKNKGGGLALFVNERWCRPAHITTKEVVCNKDIELLAVGMRPYYLPREFSYVIAITVYIPPSANASNACEHINTVTASIQLKYPHSLIVISGDFNHVSLQSSLHTFTQYVDCGTRDCKTLDMLYANVKDAYASTPLPPLGRSDHNLIYIRSVYVPAVRKQPPTIRTVQVWSDSVYEALMDCFDSTDWEVLCKSHDEDIDSLTDCITDYITFVLRTQYPQKRLNATQTISHGLYNFCVENTVPTKKVKCYSNNKPWVTPELKALLNEKKRAFLAGDREEIKRVQKELKIKIKEGKVIINLKWNINYNKIMLEMYGVIVCTKLEVTIEQVRNGLRRIKKKKSAGPDGISAGVLKACADQICWVVHYIFNLSLRLERVPILWKTSCVVPVPKKPNPTEFSHYRPIALTAQLMKVFERLVLNYIKKLLIASEDRLQFAYKTGVGVDDAIIYLLHKSLSHLETSGNTVRITFFDFSSAFNTIQPALLKVKLENAGLQKGMVSWLTDYITNRPQYVRMHNCVSQVIMSSTGVPQGTVLAPYLFTFYTSDFQYSSKNCHLQKFSDDSAIVGYIRNHDESEYRLLLKSFADWCDMNCLNLNTSKTKEIIVDFSRHPSQAVPVIIQESEIEIVSSYRYLGVYLNNKLDWSENTIQVYKKGQSRIHLLRRLRSFGVCQTLLKTFYDSVVSSVILYAVTCWGGGLLEKEKNKLNKLIKRAGSVVGGALPTIEEIAQDRMLDKFVSIMNHDSHPLYDTVQACASSFSTRLIQPRCYRERYRKSFLPTVIRLYNQSHTR

SEQ ID NO: 2324 - protein, 602 aa, synthetic construct
  source 1..602: note = Description of Artificial Sequence: Synthetic polypeptide
MLTQPVSFSRVFHENSALEFSNSYTNFLSNANASLPSCSDTEQLAETFNSACDFALNEVAPLKSKRSRVSSIPQPWLNSSTRTLRQECRRAERRWKKDGLQVSYQILKDCLNSYQDSVSEAKSKYFSNLIAKSASKPKVLFKTINSVLNPTMCSVPVVNLETCIKFSDFFAQKIQDIKSHLFPTDIDHSDSVPPSNSFTNFQPVSSSQLLNTISQMKLTFCPSDVLPCRLFKEVLDTICPSLLALINSSLINGVFPDVFKHAVVQPLLKRPNLDPAVPDHYRPISKLSFISKVLEKIVLSQLTSYLDIFYILDPFQSGFRAKHSTESALLKVTNDILLSMDSGSSAILILLDLSAAFDTVDHNILLRRLECVVGVQGLALQWFSSYLKGRSFSVNIGSFTSPPKPIHCGVPQGSILGPLLFSLYMLPLSSILLKHKISYHCYADDLQLYFPIKLGKDLSLENLFLCLTDIKTWMTNNSLQLNENKTEVLILGPAATNNSIKTQLGALNDNLHNHAKNLGVIFDPLLQFDKHVNAVVKSSFFQLRLVAKVKRFLSKKRFRNRNPCFNLLSSRLLQFFVYWPTSVNTLSATVGPKCSRQINNRN

SEQ ID NO: 2325 - protein, 702 aa, synthetic construct
  source 1..702: note = Description of Artificial Sequence: Synthetic polypeptide
MLDLCYGSIKGAMKAVAGPPVGFSDHNVVHLLPVYKSVLRREKVRKREIKVWSEDNSLALQGCFDCTDWSVFKETSESIDELTEVVCDYISFCTDMIIPHKTVIDFPNNKPWLSNDTKSLLQSKHKYFKQGDMSSVKQLKKAVRVQINKDKIRYKDKIENQLSSNNLRSAWQGVKAMAGCKEDRGGSEINLNGFSSAREFAEELNTFYLRFDEDDFKSENDNLKQHLSCSNSVNISRIQVKGLLQRTNTKKSPGPDNIGGRVLHTCAEQLSEIFHYIFSQSLMLQRVPEIWKKSVIVPIAKTKFPRELNDFRPVALTSLVMKCFERFIKGEILLQSKDKFDPLQFAFRQSRGVEDANLTILNYLFNHLENPKTHARLLFIDFSSAFNTMKPHLLVEKLISLFNLDLNICGWILDFLVGRQQCVRVNGALSDFQFCSTGSPQGCCLSPLLFIMYTNDCRSIHRDCHIIKYADDSVIVSLLHDQDLGHGPAVQEFTSWCDRFSLQLNASKTKDMVIDYRKASPTPNITNIKGLDIEIVDTHKYLGVVIDNMLTFQPNTQAVYKKVQQRLFFLRKLRSFQVSTSMMTLFYKQFIESVLSFCIVAWYGNLSVSSKNRLSSLVKVAGKIIGFNQTGLMVIYQNHVIRRAQGILCTPDHPLYSVFQLLPSGRRFRVPICRTNRTRNSFIMVAIRSLNESRGEGDVSIY

SEQ ID NO: 2326 - protein, 899 aa, synthetic construct
  source 1..899: note = Description of Artificial Sequence: Synthetic polypeptide
MTWLHECISDSVVDVAGFSSVRADRTRRESGKSKGGGLAVFVNERWCHPNHIVIKERICSPDIELLAVGLRPYYLPREFSHVIAIVVYIPPSANATTACDVIHSATARLQTMHQDAFVLISGDFNHVSLNRTLSTFSQYVECPTRENKTLDLLYANVEEAYSCIAIPPLGRSDHNLVYLQSTYLPLVKGSQLLLGQGSGQKRPVQPCKTAWRLRTGMLCACHMVWTLITSQTVSLSISTSVWIVLYHEIHTLLSYCTMKSIRCFPNNKPWVTKDIKALLNEKKVAFRSGDKEAAKEVQRRLSVRLKEGKERYKKKLEQELKQNNSRYVWRGMKNITGFKTSSPRTDGDVDRANQFNMFFNRFDSRPLSSSDTALTAPSASAPPNSVTSNCSILPYFTPSPSSSFTIVPTEASIASPPFIGVSDSYKPPMIITEDQVRRELCRLHPAKAPGPDGLTTQVLKLCASQLSGVLLRIFNLSLSIKKVPVMWKTSCLVPVPKKARPSVPSDYRPVALTSHSMKVFERLVLGTLRPLVRSAQDSLQFAYQAKIGVEDAIIYLLHRAYSHLDKPSASLRITFFDFTSAFNTIQPARLGSKLSAMQVHAPLVAWIMDYLTDRPQYVRLQGNKSDTVLCSTGAPQGTVLSPFLFTLYTSDFQYNTEGCHLQKFSDDSAIVGCIKGGDDLEYRMAVDSFVDWCELNQLQLNIQKTKELVVDLRRSRRSPVTPLSIRGVDVEIVQDYKYLGVYIDNKLDWSKNSLVTYKKGQSRLYFLRKLRSFRVCNTMLRMFYESVVASAIFYAVVCWGGSVKVADMKRFNKLIRKAGSVVGEELDNMETVAEKRTLCRLRSIMHNVDHPLHNVVDELRSTFSHRLTSLKCSTERHRKSFLPTAIRLHNVSLSHLPLQ

SEQ ID NO: 2327 - protein, 500 aa, synthetic construct
  source 1..500: note = Description of Artificial Sequence: Synthetic polypeptide
MYYMQEKEKGGVLIGLDLEKAFDRVEHDFLFAVLKEFGFGENFRKWIQIFLYRYFNLYLVLNVFFFLTECLQPTRSIRQGCPLTALLYTLEAEPLGLAIKSDRSIKGIQIENNDNREAVYQYADDTTSLGILERYCKASGAKVNVGKSLCMRVGRVKEITQHIPFKEEKEHTKMLGIWVGMDSNKADILNWERVLNGIEKRLRFWKARNLTLKGKYSSKFDVKRKVFILNALMLSKVWYVLSVTALPEVYYEKINDVVLKFLWGNGRAKIAYYTLIGEVKEGGLGLLDSFLKMKTLTIKIIQRFLEGKMGVIWKSVLDYYLKKCGHFNMGCNVLLMKMKKRMIAGLPKFYVEVLESGLRIMRGIFRKCVDYTKSKGADSRTTTFTELNNFKTILSEGNVLYFKEWWDGGLRQVKDVLYEVIKGFVPLKVIVEDGYKRVVKAKLQRQCHELKKAIPKDCIVIIEKKKSWAMKMNYQRPILRRKMERSMSLCTVKSFYAIFR

SEQ ID NO: 2328 - protein, 1130 aa, synthetic construct
  source 1..1130: note = Description of Artificial Sequence: Synthetic polypeptide
MAPVCLSACRLPRQFLNVCSATILSVLFLLLFMSCVDALISYDRQALLNIRGLLENQPRDCSITHDYCYSSFPFPTAAFVRRLPCCLIYQRKRRRRRGNRGGVRVRMRKEISISLALHTACSFVPTYGHRGLHPARRSWDVRYTCHLPIFPDKRQLAEFGAPPRVRIRRRGVNLQHIKSLDYVHQSDLQVISHINMALLNARSVSNKTFILNDFFTSHNLDFLFLTETWIGAGESSVFGELCPLNCSFISTPRCIGKGGGVAMVFRNWFRCRTISVGDFTTFESQCALIESDTTPFLCVLVYRPPKPDRGFIKEFSEFVSHIITSYDRLLILGDFNIHVCCPGKPLVTEFMHVLDSFGFTQHIVGATHALGHTLDLIMSYGFSIENIVIEDASFSDHKPIVFNTTLSYFSGTTKSEGFHSRCINSLTANQFSTMFNSNKVSTAILAAAEHSSSPDDLISLFNSSCSDILDCVAPLKYKYPKMKSQPWLDDLSRSLRQICRKAERRWRKDHLVVSLEIFRDAQVNFQKAAKKARATYFSDIINKHSHTPKILFDTINAIISPRTSCKIEQSSEICERFKRFFTEKVADIRSSFAPLCPSSCVDSTVSSATFCNFEPVSLSELRGLVFQTKTSTSPCDPISSNLLKETFNTIGSSIQAIINSCLVSGTVPAFLKHAVVQPLLKKPNADINCLNNFRPISKLPFMSKVLERAVLSQLQPFLKSSHKLEPLQSGFTMHHSTETALLKVWNDLLLSVDSGSNAVLVLLDLSSAFDTVDHTILLSRLEHWVGIKGSALQWFQSYLKSRSFSVSVGQFMSTSAPLLCGVPQGSILGPMLFNLYMLPLGNIIRKHNISFHFYADDSQLYVPLKSQNSLQSLINCLEDIKCWMAKNFLQLNNDKTEVILFGPSKTRMSYIGGLGSLAPYVKSQVKNLGVIFDSELCLEKQISSVVKNSYYQLRIISRLKSILSFQDLEKVIHAFITSRLDYCNSLYVGLPQSSLARLQLVQNAAARLLTGTKKHAHISPVLASLHWLPVNFRIQFKILLIVFKALNGQAPSYISELINLQSTPRSLRSSNKILLQVPRSRLKLKGDRAFAVAAPRLWNQLPPDITSASSLSIFKSRLKTHFYSIAFPGF

SEQ ID NO: 2329 - protein, 1049 aa, synthetic construct
  source 1..1049: note = Description of Artificial Sequence: Synthetic polypeptide
MLTGLSEDLRGIDDSRKTAVINNELLRLNVDIAALQETRLADSGTLKEKDYTFYWQGRAPDEPRQHGVAFAVKNNLLSMVEPGRNGTERLLTLRLNTTTGPLTLVSVYAPTLNATLETKDKFYGNLTSVINNIPDKEQLVLLGDFNARVGANHESWPSCLGKFGIGKMNENGQRLLELCAFHNLCIANSYFQTKPQHKVSWRHPRSKHWHQLDLILVRRSAINCVLHVRSYHSADCDTDHSLVCCKIRLNPKRFHRLRKQGNPRINVSRMSQPDLTQKFAETLVKELDTAQTGDSALEMWESLRNTMQRTALATFGKRTTKTHDWFEAKASTMIPCIEAKRAALTEYKRSPTQKNLQILRSTRSKAQHIARYCANEYWQELSNDIQKAAIAGNIRGMYDGIKKALGPTQCKTAPLKSSTGEIISDKQQQMERWVEHYSDLYSRQNTVSSAALDVIKCLPTMEELDEEPTAEELRKAIDKLASGKAPGSDGIPPDLLKQCKDSLLHPLHKALCQCWKEGAVPQDMRDAKIITLYKNKGERSDCNNYRGISLLSIVGKVFAKVILARLQKLAERVYPESQCGFRAERSTVDMIFSLRQLQEKCREQQMPLYISFIDLTKAFDLVSRDGLFKILPKIGCPPKLQSLIESFHTDMKGTIQFNGSCSEPFSISSGVKQGCVLAPTLFGIFFALLLRHAFGSATEGIYLRTRSDGKLFNLSRLKAKTKVRETLIRDMLFADDAAVTTHTQEELQSLMTRFSMACKDFGLTISLKKTNVLSQDTATPPTITVDDYQLDVVHQFTYLGSTITDNLSLDAELDRRIGKAASTLARLTTRVWTNHRLTTATKMAVYNACVISTLLYGSETWTTYARQERRLNTFHLRGLRRILGITWQDKVSNVKVLTRAGLPSMYTMLRQRRLRWLGHVCRMEDGRIPKDILYGELSSGKRTTGRPFLRFKDVVKRDMKALDINTKSWEDLAADRLKWRCTLTKQLKSGEKNMMRASEDKRVHRKVQSVSQGATYQCDCCGKKCLSRIGLFSHQRRCLRQSVMPQYKS

SEQ ID NO: 2330 - protein, 959 aa, synthetic construct
  source 1..959: note = Description of Artificial Sequence: Synthetic polypeptide
MSWRPSWQTCMLAPHINVVFLLFFVCFLSFPRCIHAMHYQHIADKLAGSCNLRQTFRIYQFYSTGLTTHCPLPQPLQRRRRKRHKRGKRGGLHARLKSRANRPPLPSILLANVRSLDNKLDELRARITSQREVRECCALIFTETWLSEKVPGTAVQLQTHSLHRGDRTTASGKAKGGGVCVFINNSWCGDVQTVHKHCSPDVEFLLLKCRPYYLPREFTAVFIAAVYIPPRANATAALGKLFNVFNAQEMAHPDAVIIAAGDFNQCNLRTVLPKYHQHVSIPTRENNTLDNVYSNIRGAYRAAPRPHFGQSDHISLFLYPAYRQRLKQTNPITKLVKIWNPQTESTLQDCFALTDWDVFKTAATKEDLSVNVQDYAEYVTGYISTCVENIIPTIQVKKFPNQKPWINSKVRHMLNARSLAFTSGNENEYKSAKYGLRSAIKEAKRQYKEKLDNTYSTASAGQMWRGLQHITDYKSTTNVTISASESLPDDLNTFYARFESSSINTEQRHTQTQTSQPALPPPVVTPAAVHKALRKINPRKAAGPDNIPGQALKACASELVDVFTSIFNLSLSQSSVPTCFKTTTIVPLPKKSPLTCLNDYRPIALTPIIAKCFERVVLPLIQSSIPDTLDPLQYAYRTNRSTSDAIAAALHTSLSHLEDKDTYIRMLFIDYSSAFNTVIPHNLTHKLSELGLHPTLCDWLLDFLTGRLQSVRIGNKSSSTILTNIDTPQRCVLSPILYTLFTHDCVASHKNNTIIKFADDTAVIGCITGGDEAAYRKEGASLVTWCDNNNLTLNTDKTKEMIVDMRKERKTHQPLFIRKLEVERVSSFKYLGVHISEDLTWTLNTTQLVKKAQQRLYFLRKLRKLGLSSKILSNFYSCVVESILTNCITVWYGNATVKDRKRLPRVVRTAEKIIRSPLPSLQTIYHHRVHKRTASILKDPTHPQHGYSHSYPQGGGIGV

SEQ ID NO: 2331 - protein, 932 aa, synthetic construct
  source 1..932: note = Description of Artificial Sequence: Synthetic polypeptide
MRWIGQGCLRKKNCDIYYSCHPERHEFGCGFVVGARLRRRVSHFLPINERLATIRITAKFFNISLICAHAPTEEKDDVTKDAFYAELDRAYGRCPSHDIKILLGDFNAKVGREDIFGATVGQFSLHETTSSNGLRLIGFAAAHNMVVRSTGFRHLDIHKASWLSPDRLTRNQIDHVVIDARHASNVLDVRSCRGPNIDSDHYLVAAKIRTRLCVAKVARRGLLRKLDIGKLQSQRTRDAFSTQVTGLLSRATPTPEDISNMWALISHSLRTSAEEVIGFQRTPKRNPWYDQECRDATAAKDAAYGRTLQAGATRAVVEVYRSRRRDEKRLFRRKKREQERRECESIESSRDRNEARNFYQRVKRLTQGFKTGGVACKDDDGNLITDAEIVLRLWRDHFSSLLAGSGHDDYGEYDPQTPIYGTDVDVPTPSHAEVKDAIQRLKNNKTAGADGLPAELFKAAGDMLVGSMHKLISKIWLTESMPDDWNHSMICPILKKGDATLRTNYRGISLLPVAYKVLTSVLCENLKPHAEALIGPYQCGFRPGKSTIDQIFTLRQILEKSYENQIDTYHLFVDYKAAFDSPRRDRLYAAMSELGIPAKLIRLCMMTLSNTISSVRVGNDQSETFYTKCGLRQGDSLSCMLFNILMESIIRKAGVHRTGTILTNRCVQLLGYADDIDIIGRTKRDVTAAFGAIEKESAKVGLAVNMDKTKFMVCSSRESRRLDSQLSAGSHSFESVKEFIYLGSAISSTNDVSLEIKRRITLANRCYFGLSRHFNSRALSRPTKITLYRTLILPVLLYGAECWTVVQSDAAALGVFERKILRKIFGPICVGDAYRTRWNHELYELYGDVDIVSRVKIQRLRWLGHIARMEEDAPARKVFDAVIVGKRRRGRPRIRWQDQVMEALSTSGVTNWRARAQDRKAWRQIVQQAVTR

SEQ ID NO: 2332 - protein, 883 aa, synthetic construct
  source 1..883: note = Description of Artificial Sequence: Synthetic polypeptide
MQDIDDAIEIFNRNIYHAAKIATRHIKTSNRNPTGQFLLDRKLLNLQAIKKYTKQIKMARQTPEAAKNYKAANERFLRAIKEAKTKRTNNILNKIDPLDRYRMQKLWKITNHFKRQPEPNWPLKLYTGDGTSAKDWYSWTKSSEEKTEAFTRHLEERFSPKLTNSESFRAHVISKKEEICTQKLLMTTPCWMHRENYGHNSDKTNLPFLPITPNEVLAEVKLLQNKKAPGPDQIDNKLIKLLPHKATLHLTHIYNCMLRYSYFPKQWKRAAITMIKKPGKTPHEVSSYRPISLLPGFSKIFETLLMHRMFKIQDFERAIPSHQFGFRKQHSTEQQLLRVTQHILSAYEQKMYCSAVFIDVSEAFDRVWHDGLLLKLAKLLPHSLYKILQSYLTDRSFTMNSTNGIPSRTGKISAGVPQGSVLGPILYTVFTSDMPLPEVISSQHTYNPSYFENMMLSTYADDTIILCTKREPQLAIQTTESFLKYITDWATSWCITLNPNKTIHVLFTKRSVANLTGNKSPKMKGILIKNEPKHRYLGLILDRKLLLHHHINQLQNRIRNVAAGLNWIIGTKSKLSPQSKILLYKQIIAPIWQYALPLWGALTSNTQFQRIEAAQSKLIRKILKAGRYTRNQVLRDAYNIKSINEIYSEASNRLATSLASHPNTEARKILMDPVTPNRLEMPRYLDQLNRFFLPLRQQLQQQNQLNTHQPALPTLISYEQQLLSQQASIKARQQDEEREQNKRLKIEQDPHYRPSIGWVNAMSYKLRHGITTRWEMADKIKYEPEYIQRLIMSPLLPSEIPPPTPDQELDARLSTLKTQIINDLDLNLNYETNLAEGDSRTRFLPNSSSPILQAPQIPCINLVEDHPLGNPAIADIWKSTPEI

SEQ ID NO: 2333 - protein, 1071 aa, synthetic construct
  source 1..1071: note = Description of Artificial Sequence: Synthetic polypeptide
MSSFGLIVTNLNSETVLWGCQPLGQFSLIGTNMQNTTPRIINTNSLTNQIPTVSSLGAQSEHSAQVNPNSGYQCTICESSFRSKSGLGVHMSRRHKDEFDQLRLRTDRKAQWSEEELSMMARKEIELAANGERYLNKKLAEVFTNRSVDAIKKCRQRERYKTKIEQLKGQAVPLPEALESETIQRRPSIRERDLLVTPPNTLGTTPTELSNSEILAVLQGYPPVVCNDQWRVEVLQSIVDGAQASGKEITLQRLSTYLMEVFPSQNDRPIQTRPPRRPRNRRQGRRQQYALTQRNWDKHKGRCIKAILDGTEGTATMPSQGIMGSYWRQVMTQTSPTYSGTNTTFRTEHPLEGVWSPITLGDLRVHRVSLTKSPGPDGITPRTVRSIPSGVMLRIMNLILWCGKLPVSIRQARTIFIPKVGNASRPQDFRPITVQSVMVRILNAILASRLTSSVDWDPRQRGFLPTDGCADNTTIVDLILRDHHKRCKSLYIATLDISKAFDSVSHAAVSATLTAYGAPKEFVDYVQNSYEVCGTTLNGDGWRSEEFIPARGVRQGDPLSPIIFNLIIDQLLRSYPNEIGATIGDHTTNAAAFADDIVLFAETRLGLQTMLDTTVDFLSSVGLTLNSDKCFTVGIKGQPKQKCTVVIPETFRIGSRSCPALKRTDEWKYLGITFTAQGRTRYSPADDLGPKLLRLTRSPLKPQQKLFALRTVLIPQLYHKLTLGSVMIGVLRKCDILVRSTVRKWLGLPLDVSTAFFHAPHTYGGLGIPSVRWVAPMLRMKRLSNIKWAHLAQSEAASSFLTDELNKARGRTLAGLNELTSRTEIETYWANRLYMSVDGRGLREAGLFRPQHGWVCQPTRLLTGQDYRNSIKLRINALPSRSRTTRGRNELERQCRAGCDAPETTNHILQNCYRTHGRRVARHNCVVNNLKRILEEKGHTVHVEPSLQLETSVSKPDLVCIRDNHACVIDAQIITDGLFLDDVHHRKVEKYKRPEVISALRREFGVSGNVEVLSATLNWRGIWSNQSVRRLIAKGLISSGDSNVISARVVTGGLYCFRQFMYLAGYTRDWT

SEQ ID NO: 2334 - protein, 705 aa, synthetic construct
  source 1..705: note = Description of Artificial Sequence: Synthetic polypeptide
MNILNKEISLSKNKHLNKKLCKIDSSDRYRPHKLWQLTNKLKRQPLPNWPLRIPSGVDKKHAWTRSPEGKMELFTDQLEKRFSPNLTNSSLDRAKINEETNAILAQKMLMEYACKTHHSIASSSANFDSSNSPFVKPITLSELKKEIDSLINKKAPGYDRINNALIKVLPLKAIIFLLKIYNSILRFGHFPLVWKKAIVVMVKKPKKTISDASSYRPISLLPAFSKILESLIAKRLLKFNRLSQSIPNHQFGFRKFHGAEHQLARVTQFLQRAFEDKLYGSPIFIDITEAFGKVWHCGLRNKLIKLLPINLYKVLDSYLKDRTFSVRGNHGIMSRDGKILAGIPQGSVLGPLLYNIYSSDMPIPKFIIEHETLIEYYPTYKHGDTLLSTYADDTIFISTDKNALVAMNKTENYLHKFSTWSNKWCFTVNVSKTVHVLFSRRSTSPAVKAATVKFNNKPIKNTSSCRYLGVLVDSKLLFKTHIAKLCAQAKSTYTRYKWLGGAKSHLSTRCKVTIYKQILVPIWTYAIPIWGSLISNTLFKKLTGTHNKLLRKLTNANIYCPNSEIQEKHNAKPLETIYNDACLRFFNSMSDHETKEIEKLYLKPFIPKRLPWPRYSKQIDKLVASRTIKKAQTPPLMPPLNPSVTVTNIKLRIESKLMEFFSKAPALIADNCHQTYNRITEKQDVLRAKEASIARKNRQKIQSGH

SEQ ID NO: 2335 - protein, 1321 aa, synthetic construct
  source 1..1321: note = Description of Artificial Sequence: Synthetic polypeptide
MPLFKSLDIWKYVNLTLLPPLPPSSSSPPLPPSSSPLPPSSSPLPPSSSPLPPSSSPLPPSSSPLPPSSSPLPPSSSPLPPSSSPLPPSSSPLPPSSSPLPPSSSPLPPSSSPLPPSSSPLPPPSSSSSRPHPGPRKKRNKQKKRTGPRKCPPPTSSRPLPHTTEGLNPVSDDLFCPVSGCPGPSSSATDEWIECSACLLWYHTSCLLLQAIPEDDWFCANCPQIHTQIGPQVNSNTPSPANQSTLGTHSQIIQSSPCTNPRASQPISTLSTPLSNFISSKATCTSLTLEWLNNNIVPGGIIEKNLLHEAYRQDSLGIFKPLNDAEIGKLIKNSFSNIRTKRLRTEFHGASKYHYVGIQLKSEQVPETVFDFKSIISSLRQNCPTLKQCPKACRIPVAQSIKSAIDKCITENTPEAWHLLLTFPYVTLQCDSRANIKNGQSLNNKIRNNLSIFESLDKNTYQDYLISLSSKNSVFDKSGSKINDIGPKVISKVSEGNIRGAIRLLTSDDVVAPNSSATLDTLVEKHPQQSLDNFTVLDEPNIPPFTTTTEQVISAIFSFPSGSAGGLDALRPQILKDLVSQHTGDVGTQLLESLTKFCNFMLAGKVPLDICPFIYGASLTALKKKSGGIRPIAVGCTYRRIVSKICVKVMNHVFQDYFSPVQVGFNVKNGAEAGAHAARRFFSFPHQSPTAFLKIDFKNAFNMVDRGKLLSSVHELVPTLYPYINQCYRFSSSLVWNSSLIDSCRGVQQGDPLGPPLFCLTLHPVISNLGSEFNMWYLDDGTLGGNPTTVLDDFQHIISCANEVGLELNFDKCEVSVLGPQTNTQCILESFQSVAPGISCMTQENAELLGAPLTLESIEHVFRKKIHAFTNMAGRLHSIPSHIAYYLLKHSLAIPRLVYLLRAAPIFKSPHLLEEFDSLLHNALEQITNCQINPLSLEEIALPIKLGGLGIRQSKTLATPCFLASSFATTDLVSLILPSYVTALSDSLVTEAQDLWKSISCEELPRSTITSFQSSWESPIFNYVSSRILESSTTPINTARILASRSKESGAWLQALPSRNLGTLLDDNSFRIAIGLRLGLNLCFPHKCVCGAQVDELGLHGLSCKKSAGRHSRHTQANDIIKRALISADIPSIREPLGCCRTDGKRPDGLTLIPYKQGRSLIWDFTCTDTFAPSYLSHTLRHAGTAAKLAETKKHKLYSELKTNYIFVPVAIETSGVWGTEGLKFIQDVGRRMKDVTGPMSTTFLIQRISLAVQRGNAASIMGAVPSQRGLEELFYILNDRSFYLQKSCKGPNGDLGRLSGSSKGFPNPPTSGFSSTPQAN

SEQ ID NO: 2336 - protein, 1004 aa, synthetic construct
  source 1..1004: note = Description of Artificial Sequence: Synthetic polypeptide
MIILSYNSRGLGRGVKWAAVRRLIVKHKVDLVCLQETKRENFNKSICQAIWGDSTGHWDFVPSVQAAGGLLCMWNNSTFVVERKEKGRSFLMLEGTCCSNNQKLIFVNVYAPCDLVGKKALWDELRQLKASNPSGMWCFLGDFNSIRSSQERISLSQRRADPYDIAAFNQWIDDMELQEIKCYGNSFTWIRPNGCVKSRLDRFLVSQNWLSLWPESCQTVLQRNLSDHCPSILQTNMVDWGPKPFRVFDWWLQQKGYQKMVREAWKKDQQGGWGGIALKNKLKNLKSVIKCWSKAEGNINPKKVLNIQQKLNEVEDLAAHRNLTDQEIKDRTLLQQELWNASNAFESLLRQKSRARWLKEGDYNTAYFHKYMNFRRAYNNIPGIFIYGEWIQQPDAVKNEAANFFHNRFTEQMHSRPTLDGVHFKSISQRQREQLTVPFSDQEIKQAVWSCGGDKCPGPDGLNFNFIKEFWDVLNPEFRRFVDEFYAHESFPRGSNASFVALIPKKSHPQSLNDYRPISLIGCMYKVIAKLLSNRLRSVMDELIDERQSAFIKERHILHGILILNEVVEEAMRSKKPAMIFKVDFEKAYDSVSWSFLDYMLLRLGFCQKWRRWISACLHSATISVLINGSPSKEFNPSRGLRQGDPLAPLLFNIIGEGLTGMMREAVHKNLYRSYLVGKKREPVNILQYADDTVFVGEVDWQNVHAIKALLRGFELASGLKINFAKSQFGIIGGGVNWGLAAANILNCSQMNYPFHYLGIPIGANPSSLMVWEPLITKFKAKLSKWAQKDISMGGKVTLINSVLNALPIYLLSFFRIPQRIVQKLISLQRKFLWGGDNTHNKIPWVKWADICLPKNEGGLGIKDISKFNVALMGRWIWAFASGQQQLWVRVLISKYGGWPEFQHDTDKRGFSHWWRDLRKIFHQSDHNIFKHQLTWKVGCGETIKFWTDKWLGEDYTLEQKYNQLFLISRQQNSLISNMGEFNHDSWEWNLRWRRNLFDHESDL

SEQ ID NO: 2337 - protein, 1252 aa, synthetic construct
  source 1..1252: note = Description of Artificial Sequence: Synthetic polypeptide
MDRSLKILQHNLNGLRARLTELIKFLSTARYDVLCFQETKLYPGVKDTILPGYRLSRLDRPGAHSKCFGGGLAIYVRTELSYQTLVLHSTEFEVNGVSLSLADGSKIAIVNVYLPPGKNVIEPSSYRNLCEQISHRNVLFCGDFNSKHNAWGSYKQDERGEGLLQFIEDNDMCILNDGRPTLIHNSSGVMSHLDLTIATSNIASNCEWQVSSTETLGSDHLLIDITYRGQIKREGTVGKPKWRIAKADWIKFTENCSQWDVKDIQDADVDVYANNVTMVLMEAAKDAIPRTSGKNRACPKPWWSDACQNAVKLRKKALRRVQRNLNTETKRTYLEATENARKVISEARTSHWHDFCQTLNQHTQIRDVWAKIKSMNGTKSTREIPVVTYGDRVGESDRQKADLMAESFADASSDKHHSPEFMNRKTNFAVDHSNVLTHIDENDPLNLPFTSDELQKALSSKKDSAAGEDEVKYSMLKKLPPEASKILLDFFNESWTNGHVPTKWKTASIIPILKAGKDPNKTESYRPVSLTSTLCKILETMVTHRLRYYLESNNLLDKNQSGFRKLRSTADHIVRLQHAMSKTLNSSGFLCAVFVDLTKAFDLVWTDGLMHKLRQLGIGGRMHNWIASFLADRKIRVTIGKSLSEEFSLENGTPQGSVISPTLFSVMVNDIRNPKYLSNKCQIAMFADDSTFWGNGTLYTNLQMRIQTCLDRFAKWANDWGFRISKAKTVGMLVCKDPQLTDMRLVLDGERIQFVSETKLLGVTFDRKLSWEPHIKNITNRCQIVLNLMRNISGNEWGANVVTLMMIYRALIRPILDYGSQAFMTARPMLLHKLDVIQHKALRLATGAGIGIKTESLLQDVGEVPLQIRREELALRYWSKLKHLGESSPTYLETARFRHAKKTISFGQSVRDSVRKYGLDRLPIKPLVFSQVAPWTVSPPIVDTSLASRLDKKRDDPCIARMIALTHMDARWSESIRIYTDGSHNPDDGTTGLGIYVPSSSTRISKRLPNNCSVYTSEMLAILYAVKYSAGHYHSNYVVLSDSLSSLTSILNDSSNSQAELVDEIRQACSLVHSQGKSIELAWIPSHVGIQGNEIADELARIGLGLSEIDRIDYSLSEIRSMITKSIKSTWEATLIDANAFRFRLNDSISSKVFLHHPNRQICRTVARLRMMGEVRNHKYELKLCPCGEAGTAEHLLIHCEQLRELRKSLVEIMKRYRLEYTLKNILSHTGEGMSTICETVYNFLSESRMIT

SEQ ID NO: 2338 - protein, 1164 aa, synthetic construct
  source 1..1164: note = Description of Artificial Sequence: Synthetic polypeptide
MTYPREGCTGPRDGLSKQEELTAGYSGFSNAWTLTRIIMSHRAWTVELFLLNCTIGPIDPSTSLCTTFLSKATTSRCHYWSVPLLVLMLMKSLDAVFPGPQETALFLVRFGSSDDASRVLKNRKLLPSSVEATADHTAYQRDLYRKLKLKASLHNTSHPDSLKKVVYVKGTPTLVDLRRTSTAPLSEKPSKNLQASETFKKLAGILKPVNKLSLYYQNAYSMYGKLHLFKAKLFQLSILPDIVVITETWLQDCVLSSELGMQQFDVFRCDRDLSSHGVQRGGGVLIGVKKFLQAELVHVDNVIEQLIIRISLPSHKLIVAASYLRPDSSVQVFSSHVSNLEDANIKFPDHRMVLLGDFNLHHITWSSDTSAYSPMAYLSPALRSAADIISGYSTSMDLVQHFKHHPKKGYSLDLLFAQKDFISPMDFNEDILPCDDHHVPGMFSCNISVASSASCNLKFCKRKFYSADFEAIRARLSEEDWATVLYSFSDDPDSGIARFYEILNGVIDQHVPITKQSLSSYPKWYDSELINAICKKKIAHSTWKSSNSKRDEIEFKRLRAVCVRLSRSKYRAYISSVELGLKRNMRTFWSFIKNLRNDSSIPSKMYHGPTRAASDVEVSNLFSGYFSSVYRTDSLREFESNDEPLVSLSNIVLSIETLRSIVANLDDNINGGPDGIPPYFIKRCWSLLERPIVHIFESMLRSGYFPTFWKYSFVVPIYKNGDRHSVANYRPISTLSCIPKILDAYLASELSNSLLSKVAQQQHGFISGRSTLTNLLVFNDFLSESLCNHEQTDAVYTDMSKAFDSVNHSRLISKLFNFGIRGKLLDLLRSYLTNRSQAVRVNGAVSSPVDVPSGVLQGSHLGPLLFCLYVNDLVPKLSAAQVLLYADDIKLFMRVRSADDSVKLQRDLDTLVAWSVENGLSLNANKCSVISFSRSKSLLLFNYCINGSRLQRVDVVKDLGVIFDSSLTFITANQQTDVVVSRSLRMLGFIKRSTVDFSDPSAIIYLYKTLVLPHFLYCPQIWRPHSQYLINKLESVRHSFLRYIAFKMGKPLHRFCHDYSEIAEGCDILTVDSTFYLHDCVMTFKILRGLTNCERLSDLFVSRTVAYPLRNLRDLREGTFSSNLGFYSSINRMKRQWNSIPNNVQSKESVGQFKSSIRSLSLAY

SEQ ID NO: 2339 - protein, 866 aa, synthetic construct
  source 1..866: note = Description of Artificial Sequence: Synthetic polypeptide
MESLFIEIINEKSKNTLIGVIYRPPHSNVNDFLNEMELLTTKLNTENKKCYILRDFNLNLINIEYHELTRQFLDIMYSSSMIPTISKPTRITSHSATLIDNIFTNNINMQDSFSGLLCADISDHIPIFHITKIGKTKQNKEKRNMYTYKRIMNDSCIDNFLGEIDQINWDNVVLKENVNDSYNSFLQNITYIYETCFPLKKFRNKKINSKPWITNGLLKSIHKKHKLYKKSQELPSESNFNKFKQYRNKLNSLLRIAKRDHFTDSLEKSKMDAKNTWKILNSLLKKNIKKPNYPDIFKNNNQEISNPKDIADKFADYFTNIGPNLSKNIENTNIDIKSYLKGNYSNSLLFRLTTPDEIKEITLSLKNKNSCGFDEINIRVIKAAISILSNPLSTLINQSIMAGIVPDKLKIAKVIPLFKSGEKELFSNYRPISILPCFSKIYERAIYNQLISFINKYNILNNNQYGFRDKHSTVMAVCDFIEKISSSIDKGYNTIGIFLDLSKAFDTINHNILLQKLQFYGIRGIPLLWFQNYLSNRKQFVNYKDTKSEEYDITCGVPQGSILGPLLFLIYINDVPNATELFSFTLFADDTNLIFKSKSAEDMDEILNSELFKLTEWFKTNKLSLNTKKTNYIIFRNSKRKTKHTTKIEINNEPIQMVNETKFLGLIIDSQLNWKSHINHVRTKITKNVGIMNKLRFYLPKFSLKTLYFTLVHPYIHYGNINWASNYDTSLKRIFLLQKRCVRIITNSHYLSHTEPLFKEERLLTVYDINTLETALFMYKFDNNQLPGTFDNFFKRNNTIHSYNMRNSCDYRTTLRKTRRGQFSISYRGPKIWSNLTCQAKQCRSLNMFKKIVKDNILSQKAAIDL

SEQ ID NO: 2340 - protein, 292 aa, synthetic construct
  source 1..292: note = Description of Artificial Sequence: Synthetic polypeptide
MRKYNVSFHCYADDIQIYLPLKSGGAEGLDRLQNCLADIKSWMELNFLCLNKNKTEMFVFGKSDLLTGCCSAVGPLDPSDAPFIRNLGVNLDRHFKFDKQVSLVVQSSFYHLRLISKVKPYLPPHALQQVIHALIFSRLDYCNSLYSGMDQSLLRRLQLVQNSAARLLTGTRRCEHITPILRSLHWLPVSFRISFKILLLVFKCLNGLAPQYLSELLHVYRPCRVLRSEDQMLLVVPRTRLVTRGDRAFSVAGPKLWNALPYSVRSARTVSNFKTLLKTHLFTQAFNSSERI

SEQ ID NO: 2341 - protein, 455 aa, synthetic construct
  source 1..455: note = Description of Artificial Sequence: Synthetic polypeptide
MKLNQHKAAGPDGVSPRTLRTCAHQLSAVLQHLFNLSLRLERVPLLWKTSCLVPVPKKTSPSHPGDFRPVALTSHVMKVLERLVLAQVRPVVSSSLDPLQFAYRPRLGVDDAVIHLLQRTHSHLDGGGGMVRITFFDFSSAFNTIRPSLLGDKLRLMGAGASTVSWITDYLTDRPQFVRLGGVLSDVVLSGVGAPQGTVLSPFLFTLYTSDFQHNSESCHLQKFSDDSVVVGCISGGREEEYRRLVDGFVEWAGENHLLLNVDKTREMVIDFRRKRTVLQPLCILGRDVEAVEEYKYLGVTIDSRLSWRSHSTAVYKKACSRLYFLRKLRSFNVCSKMLGIFYQSVVASTLFSSVVCWGSSIAVSDTNRLNKLIRKAGSVIGCKQETFEAVMERRSLNKLLSIMDNPEHPLHPVLDKQRSSFSRRLRQLRSKTARYQKSFIPNTITLFNNSQCRR

SEQ ID NO: 2342 - protein, 965 aa, synthetic construct
  source 1..965: note = Description of Artificial Sequence: Synthetic polypeptide
MTPSAESKRIMTLRLFTESGYINIISAYAPTLTTNSADKNHFYESLQKVVDSISSDEQLFILGDFNARVGIDTSSWPICLGHHGIGKMNENGQRLLEFCSINELCITNTFFPGKECHKVSWHHPRSGHWHQLDFVLVQRKDLNCVKSTRTYHSADCDTDHSLIVSKTKLKAKKFHRTTLNKKPKINCMNTRNSAKCEDFAKAFAKKWEENAHVESVEETWQTLCSAIYEAAREAFGEKKSSNKDWLEENADRLMPLIKQKNEAYLEYIKNPSDSAKAKLQHAKGLLQREIKHCINQYWIDICSNIQVASDTGNARAMYEGLRKALGPNITKIAPLKTKEGISITDKSKQMARWIEHYSELYSEERNIMSETRDFIPTMELMQELDAVPSKQELIDAIDALSSGKAPGTDCIPAEVLKHNKDCLIPPLYDLLLKCWTKGEIPQDMKDANIVTLYKNKGDKGDCNNYRGISLLSITGKAFAKVILRRLQLLANSIYPESQCGFCTGRSTIDMIFSLCQLQEKCREQNMPLYISFVDLTKTFDTVSRQGLYLLLERIGCPPKLLQLIIAFHEGMRATIQFDGYTLDSFQVNTGVKQGCVLAPTLFGIFFSVLLSCAFKNSHGSIYLHTRSDGSLFNLARLRAKSKIKKVLIRELLFAADAAIVAHNETQLQDLMAQLSRTCQQFALTISIKKTVVLAQGNTTSPCIMLNNNPLEVVLKFCYLGSTITSNLSLDAEINIHIGKAATTFSRLTKHAWANSKLTIRTKILIYQACVLSILLYGSETWTTYASQEKQLSSFHLHCLHKILNIKWQDKVPNEKVLERAGMSSMGAILHNRRLRWLGHMKRMDNNCIPKNILYGELAEGTRPKGRPKLCFKDYCKATLVKFQIDIDSWENLAVDRNTWHQHLRQGQKHYDKTLAENQNKKRMKRKEQMITTNTTTAWSCIYCSRTCLSHIGLLSHTKHCKKRPV

SEQ ID NO: 2343 - protein, 1216 aa, synthetic construct
  source 1..1216: note = Description of Artificial Sequence: Synthetic polypeptide
MDVDGGPAMPEPWVLRFDGACRRNPGPGGAGAALFKPCGTVAWTCSHYMPNSSETNNTAEYTALLLGVQSAVHHGASHLEIEGDSHLVVAQVKGTFACRNPRLRQLRNRVRHALRAVTSLTLKHIDRKANAHADRLANRALDLKRSLAECGEHQGAMESCLHMNPAAQRQREQPAPPARPACAPTRAEPASDHDEDIDAEIAARDGGEAFPTLPIGPGTAPARQPRLRLRQLTEDEQEAAASALQAMAEELACKIEDADSWTSGDGYISAIPGRIRQVLQPFTAAQPHPRPTLQQQRQRPPRVTRTQREHRLDEALDEMAAVQQERPTSRSAVRRARRRVGRIRASMRQQQLRHDFARNESKCVEDILRAASAETAAEEHPETCPIDSGTLHEHFTAVNSPRINFLPDEACGALFREAMADVGTPQERRSALTDELTVDEVEDQLMQAATNSSPGHDGVGYDIYKKFAAQLVPLLHAAFQFCWRHHRVPALWKVGFVRLIHKKGDPTDPANWRPICLQTAIYKLYSGLLARRLSTYLEANGLLPMAQKGFRAYNGCHEHNFVATTLLDQTRRMRRRLYQVWYDLRNAFGSVHQDMLWYVLRLLGVERAFVERCDDIYEDSYFVVGNAADGATEPVRQEVGVYQGCPLSPLLFIAALVPLLRALEKLDGVGVALADGVRPCTTAYADDLKVFSDSAAGIARCHAVVEQFLEWTGLQANPGKCAFLAVTRNARGNPAHDKDMKLSLHDEEVSSIKLHDSYRYLGVGDGFDHVRHRLQLEPKLQQIKREAVALMQSGLATWQVVKALKTYVYPKVEYALRHLRPLQSQLQSFDRVVAKGLRHLLRLPRSATNEVLYAPTSSGGLGLQPLVEMHRALQIAHAWQMLHSKDPAIREVARAQVCQVARKRHRLREEHWRGRDDELVRCFLNSELAASPHAEALRRHGDIGSLWSDVQRWLRIYHLSLVVQDDRNGLDPLGLRVPHHAKWLDHKSVLRHVKLHLKIRHQTRWKGLADQGKTVRAHGGVGAKFVSTGAGLSDDDYRFGVKARLNQIDTNAVLKRKRLRSHKTCRDPTCSSAETLAHVLNHCEPNMDAIRQRHDDALEQIGSKIRNALKRGESTAELRLNQTVPEYTGAALRPDIVLRNVAAKKMVIADLAVTFEEHAAGARHSSLQLSHDHKTLKYQPIVAELQLKGWQVQTAAIVYGSLGSVQPSNSTPTRRS

SEQ ID NO: 2344 - protein, 1677 aa, synthetic construct
  source 1..1677: note = Description of Artificial Sequence: Synthetic polypeptide
MDVDQGRVRPRQRRPSPRRPSERRPDGKRRRLNSEDDADAQKPAEHLQLADEDGAENHTPVHTPSAASAHQAPVLAVYVHNAERFTCTLCTFTAASFSSLQRHRTTRHRRAVLQDKFLAGCACGTPIASRPAAAKHAQACAGRSTALPATAPPVAGTSSPTDAAATATVAAATVTPDSPQPATPELAAPPPLASPTHPEVVEVQEQPSQGRWGPALPRALVAERVAARLGAIPAPRWEPPLPRELVSTRIAARLGEVPAPRWGPPLPRRMVASRIAARLLPPEPTADGETKEDTPADGADLTARDANQENNPAAAPDRTATAAAMDMDSGADGEWLLRFDGACRANPGPGGAGAALFKPDGSVVWTCSHYMPSSSETNNTAEYSALLLGSRAAADHGATSLRVEGDSTLVIQQVRGIFAARNAILRRLRDQVKVELARVGSFSLHHIDRQANAHADRLANRALDLRRTMMECGAHTAGDGCTNTTLDPMPVLPPQPTPRAPPPTPAADTNIEMQEPEDEDLADIDDGEVYAAMRIGPDAVPQRRPRLRLRQLTEAEDDAAREMVERLGATLAAKITDASDWESAEGYITALPHLLYDKLQPYSQAQRRPEPRPQRQRQQHQGSQCPRQQRQQGEQRRQRPLHDQGQDRRSLEGDAHGDNERDGDASQQDSARRRQCRRRGRSGAAKRRRRRRPPRVTRHHREHRLDEALDDLHAVEQASPGDRTAVRRARRRVGRVNSAIDQQHLRHRFDTDEKACVEDILAKARAQQETPRTAASSAGTASDPAAPAAGATDDGTCPIPGDELWRYFDGVNTPSQEFAPDAPAGAAFRSAMTHLPAASRFRELLTEAPTQDDIESQLQHAHGTSSPGLDGVGYDVYQHFAAQLLPVLATAFQKCWEAKRVPQSWKLGVVRLLHKKGAREDPANWRPICLQQAIYKLYAGVLARRLVRWLDANDRHAPGQKGFRAVNGCGEHNFLAATLVDQARRKRRQLYEVWYDFRNAFGSVPFALLWDALARLGVPEDYVTMCKGLYESAAFVVGNAADGTTAPISLRVGVFQGCPLSPQLFNAAISPLLFALKRLPATGVPLSGDDCPGASAYADDLKIFSGTEDGIKRQHALVADFLRWTGMAANPSKCSAMSIQRDRRGVLKADDLKLELDGSPIPALSMSASYTYLGVGDGFDHTRRRVELAPTLKQLKDDATALLQSGLAPWQVVKAVKTYLYPRVEYALRHLRPFQQQLAGFDRHLARGLRHLLRLPASATAQCFYAPVSRGGLGLLPLTELHAALQVAHGWQMLNSKDPAIQRIARVQLRQIADARHRLDTQAWAGREEELCELLLNSQLGTSPDAPPKRRNGDIGSLWVDVQRHLRTLGLQFATAPACADTGTAAATLQLRVPHHDKWLDHRTVLRHVKLHIKHRHWTKWAAMRDQGRTARAHGGVGSSFLTRPRGMCEADYRFAVAARLNQLDTHSVLKRRRLRAHDRCRQPGCSRVETLAHVLNHCPGTMDAVRGRHDDALKTIERALIASSSGDRQDRVELRVNQTVPSLAGPALRPDLQLYNHTKKTVAVVDLAVAFEEQVGEDPDSSALARIAAHKRAKYDRIKRHLERQGWKVHLSALVYGSLGAVAGGNRSVYTEHLGLLKRDAKRLDWQKKEEDREDKCSSWPHEGWVKAPGDRTAIG

SEQ ID NO: 2345 - protein, 771 aa, synthetic construct
  source 1..771: note = Description of Artificial Sequence: Synthetic polypeptide
MKKNKTPGSDGITAEFYQVFWNEICDILVAALNECYANEKMSDTQRKGIITLIYKKGDHRELKNWRPITLLNSDYKIIATVLAKRFQKVIGKIIHENQSGYIRGRLAACNVRLTKDIIEYMTRNGKNGALMMVDFSKAFDVIDVTFIKKCLSKFNFGPVFQKWVTILYTNISSSVIVNGWLSETFSVLRGIRQGCPLSALLFVMAAELMANKVRENKEIKGLDIDDKGIDLKLLQYADDTLFYVSDINSFENILIELEVFGIVAGPKLNREKTVLIWIGTACQRWSLSCFGLHWTDEPVKYLGHHIAPDLQCALKIDWENKLEKMQKLLDNWRKRNLTLFGRLTIIKSLAISQVIHLMIVDTIPSTFLIKLNSLIFKFLWKSKIEKVKTFRLKWLGMFLDNTTGNWKDMCKHWFDCLGGLHLLLNCNYTDYTLNLLKLRNVPHFYIEILHAWYLINKYTSAECQTQKHVDENILWYNQDIVFEKKMLFYEDWYKSGIIYLNDIFKNGTFVSVNELFIRLKTRRSKQFLIFDYTKLQKSIPKIWINDKHRVPLVFKDHNFSIPHFVFGKSVKPVSLLSSKQWYNMISFEQIKINKCCLYWEDVLQKDVKWSSVFNRNLIGIKDFRLREFNFKLLYNMLPVRNNLFKWGLSYDDLCLKCKKTEDVLHAFISCKANETFFAYLKDLVLRAFNLRIEIDIVLLLKMNSQTEIDLIMTIAFWSIYKMIIFRNKYGYDNRDLSLIYLFKREMTNRIEINEHLKVQNMKFPANLLSYI

SEQ ID NO: 2346 - protein, 1017 aa, synthetic construct
  source 1..1017: note = Description of Artificial Sequence: Synthetic polypeptide
MESHNSKSKRNGVKGTSRNRGASLGRPSHVRQVGPDRHSASVRNRNIMRIGTWNVRTLYQKGKLDNVVQEMNRMRINILGISETRWTGSGEFTVEKHRMIYSGGIRHERGVGVLLDPFTANCVLGFWAVSDRVLLVKLQGKPFNMAIIVVYAPTAESTDEDIDIFMNSQITMTAKSQCKSNEIVIAMGDMNAKVGRGRYGGTVGPYGIGDRNERGNRWVEWCEAKGMVIVNTWFKEHPRRIYTWKSPGDRARNQIDYITINERFKRGVKQAKTYPGADCRSDHIPVVATLQCKLKKMTKAKSIQKVDFEQLQNRDVRLRYTVKVQNRFDSLTDQGEEVTWESMRDILVETAEETLPKKEKKSKQRWMTEEILSKMSKRQKIKDRDGIEYRELDREIHDHCTKAKEEWLNKQCAEIERSFNANDPRVFKKVNDLSGKKLRSSKLGCIKAKDGSVLVEKEEILNRWTEYIGELFDDVRKEPPHCAGSIEGPRILLSEVRSAISMMKRNKAAGPDGVVMEMVEALENYGVMKLTEVINKIYDDGKFPDDLCKSIFITLPKKPGAVECGQHRIISLMSHITKIILRVLLQRARNHLTPEISNVQFGFVKDAGTRNAVFVLRSIAERAVEMQKDVFLCFIDYTKAFDKVRHDQLFEDLTKIGLDTKDVKLLQNLYWEQTACVRVETELSDYINIKEGGSARMCHVSRSLQLLQVTTSTLKRGVRQGCVMSPDLFNYYSELILRNLEQERGLKVGGHNITNIRYADDTILIAESEKDLQRLLDVVVRESDKRGLSLNYKKTECMVISKKGGIPCSLKINNNQIKQATSVNYLGTTITDDARGEQEIKRRIALAKSTFSKLENILKNKKLKMKTRLRVLNCYVYPVLMYGCEAWTLTSDLRKRLESCEVWFLRRMLRISWTERVSNDEVFAMAGTRRKLLNNIRGRQLSFLGHVIRKNGLENLALTGRIEGRRSRGRRRILWMSSLRSGISECGIDLGENELLHRIWDRELWHSMVANVSGYGT

SEQ ID NO: 2347 - protein, 725 aa, synthetic construct
  source 1..725: note = Description of Artificial Sequence: Synthetic polypeptide
MSGETRYIYDKADYDAMYDKIMEIDWNNEFWEMSMEKSWSFFKTTLLDIFNRYTPKKTLNVSQRKKHWMNRETLEVVREKHRHFRKWQEMKSEKNREKYSSAEIEQQRRCYSRSSNQARWQCRKAVSSYEKYIASGVKKNARAFWSYVNSKITTRESVCNLTKPDGSKTETDQEKAEVLQDFFSSVFTQEDLQDIPLPLDVEFDTPLDDIQITSGDVFELLRRLKPNKSPGPDKIHPRLLKELADVLALPISLLFQKSLESKQLPQDWKSANVTPIFKKGNKSDSKNYRPVSLTSIICKMMENLVRKQLLDHLMTNDLISVHQHGFVVGRSCITNLLEVLDQWTQILDDGGTVDAIYLDFMKAFDTVPHHRLLLKLESYGVRGNVLAWLESFLSGRQQRVVVRGKQSKWGKVLSGVPQGSVLGPCLFLLFVNDLPKVVNSNISMFADDTKLYVRADTADLRKQLQEDLSRMEEWAEKWQLCFHPDKCTVLRLGKLPAEASTDYCMKKGTDSVTLSVTKVEKDLGVLVDSQLSFKDHISQTVLKANRVLGVIRRTFMYLNTDTMPFLFKGLVRPILEYGQAAWSPYRLGEQRMLESVQRRATKIIPGLRNLTYQERLTKLKLPTLVHRRKRGDMIDVYKYVNGLYTVQEMPFKMSTEDRTRGHSRKLEKKYSRLDIRKYFFSNRVVELWNGLPENVVAAGSVNSFKNRLDSHWSKSVPVSLLYEPV

SEQ ID NO: 2348 - protein, 476 aa, synthetic construct
  source 1..476: note = Description of Artificial Sequence: Synthetic polypeptide
MIISKPITRLFNLSLRLGVVPQEWKQARVTPIHKGGDKDNVNNYRPISILPTIMKVLEKAVHSQLHDHLLEFDLLNAQQSGFRKGYSTNTLLTYVSDNLHRNIDSGKLTGIVFLDIRKAFDSVDHSKLLEKLYTYGVRGNTLSWFESYLRGRYQCTLVQRARSDLQVLQSGVPQGSILGPLLFTLFMNDLPNSVEHSKVMLYADDTAIMFSALNPKEIESTMNSDLDRVKSWLCHNKLSLNTDKTNFLLVGTPQKLRHIEAPIDIKIDGLQIRQVEHVKYLGVWLDQHLNWNEHMKHTSSKIASRLALLRRVRKYLTIDSAKLLANALVLPYFDYCCTSWSNCNQGLRDTLIKLHKQMARIVLQMNVLTPSSEMFSKLKWMNMEKRWQFQKCKLMFDIVNGYSPSYLQDMFTQSAATHRYSTRIADTRGLVIPKVKTENGRRAFSFEGAMTWNNLPSELRNAQTKQSFCTSYFRNM

SEQ ID NO: 2349 - protein, 998 aa, synthetic construct
  source 1..998: note = Description of Artificial Sequence: Synthetic polypeptide
MPGSTVNSIINDQSFVEFLSPRNGENDFYGPSHGSYTCNEFNDLVNDSNDGLFSILHINCRSLSKNYDNISTFLSSLTVQFTAIALTEIWIKEYNSYYDIHNYTLVLKGRQNKKGGGIGFYVRNDVKFNRRLDLDINTPYIESLFIEVVTANISAILGVVYRPPDQPIQSFLESVENVITTVNTENRIFYMIGDYNINLFKVNCQSHVKDFIEMFMAVGMYPLVHGPTRVVNNSISLIDNIFTNNLENCSSGTILTDISDHFPIFCIYSQSTQTVTETCITMKRQFSAKNINTFITNIGNTHWILKENDANSSYDCFLKQFQHVYEICFPMKCQSKKKKRFDKPWFNDELRQLNRKKSLYYKKYLNNRTAYRLDAYKKCRNKLTNRIKYVKYKYFKQSFVDAKGDTKQTWKIINGLLGTKSKKNEIPSTLQYNNETIDNDTDICESFNEYFINIGPKLTSTLDIPTGDFKQYLKKMNLLLFFYFFFTPVTPREIINIVDKLKSNKCSGFDSVDVKMVKRVIHLICYPLCAIFNSSLETGIVPDQLKIAQIIPIFKSGTKTEMSNYRPISLLPVFSKILERAVYNRLYSFLNLHNILNNSQFGFRTGHSTSSASVDFTCQVSQVFDKSEVMMGLFLDLSKAFDTLDHNIILAKLFNYGIRGVLLNWFKSYLSNRKQFVKIKGNTSSMQTVVCGVPQGSILGPLLFILSINDMCNISDKLKYILFADDTSVFMSHKNIQSLQQDFGNEINKLLHWLSLNKLILNVNKTNYMVFTKQQKIDFNEVDLQVNNHEFKRVSVNKFLGIEIDSKLTWNEHTGAVCNKISKNTGILNKLRFLPKCVLRMLYNTLILPHLYYCSEVWAMTSQTNLNRILKMQKKAIRIISNSHYRAHSKPIFYKLKLLNVFDICEYHIAVFMYLCRNESLPCALLKYFNLNSTFHDYETRNASNFHLPQIKTTLMKKSISFDGPKIWNSIPINIRNCRSLQTFKRKYKMYLIESYVL

SEQ ID NO: 2350 - protein, 873 aa, synthetic construct
  source 1..873: note = Description of Artificial Sequence: Synthetic polypeptide
MFISNLLTYKIRSDLSLKSDGTDSICIEINMAQRKNILICTIYRPPHTNVELFLDEFDRMLHKVNLENKDVYLMGDFNIDLLQEDNTFHNMLRSNSFNAMIDKPTRLANNSSTLIDNIFTNVTNNYIGSGLLYSEISDHLPIFLICNHVRNYPEDEKNQAMIRKITAEKIAMFNDELLKVTWNDVVACTDTNKAYALFWNLFSSLLNKHIPMTKKRSARNRIKQPWITKGIFCSIKKRNRLYKYSLRHPGEESLNNYKSYRNKLTTIIRQSRQMYFAKQFENANGNASSTWNVINQALKKQKSKSKCHITKDNNTMVDSKEIANCFNAYFVGVGPNQANTIASNGVDFSQFLQTPCNKSLFLKPTNLIEILNIARSLKISYANGHDGISTYLLKQVIGNIITPLVHIFNLSLTTGTFPEAFKIAKVVPIYKKDDSSQVSNYRPVSILSSLSKVLERLIYNRLYCFLTENDLLNQDQYGFRKYHSTDLALAQLYDKVSNALASRKHVIGVFMDLSKAFDTLDHKVLSSKLHYYGVRGVALDWFNDYLSGRKQYVSYESVDSSLLPMKCGVPQGSILGPLLFLLYVNDISNSTTSLQYIIFADDTNVFCSNSDFRSLQRILNTELPKLSLWFRSNKLSLNLKKTNYIHFQSRKNATDKPIPEIVLDGEYLEKKQNTKFLGTIINENLKWSDHVHYVSKRVSRTVGLLYKLKHYVPLNILYMLYNSLILPYMSYCNILWADSKVYTDKMLLLQKKAIRVCTNAGYRDHTDPLFARLKTLKVTDINFLQKALFMFRLHNDSLPSHFPPMFCLNRNIHTYPTRQSNKYHLCNPKTTMAMKSIRHSGPDIWNSLSVDIRNLKSVYTFKKSVKSILLSKY

SEQ ID NO: 2351 - protein, 1198 aa, synthetic construct
  source 1..1198: note = Description of Artificial Sequence: Synthetic polypeptide
MKNYFLPPSSSRSHPLLLAILSIVCALKLLKSGNLYTQIADHRSASLPFFDLHATLCEPRSLHQPTRRRTYTADIDNCKLLLFISSCNKWNRNTKLCPLDFRSTSLSHLTILLLLSGQVETNPGPSTSAPETFPCAICGDEVRDNDPALLCDHCDCWCHISCVGISPDSYDILTKKSRSFAWVCCQCSSTNIGSSSSLQGLNLSQTNRFSPLHHDSSNEEILPSINPLTSTPTSSPGGRRQPRFHPPSRNRKKAFKVMVVNCNGLKGNAKKSSFHAAIAHHTPDFVFGCESKLDDSLSSYSIFPSNYSIYRKDRNIHGGGVFIAIIDTLIVTECPEFDSDCEIQWCNVQLANAKPLYIGSYYCPPNNRQQGLEGLHQSLSKIMTRHRRSHPNILIAGDFNHPDINWDDQSTTNPATSTCHQKLLDILLHNSLSQTVREVTRPSSNNILDLVVTSNPALVENVCVKSGISDHNIVTFTLAANPKISVKPLRKIYQFHKADEQQLRDAAAEFATEFLQSDPERRSVETNWSIIVNFLNRCLSELIPSKMSKGRKHLPWITPPLKRQMRKRDSLFKKAHSQSCSTAWTAYRQFRNQVAKNVHRARCEYVNNIIGASLKDNPKSFWSYIKTCRSENIGIPTLRTPSKLCASALDKAETLNDYFQSVFTPHQLQPLVQKGPSPFPTIGHLHVHRTGVEKRLQQLDPSKASGPDELPPKLLKLVAREIASPLSFLFQQSYNSGIVPAQWKQALVTPIHKSGEKCDPSNYRPISLTCVCCKVMEHIILSHVSKHVAVNNILTDAQHGFRRGLSTTTQLTTAVHDWSSILQQRSQADIIFLDFKKAFDRVPHLLLSTKLQYYGISGDSLQWIMSLLTDRQQAVVVDGSKSTWRDVTSGVPQGSVIGPTLFLLYINDIQDNIQSTMRLFADDSTLYREIRCPEDHQILKDDLQQLSRWSSNWMMDFNVKKCAILTITRKRTPSIREYHLSNGLIPRVKEYKYLGVTVAADLRWNKHCQTIRHKASRTLGLLRRTLSPCTRDVKSRAYTALVRPQLEYASEAWNPHSVTVTKMLEQVQRTAARFVYRDYRYTTSPSALVAALGWDTLHTRRILDQCTLLYKIHHRLVSIPAPTIVIPATYFGRHDHNLKYVIPVATIDSFKFSYYPRAIRIWNHLPGSAVNATGITNFKEAALPSIRMMQPPVGSHII

SEQ ID NO: 2352 - protein, 671 aa, synthetic construct
  source 1..671: note = Description of Artificial Sequence: Synthetic polypeptide
MHGHTLDLVITRCADNILHNCMVLDKGISDHYVISCDLNLQKSDAKRTLITSRNYRLINQESFGNELVAVLQSISQCGDVNEQVEFINKAICDVLDRHCPVSVRMKRDRPCGPWYDDNIHLLKRKKRKSERKWRKSNLRADRDIFVCHKDELNAAIVKSKSSYFTNLLLEANCKTMYATLHLLLGSSKKVLPYCDDQTDLANKFAGFFDDKISKIRTVLDEREQGLQTSGIVQSMDKHQCETGFSTFVDVSPSDIKMIISKSANKFCSLDPMPTWLVKDNIEVLVSPFVSLINSSLRSGVFPDKFKDAIISPCLKKSTLDSLVLANYRPVSNLAFLSKVLETIVSKQLVKHLDRCDLHEVLQSAYKANHSTESALLRVKHDLLLAIDKREGVIMVMLDLKSAFDTIDHSVLLRRLHSDFFLSGTVLDWFQSYLEGRSFAVSIGNHLSHKLSLKYGVPQGSVLGPLLFTMYLRPLGDILRNNGVEFHLYADDVQLYYSFNPKSSSSFQNAILLIEKCVSEVNVWMIKNKLLMNEQKTESLLIISSRLRHYLPDHVHLLLGDAFVEPSESVRTLGVVLDSSLTMSQQVTSLCKSLNFHLYNISRVRRMLTDEACHHAIRSLVLSRLDNANSLLININVSDIDRLQRIQNRAARIISNARKYDHVSPFLNNYTG

SEQ ID NO: 2353 - protein, 1015 aa, synthetic construct
  source 1..1015: note = Description of Artificial Sequence: Synthetic polypeptide
MAPAQLCGSATSVEYTISAGQIYSFPVPSVATSAAKICHLNHTDIEPCTTNPDSKDEGESDDSLCLGSPKFSSSPRTLKKKPINPTKPKAKVLTILNVNCQSIRAKKQSFAILIHQHNPDVVIETESWLTEDIRSSEVFPTDHYNIARRDRPNDLHGGVFLAIRKDLLASREIELETDCELIWCKISMPGAKTFHVAMKLRAHLVQDQHARSQDFPCCDEMSLTELERSLSRLSPTHSVVIGGDFNLPGWDWRNQQVGNCRYPNLHRRLGSLLDDHGLTQVVTEPTRYQNTLDLLLVSNPTVVNEVTVVPGVSDHDCPLVKLNVRPTRPDEEESFTLQQSSVGEVWDQPGQMRRKVLLYSKAQWEKFGESIEAVRDEIEAKVTYASVNELWLIFKTGIEKGINDFIPQKLTPHKANLPWVTNGIRRLIKKRDRLSNECRHLRKREGLIPYVLEERLRDLKRTLQFALRKAYWNYVESIFTVEDDDEGPGKYNCMKRFWQFIKNNRNDSAGIAELKSDGVLFSEPAEKADALNRQFKKVFTQEIPIPPHLLPDTSEHESMPDIVITLKGIEMMLKKLKPHKAPGPDGITPRILKQLSRVIAPILRIIYRLSYDTGEIPDDWHKANVVPVYKKGDRTDPSNYRPISLTCICCKMMEHIFASSIMRHGDEKDILCPLQHGFQAKKSCELQLTRLCHLGFVTDLLNNMELSQQTDVLITDFSKAFDKVGHQRLLKKMEYYGVRGKSIDWISSFLPNRKQQVVLDGHTSPTVEVQSGVPQGSVLGPCLFLFYINDLPNQLSTKVRLFADDTVLYHTIQETHEDAELLQQDLDQLCGWSSKWMMALNPKKCQVITVSRKKSQVCPSVFPQWRNHWSLCQLPNTLALLSLLTSTGTQHVSATCKKANNTLAFLRRNLRVNSTQLKTTAYQALVRPLLEYGSAVWDPHTIRCVNQLEMVQRRAARYVLNRYHHTSSVSDMLSQLGWTSLQKRREHQRLTLLYKMHYSLVDFDIHHPTSNRQQS

SEQ ID NO: 2354 - protein, 811 aa, synthetic construct
  source 1..811: note = Description of Artificial Sequence: Synthetic polypeptide
MDFNLNLLQCDENTSCQDFLDLMLSKSFAPTITKPTRITEYSATLIDNIFVSGTPIVKSGVIVTDISDHFPIYTVISNVISHSNPNTNKCSGIRYLSDPDLRRLKEALTITDWYAVYNCDDVDTSFDNFMEILMLTLNSFPTRQQNCSNYKKHPRLAWISKSLLKSINRKNTLYYKYKKNHTVKSKLKYSRYRNILTTSLRLAKKNYFTKQFNVNKGDIKNTWRVINNVLKSRRVSTHISNIMINENRIQDPLVIAEEFNNYFANIGPNLAQNIPVSDLHFQYFLETKNTNSMFCTPILEHEVIDIVKNMKTKKSAGNDGITNFILKEIIGEIVSPLTHLLNLSIMNGIVPKKMKIAKVIPIFKKGNAQDIGNYRPISLLTSFSKILEKLMYSRTMQFLIDFDILSDTQFGFRQKHSTTHALLMFLDKVAHAIDDMAHTVGIFLDFSKAFDTINHDILLYKLSHYGIRGKALEWFRNYLTDRKQYVSINGHDSYQRSVSCGVPQGSLLGPLLFVIYINDFRNSSEIMSFILFADDTNIFYSHRDPQYLLRTVNSELKRIQAWINANKLSLNVSKTHFMLFSNCIKSLPGNILIDNTNLNQAESTKFLGIYIDSDLSWKIHVNYLCKLISRNTGILNKLKHEFPTHILLSLYNTLILPYLNYGILAWGNGTKAQLEKLLIIQKRAIRNINHAGFLSHTSQLFFNNKVLRIGDVYVYSVGVFMYQLTINELPAVICALFVRNNTIHSYSTRQRNLFHLPLTRTLFAQKNITFTGPKLWNDLPIEFTESTSLYSFKRKLKCHLLSNYALMVEEA

SEQ ID NO: 2355 - protein, 977 aa, synthetic construct
  source 1..977: note = Description of Artificial Sequence: Synthetic polypeptide
MPPYVLIGSLLLFFTFQANCLRFNVPNLRATEWQPHNAAIKDRLTLLHHDLGAGIVTPKSAADDLTSILTEYFSGQDDFVDKKLSDTYIEHEPKSLIQARKCKNVLRKRAFGKNGTAEDRKAFRAAVKTVSYLRKQDKQKKCDKSRSHMEKRYRNNFYEFSKAACSGSLNESPTKPLFSEDVANNYFGDKYSTPNVINIGSLNWFPYVNINTPDRFEFDMTPIKPKDVKNVLRRKKAMSAPGNDGLMYGMIKHLDSVHHFLATLYNKILDSGDPPESWSESKVTLIYKSGDTDKPENFRMISLTSCISKVFHQIIAERSMSYLTENNFIDKTVQKAFIDGVNGCIEHNIVLHEILSDAKCKKRSLHTTFFDLADAFGSVSHQLITSSMERYAIPTPVARYVATLYSRLNGRVRGPGWITKPFEFKRGVFQGDPLSPTIFLMCFNPVLEYLKEQQDQFGYKWGDRKIITTPYADDFNLITGNKLQHQKLMNGINDRLKSMGLTLKPRKCSSLSLTSGKPNIVDFTIGSDVISSVHGHPVKFLGSLITFSMKTSEIFEYLKGKIESTLENINKCNIRNEYKLCILTRYALPSLRYMLTVHDVHASHLKSLDIILDRYIKMWLGIPSRGANLAVVHDPDGLNIPSISDLYRTCHCLAYSRSRVKGDDVVNHALDRRLERERGWSRQTSFSLEAHEIHSKIPDSVSWNQTKTVIKKAVQDVCRENWKRVIEPLLVQGEFMKVVHMENTDVTWKSIIYNLPQSVMKFSVNAAIDSLPTNKNLYRWGKRISDKCNLCNCTGTLHHVLNNCERMLDRYTWRHNNILRIMLKHIKNTSNNSTKVYADIEGESINGGTIPPNIIRTQHKPDICHIDNKNKDIIIIELTVPFETNIDKAHQRKQDKYASLTHDITSTGWKSKLICIEIGSRGLITPQNKYRLKEILKITNSTRYPESRDEILKAVLFSSYVIFQGRREPAWQFDQYL

SEQ ID NO: 2356 - protein, 715 aa, synthetic construct
  source 1..715: note = Description of Artificial Sequence: Synthetic polypeptide
MHRKQTKHNIESLNFDLAKEDWVEVLCVSDVNVAYEKFLEIVLHYYHKNIPLVKIKKGKKAKQPWITKGILRSIVARNKLYKEALTSQCNDKLKKYKTYRNHLTSLIRLSKKLYYSNNIESNKSNNNLLWKTVKELLGKKKTESNKCFLIDEQQITDPIKISKAFNEYYIDVGPNLAANIDSGDMDYNKSLNFPRENSLFLTPTNDYEIINVVQHLNSTKSSGHDSISVHLLKQIIFNMVTPLTYIFNLSISTGVFPHLLKIAKVIPIYKKDDSSVISNYRPISLLPSISKILEKIIYKRLNTFLQKNNSLIPNQFGFRIGHSTDYAILHMYDKIIEAFANSEHIVGVFMDLSKAFDTIDHKILIHKLQYYGVRGQALSWFTNYLQDRQQYVSFQNHESTKLTIKCGVPQGSILGPLLFIIYINDIIETSSLLNFIIFADDTSISYSHKNFDTLITRLNCELMKISRWFKSNKLSLNLSKTNFIHFKQTNVHDMRNCNIEIDGLPLIEKQSVKFLGVSIDSHLNFNEHIRNIHTSISRNIGILYKLKQILSERSMIILYNSLILSHVIYCNIVWGNCSLTRINSLFLLQKRAIRMITNSHYISHTEPLFQRLKTLKIQDIHIFQTCIFMYKYSHNQLPSLFHNIYSLNSNIHTYPTRCSTNYHLENPKILLAQKSVRHHGPDVWNSLPNSIRHCSSLYSFKASLKKTLISKYLHN

SEQ ID NO: 2357 - protein, 430 aa, synthetic construct
  source 1..430: note = Description of Artificial Sequence: Synthetic polypeptide
MPAKPCRESIRIILQRRIMKKTEEVLSEAQAGFRPGRSTMDQLFTLRQIMEKRLERNQSLLCCFIDYEKAFDSVWQEGLWKAMNFFGYSSKYIHLLQALYQQSSSAVRVNGELTDWFKTTVGVRQGCALSPQLFNILLEAVMLYAIHDTKIGVRVQGQLINNLRFADDIVLIADNDRDLQTIVDLVHQSSSNFGLKINITKTEVQAISKQPQLLNINVGGEQLKQVDKFTYLGGTISQTGSCSEEVKHRIGKAIGAFQALKKIWASQDIRCSTKVELYKVLVLSILLYGAETWTLKKVDENRLHTFEMACLRRIMGVTRFDRLRNTHIRTQLNMEETIIDRVATKRLRYFGHINRMNSKRYPHILLNGNIHGKRPRGRPAKRWTDCIKADCKNRQVDSLTKATRLTEDRKVWQAIVKQKPSYIPVMVWTA

SEQ ID NO: 2358 - protein, 964 aa, synthetic construct
  source 1..964: note = Description of Artificial Sequence: Synthetic polypeptide
MAPVRMAAVAQCPPQLCFFLMFVVLFFSFFATCNALISYDRQTLLDIRQNSQSGPSQTEFFMNRGDLPWLPWQKKHRRKRGKRAGILVRLRNRQHRAPLPSILLANVQSLENKLDELRARITFHRDIKNCNIFVFTETWLVPSIPDSAIVPEGLSIHRRDRTIDSGKCRGGGVCVLTNKRWCTDVQTVSSGCSPDLEYLMIRCRPFYLPREFTAIFCTAVYIPPHADTTRALDELFDAIDRQETLHPEAAFIVAGDFNKANMKKVLPKFYQHVNFPTRGENILDHVYTPYAHAYKARPRPAFGKSDHSSVLLLPAYRQKLKREQPMMRSVQRWTDQSDSTLRHCFNITDWEVFRTAADNNINNYAEYVMDFIHKCINDVVPRVNVRTYPNQKPWVNGEVRAALRARTAAFKSGDPSEYKSSRYALRKAIKTAKGQYREKVESCYSNSNIRNMWSGLKTITDYKGKSCRVGEVTASLPDELNTFYARFDKHLSQELLLEEDGRPYQISQADVCKHFRKVNTRKAPGPDNIPGRVFKACAHELADVFTDIFNLSLLQSAVPTCFKRTTIIPVPKKMNVSCLNDYRPVALTSIAMKCFERIVKAHITSLLPASLDPLQFAYRSNRSTDDAIAIALHTALSHLDQRNTYVRMLFIDYSSAFNTIVPSRLVMKLRDLNIGSSLCSWILDFLTNRPQVVRIGNITSSTLTLSTGAPQGCVLSPLLYTLFTHDCTATHSSNTIIKFADDTTIIGCISDGDESAYRAEVRALTSWCRDNNLLLNVSKTKELIVDYRRLQGGGHTPIHIEGAEVERVSCFRFLGINISEDLSWSHHVGVITKAARQRLFFLRRLRRFGMDSRILTNFYRCTIESILSGCITTWYGSCNALDRKALQRVVRSAERITRTELPAMQDLYRQRCRRKMQRILSDPSHPSHRLFTLLPSGRRYRSIQTRTSRYRDSFYPQAIRLLNC

SEQ ID NO: 2359 - protein, 1783 aa, synthetic construct
  source 1..1783: note = Description of Artificial Sequence: Synthetic polypeptide
MLGVSAAQGNGGPASSRRKRWRKKKRLEREDEPTLEIVAPPPPVQMLPASDATACVIDWSVQMSIAEDNLKTAAVITVVCSRDISANEIVSVLAPRLEMEEGGLVLRQLSQSSFLAVLPSRVQLDTLVDSFPIIREENFMLSSRRWTRFGGAGGNSLKHLVELELRGLPVHAWETSVVQQLINPHACISQVLPDTLEVRSLEAFRCLAWCSDPERIPATKDLWITEPDQASAAEGKKALVYPVQIRWVPADLSLLTGDPPLLIGGDDQDKSDTPPSRRRCSDNPPRTQHDAINDVPGNKTHTQRRPVHDRLGPLRRSDSPRELSHPRVQIDFEARSSQPCVLSDAVADSCVGNPPTPVPDGVQCLAAGDVLLRSEEGCEDAEVIPMTPMAVSSPCPSSGGRRRLLLKTATKQAKFRNPPIAFFRRRRRAPRTPEGATLPPCSSGDRGAGSSLGALPPAPAAGVAASLLPHGSPPLVESHGSPGQQDFLRRVSKAVGAVLPLPKAVGGGRRRRQPTSLPDAIRRSRRVAGLGVEQVQHIPKARRTIMKSILAEPDSEHFSQQNLDAYAKLFQAPLSRAQVEALAALFGWVMPDDEGEVVPPGTATLVCLQPTVAYYSNCCPMDPSLILFWNVRGLNSAARQDVVRSLVDSLRVDVVCLQETKLVNCDRRTVLSMLGADFDNNFICLPSVGASGGVLITWRAKLGRIVASRVDSFSVSVKFNPADGVAWWLTCVYGPQGHDRKIAFINELRAIRAACTGPWLLGGDFNLIFRDEDKNNININRPMMGRFRRCINDLSIKDIDLLGRKYTWSGANNVQVKLDRVFCSSDWEEKFPNYLLQSSASEDSDHCPLLLGLKDNHTGKRRFHFESFWPRFDGFLEAVSNTWGSVQQSSCPLKTLSLKFKATTKGLQSWSDRKVGNFKLQLELAREILLQLEVAKESRILNVLETWLFGRLKKCSLSLASLIRSMARTRSRIAWLKDGDANTRLFHSWSRYRKRKNFIAKIQDGEQLVTSHSDKAEVLRSFYSDLIGTGQQRSRTVNLDTLEMQHTDLQGLEQPISEEEVWNTIKQLPPDKAPGPDGFTGRFYKVCWSIIKKDIMAAIMAIWNKDFRNFRYLNTAFITLLPKKEDAILAKDFRPISLIHSFAKLITKIMASRLSGYMDKLVSRNQSAFIKGRFIQDNFMLVQQTARLLHAQKQPRILLKLDISKAFDSVSWSFLLEVLEKVGFGPIWRDVISGLLMTSSTQILLNGVPGEFIQHLRGLRQGDSLSPLLFIIVMDVLNGLIVKAADEGLLQPLSTRSIQHRISLYADDVVIFLRPAASDLHLVTRILELFGDASGLKTNVQKSSVAPIHCSPVDMEMVTQIFPCKVETLPLKYLGLPLSLRKLSKEQLQPLIDRLADLLPNWKADLMTRAGRAIQVQHVLTATVIYHAMALDLPKWAIKAIDKIRRGFLWKGRKDVLGGHCLVAWGKVTRPKELGGLGISDLQKLNWALRVRWLWLEKTDPSKSWADLPLQSSSILKSILSTALITEIGDGRNTLFWRDRWLMGLRIEDLTPHIFAIVPTRITNRRTVAEGIVEMAWIRDLRGTITWDVLSDFLTLSEVIADYSINVGVPDKHIWKFSPTGQYSSKSAYDMLFLGSTSLGAYERIWESWAPSKCSFFLWLVMHNRCWTADRLARRGLPHPSVCPLCDQEEETIQHLLISCVFARQFWYSLLSRSGLPNLSPDNASCSLDDWWSRAVEKIPRDLQSGFNSLVILGAWSLWRHRNDCVFNGEIAKPGECSHPRWR

SEQ ID NO: 2360 - protein, 481 aa, synthetic construct
  source 1..481: note = Description of Artificial Sequence: Synthetic polypeptide
MNLSKILIWNVRGLNRKARRDAVRMMVESTRPDIVCLQETKKESISRFMVFSLLGNVFDQFTFLPAIGTRGGILLAWKGSVCSALQTRVDEFSISVQFNQNDSLPWWFTGVYGPQSDEKKLQFLQELRMVRSVCVGPWAVGGDFNLIYRAEDKNNNNLDRAMMGRFQRIINDLQLVELPLLGRKFTWSNERSSPTLVRLDRFFYSRDWEDLFPDCLMQSSSSSISDHCPLVVGLHEFTQGKRRFHFESFWTKLEGFMTEVENSWCQPIAVGCPLQRMADKLKRLSKHLQSWSQKRVGHVKRQLVMTNEILHRLEVARDSRDLSYHEEWLRRKLKHHSLGLASLERTMARHRSGLNWLKEGDANTAYFHHHSRYRKRKNFIGKLKVEDRIVVDQQEKKHAVWNFYNNLLGVAASREFTLNLGVFHRPASNLEVLDQIFSEEEVWNTIKSIPSDKAPGPDGFTGRFYKMCLDGCQRGFLGSCQ

SEQ ID NO: 2361 - protein, 711 aa, synthetic construct
  source 1..711: note = Description of Artificial Sequence: Synthetic polypeptide
MADVMAVMNSLHDQRFLNFDLLNRANIVLLPKHDGAENLSSFRPISLIHSVAKLFMKLLSMRLAPTMRDIISKCQTAFIKGRSIHDNFLFVRNMARRYHRNGTPMLLVKLDISKAFDSVRWDYLLALLAHLGFPPKWRDWVASLLATCSSQVLLNGIPGQSITHGRGLRQGDPLSPFLFVLAIDPLQRLLHLATEAGILSRVAKARTRLRIAMYADDAIIFVKPEKRELDSFATLLHQFGEATGLRTNIQKSSVVPIKCAGLNLDEILAGFPASRSQFPIKYLGIPLSVERLKKVDFQYLLDKVSSKLTCWQGRNFTFAGRLVLVKSVLSAQPVHTLTTINVPKVVLEKIDKFRKRFLWAGNENLTGGKCKVNWPTVARPLDLGGLGVLDIHRFARALRLRWLWREWEVPEAPWAGLQTPCNDTDKLLFAAATRIAIGDGAKTSFWHCAWVNGRRPKDIAPDIFAASSDCRLSVREALTDSTWVNRIDLHAIHTADHLKQFVELWSFAHSVSLVQNTEDRIDWIYNASGEYSAASAYRIQFMGHTCSNLKALIWKPWGPSKCKLFAWLIIRNRVWTSDRLAARGWPHSPSCPLCKRHPETAHHIIAGCRYSRRIWDALASWLSIGPLAPATWPDSTSIKQWWFMVGSVAVPKKGTRSLLLLVVWHIWLERNNRTFQRQERSVADLLAAIKAEARLWGVAGAKHLLALLPML

SEQ ID NO: 2362 - protein, 1188 aa, synthetic construct
  source 1..1188: note = Description of Artificial Sequence: Synthetic polypeptide
MDPSKIICWNVRGLNSADRQNSVRNLVLSSKADVVCLQETKMTVISTRTILAALGSDFCQFSFLPSCGASGGVLVAWKRHLGVTGLSRIDRYSISIQFCNAHNRCAWWLTCVYGPQSNSDKMLFLQELRDVRAACTGPWLIAGDFNLIYKASDKNNSNINRAMMGRFRKLVEDLSLNEVPLFGRKYTWSNQQDSPVLVKLDRVLCSVEWEDNFPNVLLQSAASEGSDHCPLLLGIRDNKLGKRRFCFEAFWPKLEGFQDVIQEVWDSVAAVNCPFMTLNLKLKATARKLQSWSGKHVGHVRTQLALAKEILHRLEIAQDCRALSLAEIWLSNLLKKHSLFLSSLQRTIARSRSRISWLKEGDANTKLFHMHSRHRKRRNFVAQLVNGDQILTNHDDKAVLVDNFYARLIGECGDREQTINLEALHLPTFNLAHLDEPVTELELWNTIKGLPNDKAPGPDGFTGRFYKSCWNIIKMDLMAVVAAVWNRKFDNFCLLNSAFITLIPKHDGAVHVKDFRPISLVHSAAKLITKLLANRLSQKLNDMVSPIQSAFIKGRFIQDNFMLVQQTARLFHQQKRPRLLLKLDITKAFDSVSWPFLIEVMKYLGFGQIWRDIICGLLSSSSTQVLLNGIPGGHIEYRRGLRQGDPLSPMLFILVMDVLGLLFSKAEHAGLLLDLSPRRPLHRVSMYADDVALFLHPSAADIAITLDILHLFGEASGLRNNEQKSNVYPIQCGGVELEMVQDLLPCGISTFPCKYLGLPLSLKNLTKVQVQPIVDRIADQLPGWKADLMTRAGRKVQVQHVLTGMLIYLAMAVNIPSWAIKAIDKIRRSFLWRGRKEARGGHCLVAWGRVCRPLQLGGLGISSLKELIWALRMRWLWLQKTEPNRPWCSLPIKVPDKARAFFSMVLTSKVGNGANTLFWTDKWIHGQKIADLVPRLFDIIPKKITNRRTVQEALTDRRWIADITGSLSVGVLLDYLHLWNLISDFELLPDIEDKHTFSIAANGTYSAKAAYDGLFIGAVQFGHYERVWKTWAPSKCHFFLWLSVLNKCWTADRLAKRGLDHPERCPLCDQESESLDHILVSCVFAREFWFRLMCIFRLQNLAPTPSTVSFTGWWEMIDNGSGDMIMKGVNSLIALGAWIIWNHRNRIVFDGISPSVSAALCQAREEQQLWEMAGAKGLSFLAATIRGT

SEQ ID NO: 2363 - protein, 1189 aa, synthetic construct
  source 1..1189: note = Description of Artificial Sequence: Synthetic polypeptide
MNLSNILVWNARGLNNKARRDYVRDTILSSKADIICLQETKVASFSSHLLLSVCGSDFDKFLTLPAVGTRGGILIAWKGAVCQVISSRIDNFSVSVQFAGMDGMNWWFTGVYGPQEDDRKIQFLQELLDFRTLCSGPWLLSGDFNMIYQAADKNNANLNRALMGRFRRFLDDCLLKEIPLHGRKFTWSNERSSPTLVRLDRVFCCNDWEDFFPNSLLQSASSGVSDHCPLILSLNVQTHKKRRFHFESYWPKLPGFLEAVSHSWNAPVSTACPVEGIFLKLQRLSKGLQKWSHHKVGNVKLQLATAKEILHRLEIARDNRVLSPGEEWLRKKLKLHCLGLASLERTIARLRSRILYLQEGDANTSFFHQQARYRKKKNFIAKFQVEERIVTSQEEKQQAALDFYDNLLGTAEHRDYTLDLHSLGIQQHDLGDLELVFSMEEVWSVVKDLPLDKAPGPDGFTGRFYKVCWDIIKEDMMGALLAVQCGHVSKLKLLNTAFITLLPKKVDALLVKDYRPISLVHSFAKLVTKVLAARLAPHLPSMVSINQSAFIKGRSIQDNFLLVQQLTRSLHHSKEPHILLKLDISKAFDSISWPFLLDMLQHLGFGRSWCNLISLLLCTSSTRILVNGEPGEYILHHRGLRQGDPLSPMLFILVMEALNAMVSYAFREHMLQPIANQHAKHCISFYADDVVLFMRPSHQDISAIISILDIFGHATGLKTNISKSSVTPIQCGANELTTISALLPCATKNFPCTYLGIPLSIRRLANSDLLPLVDKVADKLPGWKANLLSRAGRLVMVKTVLSSVPIYLMLALELPKWVFKAIDKRRRGFLWKGQGDANGGNCLVSWEAVQRPLKYGGLGILNLEMFGWALRARWLWLQKTDASRPWAGLPIRVHRNAKALVDVAITSVVGSGESVKFWSDRWLLGKTVAEHCPTLIQVISRRALKRRTVAEGLTNRQWVSDIRGGLSVTVLVEYLQLWNLVDGVVLQPDIADQHIWRLSAHGTYCSKSAYDALFVGSIPFGPWRRVWKTWAPLRCKFFVWLAIKNRVWTADRLAKRGLPHPVACPLCDQAEETIQHILVSCVFARQIWTSMLHNLGLLAIVPQHGCTRFSNWWCQSIKKVEKSLRKGLNSLIILVAWEIWKHRNACVFEGVVPCTQRVQSAVIEEGNVWCLAGASALQDLLLRQLPRGP

SEQ ID NO: 2364 - protein, 997 aa, synthetic construct
  source 1..997: note = Description of Artificial Sequence: Synthetic polypeptide
MPSDKLWLLVGDFNLIRRPEDRNKAGGDINLMLKFNEAISNLDLVEIPLHGLSYTWSNRQREPLLQRLDWFFISQEWSIVYPDTCAKTMPRDISDHVPCLVSFKSKIPKPKIFRFENFWLEFEGFMNIFQTTWLGLPCLPDKAKNLTAKFKIVRKVLKDWQRSLPKIDKTVRDIKLLIEFIDNIEEHRDLSIEEWNFRDIMQQKVAELLNIQKIYWKQRASIKWITEGDICSRFFHAHATVKHRRNTIASLTDENGIIHFEHDHKSNLLWEAFKSRLGSSDFLGIDFDLSELLIRNEDLQGLDSPFTKQEIDNIIKSLPSDKSPGPDGFNTNFIKKCWHIIAQDFYDLCEKFYQEEVCLRSINGSFIVLIPKKENPQKVGDYRPISLLNNNMKILTKLLANRLQSFMTRLVHRNQYGFIKGRTIQDCLAWAYEYIHLCHSSKKEIIVLKLDFEKAFDTLEHELIMQVMTHKGFGSKWINWVRNILHSGTSSVLLNGVPGKSFHCKRGVRQGDPLSPLLFVLAADLLQSIINKARHLNLLQLPLPDICEQDFPIVQYADDTLLIMEACPKQLFFLKAILNSFASSTGLRVNYNKSNMYPINVNPEKMEILSRTLNCQIGAMSFTYLGLPLGLAKPRIQQFLPLIQRIEKRLSCSSNFLSQAGRLELVNSVFSALPTFFMCTLKIPKSIIKQIDIYRKHCLWRGNDTSSKKPPLVAWSTVTQRKVNGGLGVLRLETQNDALLLKFFHKFFNSYDLPWVNIIWNKYYTPNRLPGHRRIGSFWWKSMLKLLHNFKGLAHPIIGNGRSILFWEDQWNKSIPRQQYPELFSFTKSTKLSIAEVKEQDHLFRIFQLPISEQAYEQYLELQVVWEQIVLSNVKDRWRYIWDSDSYSTQKAYRHLMGQTQVHSIYKCLWKSKCQPKHKVFYWLWLKNRLNTRNMLRRKNMTLESYSCENCLWQREETLYHLFLRCNFAKACWNSIGIPPTQNCSSRGGLGKPQTTT

SEQ ID NO: 2365 - protein, 733 aa, synthetic construct
  source 1..733: note = Description of Artificial Sequence: Synthetic polypeptide
MVVFSMFFQMDPSKIVCWNVRGLNGSARQDVVRCLVDSVKADVVCLQETKMSVFSRLFVFRLLGSEFQNFVFTPSVGASGGILVAWKNNISSCGSRIDDHCVSVNFSLETGSSWWLSCVYAPQGNHEKIQFLQDLRLIRTHCSGPWLVVGDFNMILCDEDKSNSNVDRAMMGRFRRWKDDLALLELPLIGRRFTWSNGHACPTLVRLDRMFCTADWEDLFPDCLLQSAATQDSDHCPLLLGLCDINKRKGRFHFQAFWVKLEDFQDVVANAWSSIPAGQCPLVSLSKKLQATAKALQRWSDNKVGDLKLQLEMARELLHRLEMAHDSRTLSPSEDWLRRTLKKHILVLSSLSRSIARLRSRINWLKEGDAHTSLFHAQARIRKKKNFIGSLSTSEGLILTSHEDKADELFHFYDALLGTALGRENSLNLDALEMPSFNLNELDVPFSEEEVWGTVKSMPSDKAPGPDGFTGRFYKVCWVTIKADVMAAISCVWARKFRNMGLLNSAFITLLPKVEGATQVKDFRPISLVHSFAKLVTKMMANRLARHLNDMVSPNQTAFIKKRFILDNFMLVQHTARFLHRQRQARILFKLDISKAFDSVSWAFLLEVLQKLGFGQIWRDIICGLLASSSTRILLNGVPGDYIAHQRGLRQGDPLSPMLFILVMDTLNLLIQRASDEGLLHSLSTNSLQHRFSLYADDAVVFLKPAAFRHKSDSGNPSDFWGCVRSKDQRSEE

SEQ ID NO: 2366 - protein, 979 aa, synthetic construct
  source 1..979: note = Description of Artificial Sequence: Synthetic polypeptide
MCLSIPVLSPLHRPYKRSTPRGRCHSNLVVPARTTHVEFQVSGSLWNCRSAANKAEFISAYATLQSLDFLALTETWITTDNTATPTALSSSAYVFSHTPRASSQRGGGTGILISPKWTFSLSPLTHLSISSFEFHAVTVTSPFKLNILIIYRPPGSLGEFINELDALISSFPEDGSPLTVLGDFNLPTSTFDSFLSASFFPLLSSFDLTLSPSPPTHKAGNTLDLIFTRCCSSTNLIATPLQVSDHYLVSFSLSLSSNTSHSAPTRMVLRRPNLRSLSPATLSSSILSSLPSAQTFSNLSPDSASSTLLSSLSASFDFLCPLSSRPARSSPPAPWLDDSLRAHRTGLRAAERKWRKTRLPADLASFHSLLSTFSSSVSAAKATFYHSKLQASASNPRKLFATFSSLLNPPPPPPPSSLSADDFVNHFEKKVDDIRSSFAKSNDTAGPAHTALPCALTSFSPLSPDEISRLVTAGRPTTCPLDPIPSSLLQTISGDLLPYLTSLINSSLTAGYVPSVFKRARVAPLLKKPTLDPSDVNNYRPVSLLSFLSKTLERAVLGQLSCYLSQNDLLDPNQSGFKTGHSTETALLCVTEALRTAKANSLSSALILLDLSAAFDTVNHQILLSTLSELGISGAAHAWIASYLTGRSYQVAWRESVSAPRALTTGVPQGSVLGPLLFSLYTKSLGSVISSHGLSYHCYADDTQLIFSFPPSDNQVANRISACLADISVWMTDHHLKLNLGKTELLFLPGKDCPFHDLAITVDNSLVSSSQSAKSLGVTLDNTLSFSTNIKAVTRSCRFMLYNIRRVRPCLTQEAAQVLIQALVISRLDYCNSLLAGLPACAIKPLQLIQNAAARLVFNLPKFSHVTPLLRSLHWLPVEARIRYKTMVLAYGAVRGTAPPYLQALIRPYTQTRALRSSTSGLLASLPLRKHSSRSAQSKLFAALAPQWWNKLPHDARTAESITTFRRHLKPHLFKEYLG

SEQ ID NO: 2367 - protein, 1230 aa, synthetic construct
  source 1..1230: note = Description of Artificial Sequence: Synthetic polypeptide
MLAGVPTLVVFFQYAMAQSRKRKHTGSDVSRVNKVRVCELGRGSHSESLLQSPLATGGESSTNPSLATAIQIPRVGNGSPHQSPTSQSVSLETQPETTKAGKPRQRMKWTTDMNEFIMRTYYTITKLETDITGYRRELYDKFTSRYPNITVTEQRIADQRRTIIHRNLIPHSTLESIKTQVAQQISQHETDSHTQIEHDVEQTPEITYIDDNTQPINNTDTDLINKLTDTLQETLTKFTGTDPTQRPRIPKLHNSQQLNNTLHCMNTHILPKLINAETTLIEIHTLIYAAAVTVTTHLGLKTLPNKIGTNTKHHLKPAWQKRLEKQINEIRTELGRLTQYTKNNTSTKLMKSIRKIFRKLKTHTRHENHNTHIKEYIDTLKQKLAAKSQRLKRYKTSLARKLDNTLFTNNEKTFYRNINTKDPKQTQNREIPTQQSLTSFWSALWAVPVTHNQRASWIAEEETRTLDVPEMPYTTITTEELTNTIRYTHNWKAPGVDGIQNFWYKHFTCLHDLLAKHLTHLIHEPKDTPSFLTHGITFMKPKSTNTGNPSQYRPITCLPTLYKILTSCITNKIYAHIEENNILTEQQKGCRRSHMGCKEQLIIDTTILKQVHRQHRHLHAAYIDYKKAFDSIPHSWLIQTLQLYKINTKYITFLQNIMQHWRTTLHITINNNHVATEPIHIRRGIFQGDSLSPLWFCLALNPLSNKLNTSNCGYDIRQNQTTHYIHSHLFYMDDIKLYASTQTQLQQLLQITHTFSKDICMEFGLDKCKTLHIEKGVLKKGGFTLENGDTIESMEEGEVYKYLGFQQARLTEQKKTKQTLSKLYTNRLNNILKTHLNGKNTVKAINTFAIPILTYSFGVIQWTRTELESLQRKTRTTLTKYQYHHPKSAIERTTLPRKEGGRGLIDIPHLHDRQIYNLREFFHKKQHTSQLHKAIVLADRNITPLNLQNNTPCQIDNTAHIQEKKTSWCKKELHGRHPHDLQKHFIDAKASNSWLVRGDLFTETEGFIIAIQDQVINTKNYRKYILKDSTLTNDTCRKCHIAPETIQHITSGCKLLAQTDYLHRHNQVANIIHQKLATKHKLINTLTPYYKYIPDTILENSTHKMYYDRTILTDKTIHHNRPDITLIDKQNKVTYIIDISIPDTHNIQDAFTQKISKYTELSQEIKRLWGMQKVVTVPIILSSTGVIPHTLHKSLKTLDLHPKTYITLQKASLLNTCNIVRKFLSTDTDS

SEQ ID NO: 2368 - protein, 731 aa, synthetic construct
  source 1..731: note = Description of Artificial Sequence: Synthetic polypeptide
MEFLVDDLSILAPLGKSDHAVLSFSFVSKTELRYPTSNKRWNFKRLNVLALQDYLQQVDWDVHPQLEVDAHWDFLLHTILCATEHSVPKMVPKSYKQPPIIKNRTRRLLSRKRHCWAEYKRTDNNGAYRQYKHIRNICTKAIREDRLQFQTKLIDKFVSNPKSLFSYAASLRQGKTGVSQLLGPNGPTNNDSDAANLLAEQYSRTFQLTHINHTDESFTCTCTGLSEVDLSADLVLRKLQHLRKDTSPGPDMVHSAVLREAASILATPLSVMFAHSLSRGKLPEIWKLAHITPIFKGGRRSEPSSYRPVALLSIPSKIMESLVYDGILEYLSSSKFFSPQQHGFRKGHSCMTNLLTAVDRWTTILDRKGKVDVIYLDFSKAFDRVNHACLIKKLGRLGIKPPLIDWLSSYLENRHFKVRVNFTLSQAMECPSGVPQGSILGPLLFLIYINDLPQQVSSDLLLFADDVKLWREIRNHNDILVLQEDLTRLQSWADDNGLTFNTSKCKVVHLRHVADYSYNLGNSPLEVSQVEKDLGVLVPYDLKSYANCDKNASQANLALVTLKRIFGQFDGRTFHIIFNSFIRPHLEYGNIVFPPSLQKDKDTLERIQRRATKSVRGLKFKPYEERLKSLNLYPLEYRRLRGDLLMTYSILNTSGHPLKHLLKLSHNTNLRGNTQKLETLHSRTDCRHNFYSVRVVKCWNSLPTELVQATSQESFKRKLDLFLRTKDNILL

SEQ ID NO: 2369 - protein, 1449 aa, synthetic construct
  source 1..1449: note = Description of Artificial Sequence: Synthetic polypeptide
MQQKQNIPITCTSCGMFRFFTQKLDNYICSKCKQMTLMEQRIQQLEHRIKTLKDIQALELFLDTAQHAAVDQQPASHQHHQDHDQEPYGEINSKVDNPQAWKEVTHRRRRRTRQPPQNSSAQLHLHNRFEILTSLTYNQETHLVEDHSFLDTTQWTTLDQCAGDSPDGDSASPQSHLCNHANAPSPIIDQEQQEHPLGETRSNRNIPWESNGLSDVSQWIVIDECTGDVEEEDNTLHLHDSLQQEHSSGDIHTVLHKRDPVNPQRKQVLVVGDSLLRGTEAIISRPDGMARETCCLPGAKIHHITQRLSRLLKPHHPPHLMLIHVGTNDTARHTFQKITNDFRALGTKLKLYNVHVIFSSLLPVVGHGSTRAGKIVQVNNWLRKWCQEEHFGFLDHGLLFQEDGLLASDGVHLTQVGKHLFAHRLTNLIRRTLNPWSTLPRGWTTGKRWGASHTSRKTSFCTQTHKPHQAHFKLDPLGEGNNSLANTILPTTTGNRRKAKRRAAQTQQGPSTESTIIPNKQFEGRSQGLTCLYTNAQSMGNKQDELQLLAQHHTYDVIGITETWWDDSHHWNLTIEGYNLFHRNRTKGRGGGVALYVKNSYVAEEMQDCNPGNQLESIWIRIKGTGTQKDLVVGVYYRPPSQDEGLDEAFCQQLTKQAQRRDIVVMGDFNYPDICWKTNSAKSTKSNKFLTCLADNFMVQKVEEATRGSATLDLILTNVEDLINTVEVVGSLGASDHVLLQFAIQRNAETKTSQTRILDFKRADFQKMKELLSGIPWTPILKNKGVKDGWEFFKSEILKAQMQTVPTKKKNKTSAKKPEWMSKELLTELKLKSDMHKKWKRGEITKEEFKRIANTCREKVRKAKAQNELRLARDIKNNKKGFFAYVGRKRKKKEAIGPLQGEDGVMATGDREKAELLNAFFASVFSEKESHLQPQQHGMDEGLGEIQPQIGKQVVQEHLASLNEFKSPGPDQLHPRVLKELAEVISEPLAIIFESSWRTGEVPADWRRANVVPIFKKGKKNDPNNYRPVSLTSIPGKILEKIIKEVVCEHLETNAVIANSQHGFTKNKSCQTNLISFFDRVTSWVDTGNAVDVAYLDFSKAFDKVPHDLLANKLVKCGLDKTTVRWICNWLSERTQRVLTNASSSSWKEVTSGVPQGSVLGPVLFNIFINDLDEGLEGTIIKFADDTKLGGIANTPEDRSRIQNDLDRLERWAKTNKMKFNRDKCKILHFGRKNGNQRYRMGDAWLDSSVCEKDLGVLVDNKLNMSQQCDAAAKKANGILACINRGIASRSREVMLPLYSALVRPHLEYCVQFWAPQLKGDVDKLESVQRRATKMIKGLENKPYEERLKELGMFSLQKRRLRGDMIAMYKYVKGSHREEGASLFSAALQTRTRNNGFKLQERRFHLNIRKNFLTVRAVRQWNSLPGAVVEAPSLEAFKQRLDGHLSGVL

SEQ ID NO: 2370 - protein, 832 aa, synthetic construct
  source 1..832: note = Description of Artificial Sequence: Synthetic polypeptide
MDIVPKGLKVNNPLRSTYFTDYSERLCLTLSKKLRNHLISILYKKQKTIKNDISNLDRLISRQTSTPTDTLQDFCSTRQEIYYTHFYSLQQRKDNKFSNLLHTTGYNSNCLNPPDNIVNLSSYKLNPAEESVLSRGLSFCPTSPTNWIQFCGDLEAFFRRLRLREYFQTTTEHQSDLPDPPYQHQRKNNSIWTPPDGRNYNLDFYIHSFRNNAQTDIIRKRQQATHNLSRAEHHAIQSLKNNLDIVIKPADKGGAVVIMNKADYNQEATRQLSNTTFYKPLPSDPTLDYQKKLHCLLKSLPTATREQILTESPSDPRPGLFYLLPKIHKPGHPGRPIISGIGTLTTGLSSYVDTLLKPFVTNTPSYLRDTTDFLRKLQNIDNLPNNTILATMDVEALYTNIPHEDGLQAIRNTIPEDTTANLIADLCNFVLTHNYFRFENNLYLQISGTAMGTRMAPQYANIFMADLEQRFLNSRPLSPLLYLRYIDDIFMIWTHGQETLEIFHRDFNNLHPTINLSLDHSTREIHFLDTTVQINNGKLDTTLYRKPTDSYSYLHASSSHPEHTTRSIVYSQALRYNRICSNPTDRDQKLQDLYQAFINLNYPPRETKKQIERARRIPRNHLLQDRPKKTNNRTPLVITYNPQLKPVQHIINKLQPILEQDTILKEALGDRPIVSYRQPPNLKMILTNHHRTYHTNTNPGTFPCNKPRCQLCPHIHSADTIIGPNQVSYKIKNTYSCASRNIIYAIMCRKCPSAMYIGQTSQTLRQRINAHKTDIRQDHKEKTVSCHFNQKGHSLNDLATCILLQRPFTSALERESSELSFMLKFDTYQPGT

SEQ ID NO: 2371 - protein, 723 aa, synthetic construct
  source 1..723: note = Description of Artificial Sequence: Synthetic polypeptide
MTLGRSSMIDFVIVSSDLRPYVLDTRVKRGAELSTDHYLVVSWLRRWGTWSLSGPCSVPPLSRRPIGAVAARLSVPVAAATLEPAGGHLLVRDAVRLKKESYRAFLACGTPEAADGYRRAKRHAARAVAEAKTRAWEEFGEAMEKDFRTASRRFWSTIRRLRGGKRCSTNTVYSGDGVLLTSTRDVVGRWAEYFEDLLNPTNMPSTEEAEPGDSGLGSPISGDEVAEVVKKLLGGKAPGVDEIRPEFLKALDVVGLCWLTRLCNIAWTSGAVPLDWQTGVVVPLFKKGDRRVCSNYRGVTLLSLPGKVYSGVLERRVRRIVEPRIQEEQCGFRPGRGTLDQLYTLGRVLEGAWEFAQPVYMCFVDLEKAFDRVPRGALWGVLREYGVPGPLIRAVRSLYDRCQSLVRIAGSKSGSFPVRVGLRQGCPLSPILFITFMDRISRRSQGVEGIRFGGLRISSLLFADDVVLLASSDRDLQLSLERFAAECEAAGMGISASKSEAMVLSRKRVECLLRVRGGVLPQVEEFKYLGILFTNGGRREREIDRRIGAASAVKRALYRSVVVKRELSQKAKLSIYRSIYVPTLIYGHELWVMTERTRSRIQAAEMGFLRRVAGLSLRDRVRSSVIREGLRVEPLLLHIERSQLRWLGHLVRMPPGRLPGEVFRARPTGRRPRGRPRTRWRDYVSRLAWERLGIPPEELEEVAGEREVWASLLKLLPPRPDLG

SEQ ID NO: 2372 - protein, 908 aa, synthetic construct
  source 1..908: note = Description of Artificial Sequence: Synthetic polypeptide
MVMVNKKWNIKNSKKITFSRAEAVQIDIENEKEQIQILAVYRAPQGNIAEFIDDIDNWIKVENSKNLIITGDINIDITKQSNLVDKYLNCLAEHGLQSMIKDITREEILGLQLTRSCIDHICIRSKKYCKAHVIAEKLADHYFVGIAIPELGIPESERDQVTTYINNAKVDKYVREINWESIANEEDPEIIYNKIKNAFTDIYKKSSEQVTVKKRKTGNQWVTKEIDQLIRKKNKAWRLLKSSPESSQRKEEYRSIRNKVTSIIKKEKRNYFWKKFEDTKDPSQCWSVINQVLGRNTRLSIDQTIKKNFGTYCNDEKIANDFNNEFIQSIELLCNHGYQNETETRARIGNSMYLPEMTEEDLVEIVSNMKTNKAVGIDSIRPRDIKENVNIIKTVLLALYNKSLAIGKVPSGLKTAVVRPIYKKGDKKTLLNYRPVCILPVLNYIMEKYVHKALNGFINKYNLLTKTQYGFKTNSSTITLLEDFSDFVNKKLDEGNYVLALFIDFSRAFETVRHETLIDRLFSLGVRGKLLDWFKDYLSGRTQVVKIASSFSEKRLVKQGVPQGTVLGPILFNIYINDIVNVHLNSVLFQFADDTVILYADKDYTTAENKIQEDVYKLVKWYKENQIIINTKKTELMCFRSPQRRTQMEGNIKIHSDSCKNCNCEPLKLTTSVKYLGLYIDEHLKWNQHVEHICKRLRSVAAQLYHLRSCLPQPILKMIYHSLGKSVLVYGITIYGHCAKYLQDKINSILNKVVKNLYVDENRPLHYMYQHLDIQKLSDLLELNIIIQHQFSDKYKTKYIPIRNLRPKNLFQEPKVKTKYGKAVRASYVPRVFNKLPPRIIEITKISELKRELKQWFINRKELQLAEEKSTRGWNLNCVVLCVLFCRELWSKGVYMSCFHFFFLFARN

SEQ ID NO: 2373 - protein, 1108 aa, synthetic construct
  source 1..1108: note = Description of Artificial Sequence: Synthetic polypeptide
MTSPGQTPIGGARRLNLYPRGSSRNNEKPLRVATWNVRTLTAEERLPLLCRELDRYRLDLCGIQEVRWTGSGSCHHEGWTVLYSGQQTAKQQGVALLLNKRMKGAWERGGEVWEAVSPRLLWARLPINRRRGMVVVVTYAPTEDEHPWRDAGKADESDAFYDLLSQVLAKVAPRDRVIMLGDFNARVGHDAGTWSGVIGGHGPDQLNNNGRRLLDFCAAHGLVITNTLFRHRRIHTTSWMHAGSKQEHLLDYIVTDQRMRAHVLDTRTYRGADLPSDHRLVICKMRLPFFHSGGGCTPRTPFQPKVAWSQLSDESCKREFHHRLRLGLASSPTPPDVEGKWARFRTVTHAAAMAALGTRSRPPQRPWLTEEVFRMVEKKRQAHCHRLQNPTSENEEAYRSLRSEVRRAVRRCKDGWWSRVAEEMESASVARDHKSLFNSIKKVTCSATPITIIRGKNGDPISDPQEQVCRFAEHFCEVLGEGKSLSQENIVAQSEDDPAEAAVPQILEEVTPCEWLAEVPSVEEVLKAIRSLRPGKAAGRDDLPSEMLREGGVCAQTALYDIITTVWTTGRVPQDWKDALVVPLFKKGDRTDCNNYRGISLLSVPGKVLARIIQHRLARHAEERLAEPQCGFRKGRSCTDAIFSVRLLQQRCREFQQDLHLCFIDLVKAYDTISRPGLWVVLRAFGVPDPLLTIIKDLHDGERARVKLRGRESEPFPVHLGVRQGCPLAPTLFNIYFDHVVREAFNSCTGGISIWYRYNGRLIDARVRSRDGSLLLNHVMYADDLVIAAHSEEELETLLLRLERATKRWGLTISPTKTKHLPGYFVPSDTPPPQLPIGDGAVVERVESFPYLGSVLMTGSSLTAEVSLRISRAAISFHRLRNAVWKLPGLSLRTKLQVFSATVIPSLLYACETWTPLMEHLRRLETFRLACLRSILGLTRLDCVRSSQILERSGQGPIGELLRQARLRWLGHVARMPSHRMPKQLLFGRIEGAKRARHGLEKRWSDVVQEDVELSGLADDWYQRCQDRPLWRRLVKDATGQLEAVALQQQRRAEERRSQQRAERRVAKAQQVGTVGGTGGASASHLSQSTRGTWVCPVTSCQRAFDTS

SEQ ID NO: 2374 - protein, 840 aa, synthetic construct
  source 1..840: note = Description of Artificial Sequence: Synthetic polypeptide
MIAVLSKYIVRKVFYWRYRLIKSLPNLFNYLFINHAAAVPIFKRFMKVYNSLKRKELDISFLETCLEEKMIPSFIYKMKLSDCLSSKDVQLIHRRTLRRMLESEKIRRTSIDKKLTNIGLMLNNATNEFCLQVCVEWCIKNSIVQIKSKENAHIKKLINLRKIFGISKFSVENTVINLSKIVLNDDEERVLKFGPNHCIKNRLDETKLCAKIESLYFHIARSMKGINGNYVKSSLSASTMEYIDKNKKQNIRDFMTLKNLAKKNINICKFDKGNGIVILDHDVYVNKLNDLLNSPQFVKLPKGRKNGKLPPLKDEEFVQKMLNGFIEKKLIDEEVGKSIRPIGSQPAKLYGLPKIHKDGVPMRPVLSMVGTAQYKIAKFLDGLLKPLMRSEFECKDSFEFVSCIAKLQKRSMNDVMVSFDVCSLFTNVPLVETIDLCCALWNENDSEHHILDRRAFRKLLEFATSNVNFLFNDEWYQQIDGVAMGSPLAPTMASIFLASLEKKIASFQFEKPFVYKRYVDDIFLIFENQKHVEPFLQFMNSLHKNIVFTCETERKSSIAFLDLLIQRKDKQYETEIYRKPTDTGLYTSPESFCEFKYKRNMVKGLIYRSWALSSTFANSVKSVDKLVELLIKNGYSKSFLLLMIKETVDKLIKNPKDPCCGKSECNLSDGCELSVDLGDCKNGYKKIEPKYVLVLPYSEGFTNYKRKLGKLIGNLEYKIVSNSCKVRNMFINKSKTPVGLCSDLVYQFTCNGCNATYIGETSRHLCTRVLEHCRLKGLTNISEHNRGCKSDIGMSDFRILLRSFNSYWERVICEALLIRSLDPKINVQSAVTTNVLNVFK

SEQ ID NO: 2375 - protein, 284 aa, synthetic construct
  source 1..284: note = Description of Artificial Sequence: Synthetic polypeptide
MRKKLKELKEEIDSKTILVGDLNLPLSELDKSNQKINKKEVREVNEMLEKLELIDIWRKLNRDKKEYTFFSAVHGTYTKIDHVLGHRNIANKCRKAEIINATFSDHNVIKIIINKGPWKGKFKINWKLNNLILQNWWVKKEIIETIMDFIKENDNEETTYQNLWDTAKAVLRGKFISLSAYINKIEREEINELGLQLKKLEKEQIKNPQIKTKLEILKIKGEINKIESKRTIELINKTRSWYFEKTNKIDKVLVNLIKKRKKRIKLTVSKMKRVISPLMKRKLR

SEQ ID NO: 2376 - protein, 776 aa, synthetic construct
  source 1..776: note = Description of Artificial Sequence: Synthetic polypeptide
MNRLYGEGFHITLRSFNKLRDKKAQLIESLTFLKRCRDSGVIPIAFTLTSATVTSSNAKRILFKTSLALISEKIRLIRTELDQLDKTLYKSHLSLTAIMSTSDWEHVDNMTASSAATMSTKCKENLISKFNLLFNKRPDPHTKKLDVNKVVINRSNSSISDGLKSVLAKGLNFAVTPKHIPVNDIIAQVDVALRGLGHIAADVARSEIAATLKNAKMPASNLSKDERFELYKLKKRNDIVVLSADKGNATVIMDKIEYNNKIKELLDDGSYTKIKRDPTNSLVTQTNKIISDSTALIDQSKQFSLKPSAARPPRLYGLPKIHKVDTPLRPIVSTISSPTYKLARFLSEILRPFTGKTTSAVQNSTHLVSTIKGISLSPDDLLVSFDVVSLFTKVPVPDTIAIIEDLVHQGLNTEVPPLVRHCLTNTYFTWNGTFYKQTEGTPMGSPLSPVIANIFMEKFETDAIQTATLRPTLWKRYVDDTFVIWPHGRPALDQFFDHINSIHPAIRFTMEVEIDGKIPFLDVLIKKRPDGSMSHSVYRKATHTDAYLKPDSHHHPSQKNSLIKTLYHRAQCISDQEHISSELKHVHQALRANGYSDYTIRKAITQTMKKNPLEEPFKTITLPYIAGITKKISKILNKHKIQVRFNTLHKIRDLVPSVKDVIPDIQYPGVYKLSCLCGSSYIGETKRHISDRIREHKADLKHGRTNTSAVADHCSNSVGSHAIDFSKTEVLCKPSGFHERFVHEAIHIYKHRDNFNREDGFYLSNHWKDLINHFSS

SEQ ID NO: 2377 - protein, 788 aa, synthetic construct
  source 1..788: note = Description of Artificial Sequence: Synthetic polypeptide
MNHCSHESFKSKFNRLYGEGFHTSLRSFNRLRDKKAQLIESLTFLKRCRDSKVIPTAFTLTSAVATSLNAKRILARTSFALISEKIRLTRTELDQLDKTLYKSHLKLTATMSTSDWEHVDNMTTSSAATMSNKCRDNLISKFNHLSSKKSDPHTEKIDVNKVVINRSNSSISDGLKSVLAKGLNFAVTPRHLPVNDIIAHVDVALKGLSHISADVARSEIAATLKNAKLPPSNISKDERFELSQLKKRDDIVVLSADKGNATVIMDKTEYNNKIQELLNDGSYTKIKRDPTNSLVTKTNKIISDSTALIDENKQFSLKPSAARPPRLYGLPKIHKEDTPLRPIVSTISSPTYKLARFLADILRPFTGKTTSAVLNSTHLVSTIKDISLSPNDLLVSFDVVSLFTKVPVPDTIAIIEDLVHQGLHTDVPPLVRHCLTNTYFTWNGTFYKQTEGTPMGSPLSPVVANVFMEKFETDAIQTATLRPTLWKRYVDDTFVIWPHGQPALDQFRDHINSIHPAIRFTMEVEKDGKLPFLDVLIKRRHDGSMSHSVYRKATHTDAYLKPDSHHHPSQKNCLIKTLYHRAQCISDQEHITSELKHVHQALRANGYSDYTIRKAITPVMKKDPLVEPLKTITLPYIAGVTKKISKILNKHKIQVRFNTVHKIRDLVPSVKDALPDIQYPGVYKLKCLCGSSYIGETKRHISDRIREHKADLKHGKTNSSAVADHCYNSVGSHDIDFSKTEVLCKPTGYHERFVHEAIHIYKHRDNFNREDGFRLSNHWKDVLNHFCS

SEQ ID NO: 2378 - protein, 697 aa, synthetic construct
  source 1..697: note = Description of Artificial Sequence: Synthetic polypeptide
MELDTLDRTLLQAHLMLTQKMSPDWNHVDNMTASSAESLSVKCKANLISKFNHLSKKNPVPHITKLDVNKIVINQSSTPISDNLKTVLARGLNFAVTPKHIPVDDIISQVDVALKGVGHIQADVARAEIATILKNAKKPISNISKNERSELANLKNRSDIVILSADKGNATVIMDKDSYNNKIQNLLNDGSYSKIKNDPTNSLAIKTNKIITSSTSLIDPTKRPSLKPSAARPPRFYGLPKIHKEGTPLRPIVSTINSPTYRLARFLSDTLLPFTGKTASAVLNSAQLVSMVKDVVLSPDDILVSFDVVSLFTKVPVPDTIEIIENLVQHGLDPDTPALVRHCLNNTYFTWNGSFYKQNEGTPMGSPLSPVIANIFMEKFESDAIQTSTLRPSLWKRYVDDTFVIWPHGLPALNLFLHHINSRHPAIKFTMEVEKDGKLPFLDVLFERRPDGSLGHSVYRKPTHTDSYLKPDSHHHPAQKNSLIKTLYHRAHCISDQHHLTSELKHVHLALKRNGYSDRTIRQAVSPSIQKQPLDTPVKTITLPYIAGVTKKISKILNKHKIQVRFNTVHKIRDLIPSVKDVIPDLQYPGVYKLSCTCGDCYIGETKRHVSDRIREHKSDLKHGKTNSSAVADHCYNAVGDHDIIFSDTKVLCKPTGFYQRFVHEAIQIYKHRHNFNREDGFKLSNHWKDVLNRTKH

SEQ ID NO: 2379 - protein, 334 aa, synthetic construct
  source 1..334: note = Description of Artificial Sequence: Synthetic polypeptide
MGSPLSPVVANVFMEKFETDAIQASTLRPSLWKRYVDDTFVIWPHGLPALNQFLNHINSIHPAIKFTMEVEKDGKLPFLDVLIEKRPDGSMGHSVYRKATHTDAYLKPDSHHHPSQKNSLIKTLHHRARCISDHHHLASELEHVHQALKMNGYSDYTIRKAITPTVGKEPSEDPIKTITLPYIAGVTKNISKIMSKHKIQVRFNTVHKIRDLIPSVKDVIPDMQYPGVYKLSCVCGSSYIGETKRHVSDRVREHKADLKHGRTNTSAVADHCFNAVGSHEIDFSKTKVLCKPTGYQQRFVHEAIQIYKHRHNFNREDGYKLSNHWKDVINQFKS

SEQ ID NO: 2380 - protein, 719 aa, synthetic construct
  source 1..719: note = Description of Artificial Sequence: Synthetic polypeptide
MPIKMVRPRRLMDPDGFLRSLGDLPASSRGDPVDALVTRYNSEMARAIDTIAPERPLSLRRAKPAPWFTEELAVMKRERRGLECVWRKLRSESDRARAKALRKAYSVALRAAKKSFQTARIAAAKNRPSELFRVVGELLNGTPQTGPPDDLAENCAAFSHHFADKVAQIRSELDATVDAVSEEVARAPVCPILMDSFQLVQPDDVDKILGEVRATTCALDPCPSWLVKEARGGLVEWVRVVINASLREGIFPSCLKQAVVKPLLKKPSLDPTNWNNYRPISNLPFLGKVLERVVASQLQGFLDDTDFLDPSQSGFRPGHSTETALVALVDDLRRELDRGSVTLLVLLDISAAFDTIDHGILLGRLLGMGLGGTVLQWLQSFLEGRSQMVKLGDTCSDPWPLTCGVPQGSILSPMLFNIYMKPLGEVIRSFGVRCHLYADDTQLYYSFPPASKEAPQILNQCLAAVSDWMRANKLKLNPDKTEVLLVSRKSDRGIGWQPVLDGVALPLKAQVRSLGVLLDSSLTLEAQVSAVAGRAFAQLKLVRQLRPYLVKSDLATVVHALVTSRLDYCNALYVGLPLKTARKLQLVQRSAARLLTGANYRERTTPLFKELHWLPVIFRAQFKVQVITYKALNGLGPTYLSDRISPYEPARRLRSSGEALLSVPPPSQVRLVGTRERAFSAVAPRLWNSLPREIRQAPTLLSFRKQLKTWMWDQAFGPS

SEQ ID NO: 2381 - protein, 846 aa, synthetic construct
  source 1..846: note = Description of Artificial Sequence: Synthetic polypeptide
MSASLPPANAGGDGNWFDMKRDYQFSSQDEHNRNNIPHISLAPTREDSIQMCTIAAKIKNHQTINIGAIYCPPAHEWIDTQFKQVFDSLGSRFIVAGDWNAKSQWWGNARSCRRGAALLKCIQENDQSILATGSPTHFPSNRRHMPSAIDFAVYKGIRHNLIHIETSYDLGSDHNMQIIKLLLRPEYGKKKILLPKNANIRRFQAHLEQRIHLETELHNGDDIDDAVAILEKNIYIAAELASQTSSNQHTVYGPQNFHLDSQTLKAIKIKRILCKINQKDRCSNPLIARTINQLTNRISKRIKLQKDKQMNRLLHDIDPTDRYSMQKLWRLTNTIKRQPIPNLPVRRHVAEGQQAPADPWCKTTEEKAEAFAQHLEARFTPKITAALEDREEINAVLQENGPDEAAQIIRPVTIQELKSEIKKLKTKKAPGLDSIDNRVIKSLPTSAIEYLLLICNSALQFGHFRKSWKCAKISMLRKPGKPSDRLESYRPISQLTGFSKILERLILKRLFEEESFAMAIPNHQFGFRSQHSAEQQIGRVTQFILRSYEAQRHCSAVYMDIQEAFDRVWHQGLLCKVKTIIPDNLYILLTSYLSDRSFHVVCCNNITSSLKHITAGVPQGSVLGPVLYNLYTADMPQPPRHANSTQMLATYADDAVYLVSALSPKQANENVERLLADALSWSKKWGITISLAKTAHVLHTLSPVQQHTPAPRLAGQLLAKKSVMPYLGIHMDTKLNFNKHVAAIVTKTRARIKKLDWIIGRNSKLPLPPKVLLYKQLIAPIWQYALPVWGPLTSSMQMAKLQTIQSKALRAMTNAPRYVSNNALHADLQVATVEEVYNRLCRNCYT

SEQ ID NO: 2382 - protein, 1284 aa, synthetic construct
  source 1..1284: note = Description of Artificial Sequence: Synthetic polypeptide
MKMSHNRDTPSNGVKGTSVRLGTSLVRSPVGEAGAVRERGTHPSESVSQDSDASVNATGEGSVREQAPLSPPGAEEATVPTQRRTRHKWSKEDRVVLWECFVASKREGPGYLKRLKQLWDERGIPGNFPQASLSGQIRQICSKNLLSEEERLQIAARMEAQVASPSADEPARQVPTRPVTPPRSPPVEPARRPSIPSEETPDLGAVPSEIDSADPNRSPSRGPRHLPAHNMSQSESEDDVTDPDVSDQQRSDSLEPRDLLRNSSVESTPGHPNQELSDTLLSNYVPSEIDSDDPNQSPRRGPRHLPAHDMSLSDSMDEETEPDLSDQQRSDLLELRDLLRNSSVETTPKGHPSLRHLPEPKIRAAAFRVNSVIGKIHTNNITETNALIKAGADLAVRILEVQPRPQRTQRKKDPPWKHRLEKNIAEIRKHLSWISEWRRGNLHDEEKKTLLESRYRCLEVGLTNLEDTLKQRLSAKRSKVRRFEARVAGFHQNQLFNTNQKRLYQTLRGEETSSDSPNAEESIRFWSDIWSKEVRHNNAAEWLHDVKEKNVAADPDLTITSQQLKKQLSKTKNWKAPGPDMVQGYWIKTFTSLHSRIAAQLNHCLQRGTVPTWMTTGKTVLIQKDKAKGTEVSNYRPITCLPLMWKVLTGIIYERVYQHLDSKKLLPDEQKGCRRNTRGTKDHLLVDKLLTKDARSKKKNLSMAWVDYKKAFDMVPHSWILECLDIYGIAGNIRNLIATTMPNWKTQLTSANKHLGEVSIRRGIFQGDSLSPLLFVLTMIPLSETLNKAGQGYNYSRTMKLNHLLYMDDLKLYAKSKDQVEQLLNIVHQYSQDIKMQFGISKCGVLNIERGEVTASEGIIIEEGTIKDIEETGYKYLGVMEYNTILHRTMKDSIRKEYLTRLRLILKSHLNGGNTIKAINTWAVPVVRYSAGIINWTKKDCTDMDIKTRKLMTIYRALHPRSCVDRLYINRREGGRGLISVEDCVEAEKRALSQHFRESDDPWARCLIEAKLLKETETADQFKERRRLDRTNKWKSMKMSGQYLEAVQDKIVPDSWNWLLRGELKRETEGTILAAQEQALRTRYIQNKIDKRNVPSTCRICRSSDETINHVISECGVLAQKEYKRRHDKVARHLHWTLLRIHNFPVSERWYEHEPAPVVENEAVQIYWDKRMETDRVLHANRPDIVVKDKQEKSAKLIDVSIPFDSRIIDKEAEKKEKYRDLAIELQRLWQMKVDVVPVVIGALGAMSKNLKTALRELKCGHLHPGTLQKSALLGTAHIIRKVL

SEQ ID NO: 2383 - protein, 550 aa, synthetic construct
  source 1..550: note = Description of Artificial Sequence: Synthetic polypeptide
MNELIAFFKISVQNVCDQGSCYSSHQFTAQGVRSAVSKLKDKSDCKDNFMSNHVIHGGDTLFVHLSFLFNCMISHTCDPKQLRMSVLIPIPKNRRKSLSVSTNYRSIALSSIVGKVFDRMILTEHVNIFSTSNLQYGFKPKHSTVQCTFVLQNVINHYKSRGSPCYVMLLDASKAFDRVQYVRLFYLLRERGLCARIFMLLALLYTNQSMCVRWKNCISDNFSCSNGIKQGGVLSPTLFCIYFDELLIRLKHCGSGCHLGHLFTGALSYADDVALLAPTLTAAKVMLNVCEQFANNFNVLFNADKSALLVCGRPIRKEVNLRLNGRIIQQNSTAVHLGTTIGDNSSTRNVKKAASDLYCLTNVLMCKFGHCSIDVLSALFFFFFFYCSSFYGCPLWDLRNIEPILTAWRKCLKRIWKLNIRTRTKYINNLPKGNLISALLIRSLSFYMQCLSSSNAIVKLASNYCFYGCMYSVISENVHLCSVLSSVPLRFIFDDFENVKSIIQRGMYDEATIAESLALKDLCYLRDGLMFLNFEITSEELLCAFNHFTI

SEQ ID NO: 2384 - protein, 1137 aa, synthetic construct
  source 1..1137: note = Description of Artificial Sequence: Synthetic polypeptide
MENQTQTKSILARSSPRIKRTAVDAADSGHPSTSGLRNHQNPNEQSQKRQKYTMPENRTIMKCYYKSEPQRRGYQKRMHQLWKQEYPDSQITEPRLADQRRFIIRNKVFSEVELEEIQKICKVNYHQTTAQTAAETPATLGMVEQIEPEESVELLQEFEEPALETSVEPPGTLTARQQELKDKIMAHAAANAIRKRLPTLKTVPKRHLAPLMKDVNAALSTVQITSIEQTNQYAYSAAVIVTEELGLLQPRQPQRKSTGKPKWKVRLELKIKKLRSDASNLKNMKEKKLKNDKIKQYLIRKYWLNTRKIEEALEIVKEQITATARKIERYEARIIQYRQNQLFQSDQRRFYQSLNQTTDTVTIKPEKTATTKFWKELWENNKNYNKNAGWIKEFEGKFSQNKMELMEITTEMISKRVQKVKNWTSPGSDQLHGFWLKHLISLHGKMAQQFNEMLQKGSISEWLTTGRTYLIQKDPAKGAAPGNYRPITCLPTMFKLLTGIIADRIQDYLEEKNILPDEQKGNKRKSRGTKDQLLIDKMILENCKSRKANLHMTWIDYKKAFDSLPHSWIIKCLDAIGICKNVGTFIENMMEHWKTELFVGNESYGLVNIRRGIFQGDSLSPLLFIIAMIPLSTILQKTNLGYQTSKNSHKISHLMYMDDLKLYGKTETEIQSLTNTVRIFSTDINMEFGLDKCSTVALKKGKIIESEGINMPNGQTIKCHQPEAYKYLGILQLDNIKHEHVKTVVSKEYTQRVRKILKSKLNGGNTIKAINTWAIPVIRYTAGIINWTQVELDNLDRKTRKLMTIHHSLHPRSDVDRLYLPRRSGGRGLLQVKQAVKEEEHALAEYVKQSEEPALIEVKNQKLLKTQQTKNQYKKTALQTRADSWHNKTLHGKFLDKIEGKADKEKTWLWLTNGTLKKETEGLILAAQEQAIRTNAIKAKIEKSADDPKCRLCKETDETIDHILSCCKKIAQTDYKQRHNYVAQMIHWNLCLKYHLPAAKNWWDHKPAKVLENEHAKILWDFRIQTDKVLEHNTPDITVVEKNKVWIIDVAIPGDSRIDEKQQEKLSRYQDLKIELQRLWQKPVQVVPVVMGTLGAVPKDLSRHLETIDIDKITICQLQKATLLGSARIIRKYITQS

SEQ ID NO: 2385 - protein, 1080 aa, synthetic construct
  source 1..1080: note = Description of Artificial Sequence: Synthetic polypeptide
MYSKRFQPSNETLAISHDVQPGCTPVSLVEASYPLVTVEPILPATSSHPGPVYEYGEEVFQTLFAGKYSCDSSNFSPVTSVASSDIPTRKSDTKSAAPDDFASDNPANRLPNVITDDLNNNQSCHALRFYYQNVRGLRTKVDSFFLAVSECDYDVIVLTETWLDDRFQNAQLFGSKIIVYRTDRNAANSSKRRGGGVLIAVSTHLNSFIDPTLTSIALEQLWIKISTPSRTISVGVIYLPPDRRDNMDYIRDHLNSMNSVLSNLALNDCVLQFGDYNQPNLLWEASDDGFLRVNSQSILSTAGSTLVDGFHFHGLTQLNGIPNRNSRFLDLVLGNDEARYSCNVTEAIEPLSDLDVDHPALDVILNLPDSITFEDCSDNSQMYDFRQADYAGIHAAISRIDWQPIDDANNIDDAVTYFNHVVQDIIAQNVPLCRPKPKPPWSNSHLRQLKRNRAKSQRHYCRNRSQFTKQEFNRASNAYRTYNRLLYRRYVVRTQTSLRRNPKRFWSFVNSKRKEVGLPRSVHLDGQTATSEQEKCFLFAQHFQKTFHDSPATADQIAAAIEYTPRDVFDFRSFTIDEQTIQAAFRKLKMSHAPGPDGIPSCILKNCSHSLATPLAKLFSRSLQEGKFPDEWKVSSMFPVYKKGDKKDVHNYRGITSLCSCSKLFEILINDALFNSCKSFISTAQHVFFPKRSVTTNLTEFVSLCLLTLDSGGQIDTIYTDLKAAFDRVDHGILLAKLDKLGVSHSLVRWFESYLTNRLLYVKIGSSQSESFTNLSGVPQGSNLGPLLFLLFINELSQLLPPGCRLFYADDVKIYMIIDSTADCELLQSRVNIMANWCSSNFLTLSVNKCNVISFHRRQKPIIFDYRICDTVLNRVDQVKDLGITLDQEMNFKPHYNDVIAKANRQLGFIFKLSDDFRDPLCLKGLYCSLVRSILEFSVVVWCPYQSCWIARLESVQRRFLRYAFRHLPWRDPLNLPAYEDRCRLLGIETLEQRRRRAQAVFAAKLIVGDIDSPELLRQLNIYAPEQVIRQRNFLQLVPCNRLYGMNEPLRASADALNEAFTAFDFNLPLISFIRRLSLS

SEQ ID NO: 2386 - protein, 1221 aa, synthetic construct
  source 1..1221: note = Description of Artificial Sequence: Synthetic polypeptide
MKANPAMETRSMRNRRMRSPEEGAPTGAGPGTGDRASGQRLEEDNVQERPSSQRAQPVPRTRNRNGSSRNHQGHAAPTDVAVADRRQSLTLAGGRRQRIMWTREMNMYVIRCYYVCTRMETDMSGRSGMLEMFNERFPRFARQLDLNKLYTRQRAIMSHNMLTAAEVEYIKLEVQREIGEEGTRSSDTSRRSSVGLDAPITSESRDSPAPTAPGPTADMQRQQLRDELALHMGTAVTQFRGTDPMSRHRIPKLRYSYRLTSAVSILNQDILPQYLEAVENLEDLQFIVYSAAIAVVKTLGLRTRPQGEDGTRPNAQKPVWMRRLESRIATLRSKVGRLTQYKQGNRSTRLVRHVAEIVRPAELRDLREVDITEILDTHVQRLSALAKRLRRYGECSKRKEQNRMFNINEREFYNRIRNDKVDFGEGLPEIGDVTQFWANLWENPTEHNGDGMWLAEEERQCDGIGDMTAVVVTAQDIREATRYTRNWAAPGPDFVHNFWYKKLTTIHGRMAECFNTVLGDPTQLPEFITRGVTFLLPKDQHTADPAKYRPITCLSSLYKVLSSVIARRVQAHCDANNVMTEEQKGCRRNTQGCKDQVIVDAVIVGQATQKQRNLSMAYIDYKKAYDSVPHSYLLKVLQLYKVDGNVIRLMQHAMGMWSTSLHITDGTAVLRSRTLSIRRGIFQGDTFSPLWFCLAMNPLSKALNQCNYGYQLKSGERSTRVTHTFYMDDLKLFAESVQRLHQLLQLVTTFSNDIRMEFGIDKCRSIHLRRGQVMDASCFRVNEQEEIRNMVEGETYKYLGFLQLRGIRHTMIKKELQEKFLSRVNCILKSFLSAGNKVKAINTFAVPLLTYSFGVVKWTKTDLEAIERAVRVAFTKHRMRHPKSSIERVTLPRAAGGRGVTDIQALCVSQIQQLRAYFVESQNRHEIYRTVCEADHGFSALHLAQEDYQLNCDIKTVDEMIAMWKQKELHGTHPHQLELEHIDKVASNTWLVRGDLFSETEGFMVAIQDRVIATKNYRHYILHEDVEDRCRKCNSVGETIEHVVAGCSVLAGSAYLDRHNEVAKIVHQQLALKHNLVDRFVPYYKYLPDPVLENSCIKLYWDREIITDVLIRANRPDIVVYDKRMKRVTLIDIAVPLDHNVQSTFSNKIAKYHDLAEELKQMWHLEDVRIVPVVLSATGIVPKSLLRSLDELELKKDLHSIQKAVILGTCSIVRRFLNHHN

SEQ ID NO: 2387 - protein, 1020 aa, synthetic construct
  source 1..1020: note = Description of Artificial Sequence: Synthetic polypeptide
MNQRHYCAKARSLPGSNAPYGSSTVSNEQEPLHRCPDVVLNEQGFSRFRERTRVNKLVHKVKGKGRSDRRLRFGTWNIGTLTGKSMEVVDTMTRRKINIMCLQETKWVGAKARELDTSGFKLWYTGKVKNRNGVGIIVDKQWKKDVVDVKRVGDRIISIKLVVEGGAFHVISAYAPQVGSDEQHKIRFWEDLESLVQGIPLGDKIFLGGDLNGHVGREVTGYGSIHGGHGFGVINAEGKTILDFSSTFDLLIANTCFKKRDEHLITYKSGMTSSQIDFFLLRRVDRKFCINCKIIPGESLTTQHRVLVMDFRVEQKLRKRHHTKNPRTRWWRMKGEEQRSFLRRVGEEAKWDGNGSAEEMWREMAEVIRRTAKESFGESKGIGPRDKESWWWNASIQEKIKIKRECFKEWSLCRNADNWEKYKAAKKETKVAVSEARTRAYEGLYQSLGTKEGEKGIYRIAKSRERRTRDLDQVKCIKDKDGEVLAQEEKINERWKSYFYELFNEGQKTLPSLGRLCTREEDQNFDYYRRIRDFEVKEALKQMKNGRAVGPDNIPIEVWKGLGEKGINWLTKLFNEILRSKKMPDEWRKSTLVPIYKNKGDIQSCGNYRGIKLMSHTMKLWERVIERRLRKETQVTENQFGFMPGRSTTEAIYLLRRMMERYRSNKRDLHMVFIDLEKAYDRVPREVLWKVLEKRRVRIAYIRAIKDMYDGATTSVKTQGGVTEEFPIGIGLHQGSSLSPYLFTLVLEVLTEHIQEPVPWCMLFADDIVLMGESREDLNKKLELWREALEVYGLRISRSKTEYMECKFSLRRENPNIEVKIGENILRKVKSFKYLGCIIQDNGEIEQDVNHRIQAGWSKWRSASGFICDKKVPLKLKGKFYRTAIRPAMLYGTECWAAKGEHEHKLSVAEMKMLRWMSGHTRLDKIRNEDIRERVGVAPIVEKMVESRLRWFGHVRRRPIEHPVRRVDEMEDGQRAKGRGRPKKTIHEVVKRDLHVNGLSVDMIHDRAQWRRLIHVADPT

SEQ ID NO: 2388 - protein, 1271 aa, synthetic construct
  source 1..1271: note = Description of Artificial Sequence: Synthetic polypeptide
MTLEEGNVRYGARPVRTHQAGAVPGPKPRRGPPQRLEGLPSSWSARRRGRKATGNTNTKQVKKSLNIMHWNAEGISNKKTELENFLKDNEIHISCIQETHLQEEASFKVRGYQCFRNDRQGRKKGGVLTLVRNNLNTVEIKKYTGEAEYIHNRITTSRGNLDLVNYYCPNDTNLVLETIEVPDTDFIIAGDFNSQSQSWGYNRLDRRGEEIEAWQDENHLLLVNDPLDQPTFYSRAWHSTTTPDLALCTENLHRHLSRKVETQLGGSDHRPVLLTIVESLPEDSPKRPRWNYKKADWRLFSIRTNELTKNIAVFGKNINNAIREFNENILKSAKETIPRGVRKNYTPYWTPELQKTHNDLIKAREEAETHPGRENNNKLQRCKAHYLKTKLECTRKSWRDKTHKLNLEKDTTKLWRLVKGLSDEGNKNDKISLEVEGEMEMEKRAAHTFVKAYAQESNIKIPRERQKEVRQEERRKRSTNNIPEAMEKDITMEELKKAINQLKQRKSTGPDEITNEMLQHLGNTALQTLLDIFNLSWKIGQVPQCWKEATMILILKPGKSKAQPLSYRPISLISCVCKTMERIIACRMQWYLETQHIIVPEQAGFRQFRSTEDQTIYLSQVIEDSFQAQKVMLATFVDLQKAFDKVWKEGLLVKLLRSGIQGNMYQWTKSYLHNRRARVLVDGYQGRKMLLRQGVPQGGVMSPLLFILFINDLMNELPKGIHAALYADDLVLWCSEEFVTTATYRMQLALDKLTTWTKTWCVTANKEMSSATLFTLSQAEPKHLTLDKTPLKFENQQKYLGIIFDKRLTWKQHIQNAENKARKKLNIMRKLAGTQWRANEKTLRQVYLGAIRPHLEYGSSAWMTAAQTHKYTLEKVQNQALRIITGAMRSTPIEKMEQKTSIVALQRRWECKALVQYTKATAMEDHILHTRTERSNTARLKRSNFIKESRKIQRSLQDHLPATVNMLNHTPEAPSWEKKNTNISIHTSIPMFTTKDDHSDLSKKSLTLSMLEERYPREAWIRIYTDGSATDAVKRGGAGVYVQFPNRRRQAEAVPTGRHCTNYRAETEALVQAANIIKNVVDPQSQVVFLTDAMSVLQAINSGKLPRLRKEIEDIPCLRIMLQWIPSHCGVLGNEQADRMAKLGAQKEQPDNSVNYTEIKTIINTLFKAPQTPDGYHELSRQEQVIIFRLRTQHTRLRQLMYKCFKIVQSPKCQCGEADQTVEHILQHCKTHRALRQETWPTPLTLEEKLYEPPDELTRTAQFMTDTGLQV

SEQ ID NO: 2389 - protein, 903 aa, synthetic construct
  source 1..903: note = Description of Artificial Sequence: Synthetic polypeptide
MGDMQRRVIGWWPINERMCKLRIKGRFFNFSIINVHSPHSGSTDDDKDAFYAQLEREYDRCPSHDVKIIIGDLNAQVGQEEEFRPTIGKFSAHRLTNENGLRLIDFAASKNMAIRSTYFQHSLPYRYTWRSPQQTESQIDHVLIDGRHFSDITDVRTYRGANIDSDHYLVMVKLRPKLSVINNVRYRRPPRYNLERLKQPDVANAYAQHLEAALPDEGELDRAPLEDCWRTVKAAINDAAESVVGYVERSSRNDWFDEECQEVLEEKNAARAAMLQHGTRQNVERYRLKRKQQTRLFRDKKRRLEEVECQEMELLYRSQETRKFYQKLNTSRKGFVPRAEMCRDKDGSILTDGREVIERWKQHYDEHLNGAENTGTEGQDSEGDGYVSTADSGNQPAPTMGEVKDAIQQLKNNKAAGKDGIGAELIKMGPDRLAACLHRLIVRIWETEQLPEEWKQGVICPIYKKGDKLECENYRAITILNAAYKVLSQILFRRLSPIANEFVGSYQAGFIDGRSTTDQIFSVRQILQKCREYQVPTHHLFIDFKAAYDSIDRIELWKIMDENSFPGKLTRLIRATMDGVQNCVKISGEHSSSFESRRGLRQGDGLSCLLFNIALEGVMRRAGLNSRGTIFTRSGQFVCFADDMDIIGRKFETVADLFTRLKREATRVGLMVNASKTKYMLVGGTERDRTRLGSSVTIDGDTFEVVDEFVYLGSLLTADNNVSREIRRRIISGSRAYYGLQKKLRSRKIHPRTKCTMYKTLIRPVVLYGHEAWTMLEEDLQALGVFERRVLRTIFGGVQENGVWRRRMNHELAQLYGEPSIVKVAKAGRIRWAGHVARMPDNNPVKMVFATNPVGTRRRGAQRARWIDQVHQDLESVGHSRGWREAAMNRGNWRNIVGEALSR

SEQ ID NO: 2390 - protein, 1007 aa, synthetic construct
  source 1..1007: note = Description of Artificial Sequence: Synthetic polypeptide
MGSIPNFSPTTKNGERRNNERYFRQPTWQRNKDYEWKLGTWNVRTLNEPGRASLLARELQKVGVGVAAIQEVRWPRSGEREFRAVDPIANTTFKYNIYHSGGDKAEHGVGFIVIGKQMKRVMKWKPISERICVLRIRGKFFNYSLINIYAPTNDKPDDVKDAFYEGLDKAYGECPKHDVKIVIGDANAQVGREDFFRPIIGKESLHSVTNDNGLRLVTFAAARGMAICSTYFARKDIRKHTWRHPNGDICNQIDHILVDGRHFSDVIDVRSFRGPNIDSDHYLVVSKIRARLSTVANSRPQRTMRFNIQRFSADGVTAEYHQKLDERISEVNVSENLNNLWDAIHGVVSETAREVIGTARRRPRSGWFDEECQRVTDEKNVARRRMLVSGTRLNRERYREARSAEKRIHRRKKKEFDENVIAEAQNCMEQNDMRRFYETVNGVRRKSAPSPVMCNDREGNLLTDKTMVAARWKEHFETLLNGGNDRASENRMNIDNDGQAVEPPSLDEVKKAIKELKNNKAAGKDELPAELLKHGSEQLHRIIHHILLRIWEEEELPASWMDGLICPLFKKGHRLECANYRGITLLNSAYKIMSRILFNRLRPLEESFVGEYQAGFREGRSTSDQMFTLRQILDKFREYNLQTHHLFIDFKAAYDSVKRNELWEIMMEHGFPTKLIRLIRATLEGSKSSIRVADEISTSFVTLDGLKQGDALSNLLFNIALEGAIRRACVHRNGTIITRSYMLLGFADDIDIIGIDRRAVEEAYVPFKRETTRIGLIINTTKTKYMVAGRHRGPIGDVGSEVVIGGDIFEVVEEFVYLGTLVTCDNDVTREVKRRIAAASRAFYGLRNQLKSRSLQTKTKLALYKTLILPVALYGHESWTLKEVDRRAFGVFERKVLRTILGGKLDNGIWRRRMNHELYQVYNEMDIVKRIKHGRLRWAGHVARMSEERQAKQIFSREPGRGRRLRGRPRTRWLFAVEEDLRSLNVQGDWKRLAQDRVQWRRLLHSA

SEQ ID NO: 2391 - protein, 1007 aa, synthetic construct
  source 1..1007: note = Description of Artificial Sequence: Synthetic polypeptide
MGSISNFLPTTKNGERRNNERYFRQPTWQRNKDYDWKLGTWNVRTLNEPGRVSLLARELQKVGVSVAAIQEVRWPRTGEREFRAVDPVANTAFKYNIYHSGSDKAEHGVGFIVIGKQMKRVMRWKPINERICVLRIRGKFFNYSLINIYAPTNDKPDDTKDAFYDCLDKTYGECPKHDVKVVIGDANAQVGREDFFRPIIGTESLHSATNDNGLRLITFAAARGMAISSTYFARKDIRKHTWMHPNGELCNQIDHVLVDGRHFSDVIDVRTFRGPNIDSDHYLVVSKIRARLSTVANTRTQRPLRFNIQRLSTEGVADEYRRKLDERIRGYNVGENLNNLWESIHGAMSTAAREVIGTAQRRPRNGWFDEECQNVTDEKNVARSRMLVSGTRQNRERYKEARAAEKRIHRRKKRQYEEDIITEAQNSIEQNDMRRFYETVNGVRRKTAPSPVMCNDREGNLLTDKILVAARWKEHFEQLLNGENTSASENRLIISNDGQAVEPPTLDEVRRAIKELKNCKAAGKDELPAELFKHGSEQLYEILHRTLLRIWEEEELPASWLEGLICPLYKKGHRLECANYRGITLLNSAYKIMSRVLFNRLRPLEESFVGEYQAGFREGRSTTDQMFTLRQILDKFREYNLQTHHLFIDFKAAYDSVKRNELWQIMVEHGFPAKLIRLIRATLDGSKSSVRVADETSTSFVTLDGLKQGDALSNLLFNIALEGAIRRAGVQRSGTIVTRSHMLLGFADDIDIIGIDRRAVEEAFVPFQRETARIGLTVNTSKTKYMIAGRQRGSNRDVGSEVVLGGEKFEVVEEFVYLGTLVTCDNDVTREVKRRLAAANRAFYGLRNQLKSRSLQTKTKFALYKTLILPVALYGHESWTLKEVDRKAFGVFERKVLRTILGGKQENGIWRRRMNHELYQVYKEVDIIKLIKHGRLRWAGHVVRMPEERQAKIIFSREPGRGRRLRGRPRTRWLFAVEEDLRALNVQGDWKRLAQDRAQWRRIIHSA

SEQ ID NO: 2392 - protein, 1018 aa, synthetic construct
  source 1..1018: note = Description of Artificial Sequence: Synthetic polypeptide
MHDVGSATLVRWPIEDSSPTKKGKSRANGLILRQQTRQRIKDNDWKVGSWNVRTLNEPARVGLLARELRNVGVNVAAIQEIRWPRTGEREFRAVDPIANTSFKYHIYYSGGDRAERGVGFIVIGKQMKRIIRWKPVSDRICVLRMKGKFFNYSLISIYAPTNDKPDDMKDEFYESLDKAYGECPKQDVKIVIGDANAQIGKEDFFRPVIGTESLHSVTNDNGLRLVTFAAARGMAISSTYFARKNIRKHTWRHPSGDACSQIDHVLVDGRHFSDVIDVRTFRGPNIDSDHYLVVAKIRARLSSVTSSATHRTLRFNIQRLSTDGVAAQYRQQLDEKLGRVNVAGDVDSLWDPIHEAVTTTAREVIGTGQRRRRNDWFDEECQRVTDMKNVARSRMLVAGTRQNRERYRAARAEEKRIHRRKKRQHEESVVADAQESMNRNDMRRFYATVNGARHNTVPVPAMCNDREGNLLTDKTAVAARWKEHFQQLLNGENGNVARNRMNIDDDDQAVDPPTIGEVKKAISELKNCKAAGKDEIPVELLKHGSEQLYQSIHRVLLKVWEDEELPTGWLDGLIRPIYKKGHRLECANYRGITLLNSAYKILSRILFNRLRPLEESFVGEYQAGFREGRSTTDQMFSLRMILDKFREYNLQTHHLFIDFKAAYDSVKRNELWQIMSENGFPAKLIRLIRATLDGSKSSVRIADEVSTSFVTLDGLKQGDALSNLLFNIALEGAIRRSGVQRNGTIITRSHMLLGFADDIDLIGIDRRSVEEAFVPLKRETARIGLTINSTKTKYMVAGRDRVRHGGVSAEVVFDGDVFEVVEEFVYLGTLVTCDNDVSREVKRRVAAANRAFYGLRNQLRSRSLQTETKFALYKTLILPVALYGHEAWTLKESDRKALGVFERKVLRTILGGKLENGVWRRRMNHELYQVYKDANIINRVKYGRLQWAGHLVRMSEERIAKIIFSREPGRGRRLRGRPRIRWLYAVEEDLATLNVRGNWRSFAQDRRRWSSTIRPAMA

SEQ ID NO: 2393 - protein, 1014 aa, synthetic construct
  source 1..1014: note = Description of Artificial Sequence: Synthetic polypeptide
MGSIPNSLSTTKNGERRRNERYFRQPTWQRNKDYDWKLGTWNVRTLNEPGRVSLLARELRKVGVCVAAIQEVRWLRSGEREFRAVDPIANTAFKYNIYHSGGDKAEHGVGFIVIGKQMKRVIRWKPINERICVLRIRGKFFNYSLINVYAPTNDKPDDVKDAFYECLDKTYGECPKHDVKIVIGDANAQVGKEDFFRPIIGKESLHSVTNDNGLRLVNFAATRGMAISSTYFARKDIRKHTWQHPNGELCNQIDHVLVDGRHFSDVIDVRTFRGPNIDSDHYLVVSKIRARLSTVSSSRNRQSLRFNIQRLSADGVAADYHQKLDERISEIDESVNLSDLWESVHGAVSTVAREVVGTAQRRPRNGWFDEECQRMTNEKNLARSRMLVSGTRQSRERYKEARAAEKRIHRRKKKEHEEAVIAQAQEAMEQNNMRRFYESVNGVRRKTAPSPAMCNDREGNLLTDKTMVAARWKEYFESLLNGDNGSGSGSRIQIDDDGQAVEPPTLDEVKKAINGLKNNKAAGKDELPAELLKHGSEQLHELLHRIISRIWEEEQMPTSWLEGLISPLYKKGHRLECANYRGITLLNSAYKIMSGILFNRLRPYEESFVGEYQAGFREGRSTTDQMFTLRQILDKFREYNLQTHHLFVDFKAAYDSVKRNELWQIMSEHGFPAKLIRLIRATLDGSKSSVRVVDEISSSFVTLDGLKQGDALSNLLFNIALEGAIRRAGVQRSGTIITRSHMLLGFADDIDIIGIDRRAVEEAFVPFKRETARIGLTINTTKTKYMIAGGQRGSGRVSGSEMVLGGDKFEVVEEFVYLGTLVTCDNDVTREVKRRIAAASRAFYGLRNQLKSRSLQTKTKLALYKTLILPVVLYGHESWTLKEVDRRAFGVFERKVLRTILGGKLENGIWRRRMNHELYQVYKEVDIVKRIKHGRLRWAGHVARMPEERQAKIIFNREPGRGRRLRGRPRTRWLFAVEEDLRALNVQGDWKRLAQDRAQWRRLIHSAQIHRSEL

SEQ ID NO: 2394 - protein, 997 aa, synthetic construct
  source 1..997: note = Description of Artificial Sequence: Synthetic polypeptide
MKSSVQEAYNVNSDRNNRHRPRHRKRTNDWKLGSWNCKSLNFLGSTRILSELLRVRKFDIVALQEVCWKGSTVHTYRDGYTIYQSCGNRHELGTAFIVMGEMQRRVIGWWPIDNRMCKLRIKGRFFNISIINVHSPHLASDDDDKDAFYAQLEREYDGCPSHDVKIVIGDLNAQVGQEEEFRPIIGKFSAHQLTNENGLRLIDFAASKNMAIRSTYFQHSLPYRYTWRSPQQTESQIDHVLIDGRHFSDIIDVRTYRGANIDSDHYLVTVKVRQRLSVVNNIRYRRPPRYNLERLKQPEVATEYAQSLEAALPEEGELTEAPLEDCWSSLKAAINNAAEGAIGFVEANRRNGWFDEECQTVLDEKNAARAMMLQQGTRQNVERYKQKRRQQTHLFRDKKRRLEELECEEMEQLYRSQETRKFYKKLNASRKGFVPRAEMCRDKDGGILTDEREVIERWKQHYDEHLNGAEEEDQDSRRNGFISTADEGDVPTPTIGEVKDAIKQLKNNKAAGKDGIGAELIKMGPDRLATCLHRLIARIWDTEQLPEEWKEGIIYPIYKKGDKLECENYRAITILNAAYKVLSQIIFRRLSPLASRFVGSYQAGFVDGRSTTDQIFMLRQILQKCREYQVPTHHLFIDFKAAYDTIDREELWKIMDENGFPGKLTRLIKATMDSVQCCVKISGALSDPFETRKGLRQGDGLSCLLFNIALEGVMKRAGFNMRGTIFNKSSQFICFADDVDIVGRTFQVVAEQYTRLKREADRVGLKVNTSKTKYLLAGGTERDRARIGRRVTIDGDEFEVVDEFVYLGSLITSDNNCSREIRRRIIAGSRAYYGLHKTLRSGKLHFRTKCTMYKTLIRPVVLYGHETWTMLEEDLQALGVFERRVLRTIFGGVCENGVWRRRMNHELAQLYGEPSITKVAKAGRVRWAGHVVRMPDNNPAKMVFNSNPAGTRRRGAQRARWFDQVEQDLGSVGRSRNWRLAAMDRVSWRNIVAQVMS

SEQ ID NO: 2395 - protein, 983 aa, synthetic construct
  source 1..983: note = Description of Artificial Sequence: Synthetic polypeptide
MKNQATNNQRENTNRDNRRRPQRRKGTSDWKLGTWNCKSLNFIGSTRILADVLKDRGFGIVALQEVCWKGSMVRTFRGNHTIYQSCGNTHELGTAFIVMGDMQRRVIGWWPINERMCKLRIKGRFFNFSIINVHSPHSGSTDDDKDAFYAQLEREYDSCPSHDVKIIIGDLNAQVGQEEEFRPTIGKFSAHRLTNENGLRLIDFAASKNMAIRSTYFQHSLPYRYTWRSPQQTESQIDHVLIDGRHFSDIIDVRTYRGANIDSDHYLVMVKLRPKLSVVNNVRYRRPPRYDLERLKQPDVAAAYAQQLEAALPEEGELDEAPLEDCWRTVKAAINDAAESNVGYVGRSRRNDWFDEECQEVLKEKNAARAVMLQQGTRQNVERYKRKRQQQTRLFREKKRRLEETECEEMEQLCRSQETRRFYQKLNASRNGFVPRAEMCRDKDGSILTDEREVIERWKQHFDEHLNGAESTGNEGRDNGGNAFVSTAEDGNQPAPTLREVKDAIHQLKNNKAAGKDGIGAELIKMGPERLAICLHRLIGTIWETEQLPEEWKEGVICPIYKKGDKLDCENFRAITILNAAYKVLSQIIFRRLSPVVNEFVGSYQAGFVDGRSTTDQIFTVRQILQKCREYQVPTPLGIMDENSFPGKLTRLIRATMEGVQNCVKVSGEHSSSFGSHRGLRQGDGLSCLLFNIALEGVMRRAGLNSRGTIFTRSSQFVCFADDMDIVGRTFEKVADLYTRLKREAAKVGLVVNAAKTKYMLAGGAERDRARLGSSVTIDGDTFEVVDEFVYLGSLLTADNNVSREIRRRIISGSRAYYGLQKKLRSKKIHARTKCTMYKTLIRPVVLYGHETWTMLEEDLQALGVFERRVLRTIFGGVQENGVWRRRMNHELAQLYGEPSIQKVAKAGRIRWAGHVARMPDSNPAKMVFASDPVGTRRRGAQRARWADQVRIDLASVGQNRGWRDAATNRVLWREIVDSVLSV

SEQ ID NO: 2396 - protein, 1190 aa, synthetic construct
  source 1..1190: note = Description of Artificial Sequence: Synthetic polypeptide
MQNGAAQVALVQEPYFRRGNFYLGNLVDPVFATFSKLEMANSRSMPRACVLVNKAIVATLISELTTRDVCAVTIDVSVGDLNRKYVYCSVYLPHDEPSPTDDFKRVVVHCVTKGLPLIVGSDANAHHIIWGSSDINLRGSSLMEYLSSTDLGLLNIGNRPTFMVSNREEVLDITLCSNRISHELTNWHVSDEESLSDHRYIFFEHSNVTAQTLRFRNPRSTNWELYIELVATKFHGYSPSIENPSDLDDAVDTTTSYIMEAFEEACPLRSVKTTRGTPWWNSDLTRLRKQCRRSWNRRRSAGSESFKSARKAYKKALRSAERSGWKNLCTNVSSLSEVSRLNKILAKSKDFQVNEIRLPNGDFTSSDEEVLECLFNTHFPGCVDIASTDEPNVFSCSYESLASARSIVTTESIQWALNSFAPFKSPGADGIYPVLLQKGFEFIKHVLKKLLVSSFATGYIPKSWRDITVKFIPKGGRASYEEAKSFRPISLTSFLLKCLERIIDHHIRDVYLANMPLHVNQHAYQSGKSTVTLLHKVVYDIEKAFAQKQSCLGVFLDIEGAFDNVSFDAILEAARNHGLPTMITNWIHQMLKNRHLFSTLRQAAIRKLSVCGCPQGGVLSPLLWNLVADTLLRQLNNCGFPTYGFADDYLALIVGMCISTLFDLMQSALQVVESWCRQYGLSVNPNKTSIVLFTERRNRDGIRPLRLFGTEINVTDQVKYVGVILDSKLSWTPHIDFRVKKACMAFGQCRRTFGKTWGLKPKYIKWIYTTVVRPILAYGCLVWWQKGEVRTIQSKLGHLQRMCLMAMSGAFSTTPTAALEALFDVAPLHIYLKQEALSCSYRLWVLDLLEKNPVNRRSTHTSLFPLLVNWDKIVLAPSDLTIACNFPYRTFTTQFPSREEWTSGYLERSISNNIVCYTDGSLLEGRAGAGVYSRELRLNQFYSLGRNCTVFQAEIFALMCGVQSALQQRVMGKVIYFCSDSQAAIKALASANSRSKLVIACRTQIEELNSVNSVNLVWVPGHSSIAGNELADELARDGASHDFIGPEPAIPISKCWVKLQINSWAATQHKQYWNSLESCRQTKLYITEPSPKVAKYLTNLSKQNCSLLVRALTGHCRLNYHMANIQRADSFVCDSCDSDYGTSYHLICNCPVFAQMRFQLLGKHLLSETEYRSLNLQDILLFLTRCGNEL

SEQ ID NO: 2397 - protein, 1041 aa, synthetic construct
  source 1..1041: note = Description of Artificial Sequence: Synthetic polypeptide
MPHQRDRPSVSWDVKQSWHDGAPARQECWRRPNKPPVKNLIANNIGDNTTRNNRQRPTRRNKDYDWKLGTWNCKSLGFAGCDRIIYDELHPRNFDIVALQELCWTGQKVWKSGHRAATFYQSCGTTNELGTGFIVLGKMRQRVIGWQPINARMCKMRIKGRFFNYSIINVHCPHEGRPDDEKETFYAQLEQIYDGCSPRDVKIVVGDMNAQVGREEMYRPVIGRNSLHAVSNDNGQRCVNFAASRGMVVRSTFFPRKDIHKTTWRSPDNLTENQIDHVLIDGKFFSDITNVRTYRSANIDSDHYLVAVCMRSKLSTVTNSRRSRTPRLNIERLRDSEVAQEYAQQLEVALPTEEQLGAATLEDGWRHIRSAIGSTATAALGPAAPNQRNDWYDGECEQLKNEKNAAWARMLQHRTRANEARYKQARNRQNSIFRRKKRHQEERDREAMEELFRAKDTRKFYEKLNRSRKGFVPQADMCRDCDGNLLTNEREVVERWRQHYDEHLNGDVASSGGGTEITLGARADDERLPPPDLQEVETEIRRLKNNKAAGVDQLPSELLKYGGDALARALHWVISKIWEEEVLPEEWMEGVVCPIYKKGDKLDCANYRAITILSAAYKVLSQILCRRLSPIAREFVGQYQAGFMGERATTDQIFAIRQVLQKCREYNVPTHHLFIDFKSAYDTIDREQLWQIMHEYGFPDKLIRLIKATMERVMCVVRVSGTLSSPFESRRGLRQGDGLSCLLFNIALEGVIRRAGIDTSGTIFRKSVQLLGFADDIDIVARNFETMADTYIRLRAEARRIGLNINVSKTKYMIARGSREDTARPPPRVHIDGDEIEVVEEFVYLGSLVTADNDTSREIQRRIVAGNRAYFGLRRTLRSSKVRHRTKLTIYKTLIRPVLLYGHETWTLRAEDQRALGVFERKVLRTIYGGVQMEDGTWRRRMNHELHQLLGEPTIVHLAKIGRLRWAGHVTRMSDTNPVKMVLENNPTGTRRRGAQRARWVDQVEDDLRTLRRMRGWRRAAMDRVEWRRLLRTAEATQALA

SEQ ID NO: 2398 - protein, 981 aa, synthetic construct
  source 1..981: note = Description of Artificial Sequence: Synthetic polypeptide
MGQGFKLRLLGDGETLIGACPGTNTQESPVDRDTRRATLAGAEGIVLPQHDRKSRVSVGGLRCLYTNARSMGNKQEELALLLSSGHYDLVGITETWWDSSHDWSVAIEGYTLHRRDRVGKKGGGVALYVKEQYTSLEADIGSKEGQLETLWVKLWGGGGERDLTVGVYYRPPNQGEELDLEFSRELTEAAHARDMVVMGDFNYPDISWEEHSAKSDQSRSFLTCIEELFLTQEVHGPTRGNALLDLVLAKGDDLVTDLNIEGSLGDSDHETIMFTVHHKADKSDSRIEVLDFKNANFNKLRSLVGEVLWDQGPKVKGVHEEWLFLKDTILEAQRKSIPMQRKGSRRAGKPSWLNREIMVLLRKKKEAYKQWKLGTVPKEDYTTMAHTCREQIRKAKAATELRLATGIKDNKKSFFRYVGNRRKTNGSVGPLLNNSGQLVTDTQEKAELLNDYFASVFHQTKGKIMPGRVQDEHGRNDHLPTIAVELVYDQLEKLDIYKSAGPDELHPRVLKELAEVIAEPLAKLFQNSWCSGEVPEDWKRANVVPIFKKGRREDPGNYRPISLTSIPGKILEKFIKESICDKLAEGKILNDSQHGFIAGRSCLTNLISFYDQVTHHLDKREEVDIVYLDFQKAFDLVSHDVLMRKLEDCGLNCETVRWVGNWLQGRTQRVLVNGSVSSWREVASGVPQGSVLGPVLFNIFINDLDVGVKSSLAKFADDTKLWGSVVTLEDRLQIQADLDRLASWADQNQMKFNVEKCKVLHLGTNNPQHTYRLGGTKLTSTMNERDLGVIIDHSMNMSHQCDAVASRANNTLACINRCISSKTKEVILPLYSALVRPQLEYCIQFWAPHFNKDVEKLERVQRRATHMIRDLQGKPYEERLRDLGLFSLKKRRLRGDLVAAYHYIRGVHQGLGEQLFTRAPLGKTRSNGHKLLEDRFRLNIRKNFFTVRVSRLWNKLPPEVVQSPTLEIFKRRLDSHLAGVT

SEQ ID NO: 2399 - protein, 910 aa, synthetic construct
  source 1..910: note = Description of Artificial Sequence: Synthetic polypeptide
MGNKQEELALRIASSNPDVVGLTETWWDSSHDWAVNIRGYRLYRRDREGRKGGGVALYVKEHYTSSASSMGSGEGRAEVLWVKIQGGQGERDLTVGVYYRPPNQEEELDREFSGQLAETLKARDVVVMGDFNYPDICWEEQSAGTDRSRRFLAELQDLHLIQEVHSPTRGDALLDLVLAAGDDLVRGLQVLDHLGNSDHRVLEFTIQRRVSRARSKVVALDFRRANFSEMRRLVGEELGSLRAEELSVQEEWSFLKETILGAQGVSIPTRSKAGRSVQKPPWLTKGVRECLLAKRVAYARWKGGVISKEEYTSSARACRRAVRKAKAEIELGLASRIKDNKKSFFKYIGRMKKAPGNVGPLQDMRGNLVVASEDKADLFNQFFTSVFLCRDRDFPAVIEAGREGIAFRPQVGEDRVRELLEGLDAFKSAGPDALHPRVLRELAGVIAGPLARLYERSWCLGQVPDDWKVANVVPIFKKGKREDPGNYRPVSLTSILGKLFEKIIKEHICDGPASEMMLRGNQHGFIRGRSCQTNLIAFYDQVTKAMDAGVAVDVVFLDFSKAFDTVSHPILINKLGDCGIDAYTVRWIADWLKGRTQRVVVDGSYSTWGEVGSGVPQGSVLGPALFNFFISDLDVGVESNLFKFADDTKIWGEVSTLAGRERLQKDLDRLQGWANRNRMCFNTDKCRVLHLGSRNQQHTYTMGSSLLESTEAERDLGVIIDSKMNMGRQCEVMVGRANRTLSCIHRCISSRAREVILPLYATLVRPQLEYCVQFCAPHFRRDVDNMERVQRRATRMIRGQQGRPYSERLRDLNLFSLHKRRLRGDLVTVYKLTRGNQKGLGETLFPLAPAGITRNNGHKLMERRYRLDIRKNYFTVRAARSWNQLPREVVLAPTLGIFKKRLDTYLAGLI

SEQ ID NO: 2400 - protein, 1077 aa, synthetic construct
  source 1..1077: note = Description of Artificial Sequence: Synthetic polypeptide
MLLMHPLHFTTAFALCIVGGGWGRLEGYGDCRVGEGNGCERMPIYNRKLVNQITSFGPGEEKGKGQCDRGGGCSDGWGAPIEVVSGRGRYGKGRPNHLIRPRVFGRTLIVPKRSPDIANLGSQDGGPSRLKVVLFNARSVNGKTSFIQDLILDEHVDLACITETWLDEMGGVNLTQLCPPGYSVQHQPRSGGRGGGVAVVYKDSIPLTRCPVPQSTMFECVHLRVGDRDRLGILLVYRPPRCTTVSLPELAEVVSGLALESRRLIVLGDFNVHAETNLSGAAQDFMAAMATMGLSQLVTGPTHSAGHTLDLVFCQGWEEGGGVEELTIAPLPWTDHHLIRFRLTAPPNLCRGGGPKMVRPRRLMDPEGFLTTLGEFPASSAGDPVDALVSLWNGEMTRAIDTIAPERPLSSNRAKPAPWFTEELAAMKRKKRELECVWRSGYNESDRTRLGSYLRAYAAAIKAARRAHLAANIASAQNRPAALFRVIRGLLTPTNQGGSPDNSAARCEAFARFFADKVALIRSDFDTILTAVSEDVTSAPACPVLLDSFQLVELEDVDKILGEARPTTCILDPCPSWLVREARGGLAEWVKVVVNASLREGKFPASLKMAVIKPLLKKPSLDPTQFGNFRPISNLPYLGKVLEHVVASQLQGFLVDTDFLDPAQSGFRPGHGTETALVALVDDLRRELDRGSVSLLVLLDLSAAFDTVDHGILLGRLAGMGLGGTVLQWLHSFLEGRSQMVSLGDACSAPQPLTCGVPQGSVLSPMLFNIYMKPLGEIIRSFGVRCHLYADDVQLCHSFPPVTKEAVQVLNRCLAAVSDWMRANKLKLNPDKTEVLLVSRKAEQGTGLQPVLDGVTLPLKAQVRSLGVILDSSLSLEPQVSAVARGAFAQLKLVRQLRPYLGKPDLATVVHALVTSRLDYCNALYVGLPLKTVRKLQLVQREAARLITGAAYRERTTPLLRQLHWLPISYRAQFKVLALAYKALNGSGPAYLSERVSRYDPPRSLRSSDEALLAVPSASQVRLAGTRDRAFSVVAPRLWNALPIEVRQAPSLLSFRKRTKTWLWDQAFEHESAAKMR

SEQ ID NO: 2401 - protein, 957 aa, synthetic construct
  source 1..957: note = Description of Artificial Sequence: Synthetic polypeptide
MLTKTSRKIFYCQLDTILSEIPKEDKIILLGDFNARVGRDSDLWPGIIGKDGVGNSNSNGILLLTKCGEHNLVITNTLFRQKNKLKTSWKHPRSKHWHLLDYVITRARDRRDVLLTRAMTGTDDCWTDHRLIRSTMAIKIVPKRRLQGRKTRRKMNTQALQEPSKRALLQTTLKDHLPTEHPENVEEHWNKLKTSIITACEESIGYLTKKHQDWFDDNDKEIQQLIDNKRKAFQTWQRDTNCAAKKKIYASAKAEVQRRTRELKNIWWTKKAEEIQHLADTHDAQGFFKATKIIYGPRNHGIQPLRSSDGTKILKDKTSIALRWKEHYQNLLNRSSNVAEETLSQIPQQQTRDELAALPSLEEVSNAISQQKNNKASGPDGIPAEIFKEGGPELIQQLHQLIEKVWMTEKIPADFKDATIITLFKKGDRTDCGNYRGISLLTSAGKILARILANRLLPVSEDTLPESQNGFRPSRGTVDMIFTARQLQEKCREQNQPLYMAFIDLAKAFDTVNRSALWTILQKIGCPDKFVNILRLLHDDMMATVLDSNGSQSDPFKVESGVKQGCVIAPTLFSIFIAMILHLVDGKLPTGVEIIYRTDGKLFNLSRLRAKTKVTTTSVIELQYADDNVVCAHSEEDLQATLNTFAEAYEKLGLSLNIEKTKVLFQQAPANPSAKPGIQLNGVTLENVDHFRYLGSHLSTKVNIDTEIQHRLSSASAAFFRMKQRVFDDRDIRRETKVLVYKAIVLPTLLYACETWTVYRRHTKLLERFHQRCLRKILQISWEDRRTNVSVLEEAKTTSIEAMLLRHQLRWTGHVVRMPDHRLPKQLLYSELKNGKRNVGGQEKRFKDGLKANLKNCGIDTENWEALALERSNWRSAVTSSAAEFEEARTEGLREKRAKRKERQANPDRDRLPPGNRCPHCGRICGSRIGLFSHLRTHAQDTKVGRPSSSNYEGSPK

SEQ ID NO: 2402 - protein, 982 aa, synthetic construct
  source 1..982: note = Description of Artificial Sequence: Synthetic polypeptide
MDEYQRSLSRPLLTIMSINIEGLSLAKEELLAKMSEDISCDILCIQETHRDITMRRPKILGMQLAVERPHRQYGSAIFVRSGVAISATSLTEVNNIEILSVELDSCTVSSLYKPPGADFYFTPPTSCHNHEAHFVVGDFNSHSCVWGYDEDDRNGEAVLTWADNSRMSLLHDSKLPPSFNSGRWKRGYNPDLIFVKESISHQCTKRVLNPIPNTQHRPICCVAYAAVRPKSVPFRRRYNFNKANWTKFTETLEAAISDIEPSIENYDLFVEAVKRSSRLSIPRGCRTSYLPGLNEESLNQLQEYLRLFQENPYSDGTIAAGQKLSTALANAKKDRWIELLENLDMSKSSRKAWQLLRRLDSDPLVNPGHANVTPDQIAHQLIQNGKTNCSRIKMKINRVPELETHQLSSPLNLKELREAIKRCKTGKAPGLDDLMMEQIKHLGPKAENWLLKFYNQCLAHKQIPRAWRKTKIIAILKPGKDASNARNYRPISLLCHLYKVYERMLLNRLGPVIEPKLIAQQAGFRPGKNCTGQILHLTEHIEEGYEKGCITGTVFVDLTAAYDTVQHRKMLHKVYHITRDFDFTKTVQTLLENRSFYVEFQGQKSRWRRQKNGLPQGSVLAPTLFNIFTNDQPQPPLTKSFIYADDLGLTTQAKDFETVEKQLTNALKDLSSYYKENHLKPNPAKTQVCAFHLRNREANRKLKVTWEGQELEHCFHPKYLGVTLDRTLTYRKHCMNTKHKVAARNNILRKLTGSAWGADPQVIRTSALALSFSTAEYACPVWHKSAHAKQVDIALNETCRIITGCLKPTPVDKLYKLAGIAPPDVRREVAANGERKKVEHCESHPLHDYHPPPTRLKSRKGFMRTTTPLDVPPATARVSLWAAKPGNSNWMAPQEGLPPGANQEWATWKSLNRLRSGVGRSKDNLARWHYLEESSTLCDCGAEQTTQHMYACPQCPASCTEEELFKATDNAVAVARFWSKTI

SEQ ID NO: 2403 - protein, 972 aa, synthetic construct
  source 1..972: note = Description of Artificial Sequence: Synthetic polypeptide
MGSWNVRTLSEAGALKKLDDALATLSMDLVALQEIRWLGNGVHNRRGKHCYDIYYSCHDRHRVLGTGFAVGPRLKPAIMDFKAINDRLCTLRMRGKFFNISLINVHAPTEDKEEEEKDLFYGRLARIVDACPRHDLIIILGDFNAKVGREPMYRQYTGCHSLHEHSNDNGSRLVQFAAANNLVVGSTKFARKKIHKITWAHPGGESFNQIDHVLISRRRQSSLLNVRTYRGANIDSDHYLVGLVIRCRIARPRANGGGENTQARLNTDSLRDIAVQQEFKTALEESLLPEDRYETTSERWNALKTKIINCARNILPPRRGNTKSGWFDDECRQVTERKNTAYRAMQQRHRTRACAEEYSRLRREEKRVHRSKKHALEEQNMRELEQTREAYGPTRKFYQAIAGHRNNVVPKVTCCRNKDGDLVSNQPEVLSRWAQYFDELLNDQFSEQLEAPLADNVMLLPPSIEETRKAIRRLKNNKAPGTDGIAAELVKNGGARLENEIHQIVTEVWDSESMPCDWNLGIIYPIYKKGDRLDCNNYRGITVLNTAYKIFSLILQDRLVPHVEEIVGNYQRGFRNGKSTTDQIFTMRQILEKMAEYRNDTYHLFIDFKAAYDSIARVKLYDAMSSFGIPAKLIRLVRMTMTNVTCQVRVDGKLSGPFATTKGLRQGDGLACLLFNLALERAIRDSRVETTGTIFYKSTQILAYADDIDIIGLRLSYVAEAYQGIEQAAENLGLQINEAKTKLMVATSADLPINNPNLRRRDVQIGERTFEVVPEFTYLGSKVSNDNSMEVELRARMLAANRSFYSLKKQFTSKNLSRRTKLGLYSTYIVPVLTYASETWTLSKSDEALLAAFERKMLRRILGPVCVEGQWRSRYNDELYEMYGDLTVVQRIKLARLRWAGHVVRMETDDPARKVFLGRPQGQRRRGRPKLRWQDGVEASAIKAGITDWQTKARDRERFRTLLRQAKTAKRL

SEQ ID NO: 2404 - protein, 999 aa, synthetic construct
  source 1..999: note = Description of Artificial Sequence: Synthetic polypeptide
MNAGSESRQEAVCRKIEDLNTAKTKVIIGLWNVKTLYGTGKSAQVTAEMRRYGLHVLGISESQWTGSGWLRTATGETLIYFGREDNQHREVVATILNKGLEKCLMEWKPINSRMMTLRLKGKHTNTSIIQCYAPTNDSEDESKDYFYEELQRGLTGIPRHDLIVVMGDLNVKVGEDNTNYERTMGQHGMGTRNENGERLVDFCALNNLVIGGTLFPHRTIHNLTWNSPNGRDKNQIDHLMIGGMLRRSLQDVKVRRGADVGSYHHLVTSRIKFKLKKTFTREATRTQFNIQKLSDGNVTSAFRLELKNRFQALQDLEETTPNTDEVNTQWKLIVEAYTESSKTCLGVKKKNASNEWIQQGTWNIIEERREIRKRELAAKSIRLQEKYAEDYKEVCQKVKRLVREDKREAMENLATETEEAAAKGEQGNVYKITRIICGKYHGGMSGPIKGKIGRLLTIEKEQEARWPEHFREVLNQPPPEDTPDIQEATLNLDISSDPPQRHEVVKAVKSLKEGKSPGMDNLNAELFKVDPELTTTILQPLFKTIRKGEQITEDWRTGVIVKVPKKRALGDLNNWTGITLLSVASKILAKIIINRMSDAVDICLRKEQARLRKERRCTDQIFALRNITEQCTERQRQLYVNVVDFEKVFDGVHRESLWCILRSYGIPGKIVEVIKSFYQSFKHVVGNRTTAFEVKTGVRQGCNMSAIMFNLAIDWVMRKTTEDTSRGIRWTLFSTFEDLDLVDDLAQLSHTNQHMKEKTNPLHKYERHIGLRISQKKTEMMTLNVSSPTLIMENNAHLPITDKFTHLGSINKTDGGTKEDIMNRLGKERSVHRSVINIWKSEQFSIQTTLKQYNSCVLSTLLYGFECWRKTGHDRAKQSSFHTTSLRQILRIFWPDNISNTDLLQKWRQEDRTTIIKRRRWRLIGHVLRREPDSVVKTAFHWTPEGHRKRGRPKVTWRRKVESEMKSWNHSWGTLTKLGQNRQSWRSFVAARNSRWRNG

SEQ ID NO: 2405 - protein, 1048 aa, synthetic construct
  source 1..1048: note = Description of Artificial Sequence: Synthetic polypeptide
MKLSHARGATQDGRVMVERSDRMWSTGEGNGKPLQYSCLENPMNSMKRQNDRILKEELPRSVGAQYATGDQWRNNSRKNEGMEPKQKQYPAVDVTGDRSKVRCCKEQYCIGTWNVRSMNQGKLEVVKQEMARVNVDILGISELKWTGMGEFNSDDHYIYYCGQESLRRNGVAIMVNKRVRNAVLGCNLKNDRMISVRFQGKPFNITVIQVYAPTSNAEEAEVERFYEDLQDLLELTPKKDVLFIIGDWNAKVGSQETPGVTGKFGLGIRNEAGQRLIEFCQENALVITNTLFQQHKRRLYTWTSPDGQHRNQIDYILCSQRWRSSIQSAKTRPGADCGSDHELLIAKFRLKLKKVGKTTRPFRYDLNQIPYDYTVEVRNRFKGLDLIDRVPDELWNEVRDIVQETGIKTIPMEKKCKKAKWLSGEALQIAVKRREVKSKGEKERYKHLNAEFQRIARRDKKAFLSDQCKEIEENNRMGKTRDLFKKIRDTKGTFHAKMGSIKDRNGMDLTEAEDIKKRWQEYTEELYKKDLHDPDNHDGVITDLEPDILECEVKWALESITTNKASGGDGIPVELFQILKDDAVKVLHSICQQIWKTQQWPQDWKRSVFIPIPKKGNAKECSNYRTIALISHASKVMLKILQARLQQYVNRELPDVQAGFRKGRGTRDQIANIRWIMEKAREFQKNIYFCFIDYAKAFDCVDHNKLWKILKEMGIPDHLTCLLRNLYAGQEATVRTGHGTTDWFQIGKGVRQGCILSPCLFNLYAEYIMRNAGLEEAQAGIKIAGRNINNLRYADDTTLMAESEEELKSLLMKVKVESEKVGLKLNIQKTKIMASGPITSWEIDGETVETVSDFIFLGSKITADGDCSHEIKRRLLLGRKVMTNLDSIFKSRDITLPTKVRLVKAMVFPVVMYGCESWTVKKAERRRIDAFELWCWRRLLRVPWTARRSNQSILKEISPGISLEGMMLKLKLQYFGHLMRRVDSLEKTLMLGGIGGRRRRGRQRMRWLDGITDSMDVSLSELRELVMDREAWRAAIHGVAKSRTRLSD

SEQ ID NO: 2406 - protein, 1063 aa, synthetic construct
  source 1..1063: note = Description of Artificial Sequence: Synthetic polypeptide
MADSRNAFTVITLNVNGLNSPIKRYRFAEWIKKNEPSICCIQETHLRHRDTKKLKVKGWKKIFHASYSQKKAGVAILISDKIDFKCKDVMRDKEGHYILIKGAIQQEEITIINVYAPNQGATKYMRQTLAKLKEAIDVSTIIVGDFNTSLSPIDRSTRQKTNKEIENLNNLINELDLTDIYRTLHPKSPGYTFFSSAHGTFSRIDHMLGHKTSLNKFKKKIEIIQSTFSDHNGIQLEVNNHQRLRKFTNTWRLNNTLLNNQWVKEEIAREIAKYIETNENENTTYQNLWDAAKAVLRGKFIALNAYIKKEERAKIKELMDQLKKLENEQQTNPKPSRRKEITRIKAEINDIENKKTIERINNTKSWFFEKINKIDKPLARLTKSKREKTHINKIMNEKGDITADPEEIKKIIRGYYEQLYANKLDNVEEMDNFLETYEQPRLTREEIEDLNQPITSKEIQSVIKKLPTNKCPGPDGFTGEFYQTFQKELTPILLKLFQNIEENGTLPNSFYEANINLIPKPGKDATKKENYRPISLMNIDAKILNKILANRIQRHIKKIIHHDQVGFIPGMQGWFNIRKSINVLQHINKSKEKNQMIISIDAEKAFDKIQHPFLIKTLQKVGIEGNFLNMIKSIYEKPTASIVLNGERLKAFPLRSGTRQGCPLSPLLFNIVLEVLARAIRQDKEIKGIQIGKEEVKLSLFADDMILYLENPEKSTIQLLELINKFSKVAGYKINAHKSVMFLYARNEQTEETLKKKIPFSIATKKIKYLGINLTKDVKDLYKENYITLLKEIEGDLKRWKNIPCSWIGRLNVIKMSILPKLIYRFNAIPIKIPTTYFADLEKLVIKFIWKGKMPRIAKDTLKKKNEVGGLTLPDFEAYYKATVVKTAWYWHKDRHIDQWNRIENSEIDPQIYGRLIFDKAPKVTELGHNSLFNKWGWESWISISKRMKEDPYLTPYTKINSKWIKDLNIKDSTIKLLEDNVGKHLQDLVLGGHFLDFTPKAQATKEKIDKWELLKLRSFCTSKEFVKKVKRQPTQWEKIFGNHVSDKRLISCIYKQRNPTTQ

SEQ ID NO: 2407 - protein, 1086 aa, synthetic construct
  source 1..1086: note = Description of Artificial Sequence: Synthetic polypeptide
MTTSSWCRLGSLDASLGELRVQQLQTGLTTLFGFNVLVTFDNVHYKTSGASAPVPTSTQERLVGLTCEECGKWCKSKAGLVAHHRVHDNDSVGTNMVAQLACADCSRLFPTKIGLSQHRRHAHPTQHNADKLSRVKHSGARWSQQESQSLLRLANNLYPSCETQTALFARLEQYFPGRSAISIKTRLRVLNWQAQQDESSSGGPDQTIGQIAAYSSEADDYSVWFKQTVDCAVSLLESHADSSLASVDLLAFARGLQSGIMTPEQVLSLLDLHASRTFPHTWKTVSRRRRQLAHRMPVNRKQIRRANYAAIQTLYHQRRKDAASAVLDGSWKDLYKGNCGLPPDAEQYWKQVLSAPKHVDSRPSRVVVPSDWSLIEPITGEEVGRTVRSMGNSSPGLDKLTPRMLRRFNANVLAGYFNLLLLAGGCPPHLCRARITLVPKVPNPTSPDQLRPISVSSILVRCFHKVLADRWSRRLQLPSLQFAFLHRDGCLEATSLLHALLRHSSATASNLSLAFVDISKAFDSVSHDTIVRSAEAFGAPSPLVRYIAQSYENAVAVFPSSEVHCHRGVRQGDPLSPLLFIMAMDEVLGLSMPQLGYQFHDTLVDGFAFADDWVVCAESQARLKEKLEAAAVELGRAGMKINARKTKAMVICGDRKHRATAVSVEPFCFAEELITPLGPTDTVTYLGIPFTFKGKGVFNHRQHLLKLLDEVTRAPLKPHQRMEITRNYLIPRLTYSLVLGQVHRNTLKRLDNYIRQSIRGWLRLPKDTPISYIHAGKQHGGLGIPSLSATIPMQRRVRMEKLLSTQCRVLRNVVNDSAFGKVVRDLSLPIRVHGSCVNTKEELVAAWGDSLHNSVDGRGLRELVASPLSNRWLVFPERVFPRIFIRGIQLRCNLLRTRVRSARHGHGGQTILCRGNCGQPESLVHILQSCWITHDARCARHNRVARELAKRLRRLGYTVFEELRAPTSTSFIKPDLIAVRERRATVIDVSIVSDGRGVTVWNEKKQKYGADEFSLAIISALRAIGCDVDFLVHQPMIISYRGICFPQSAKAVIGLGLSKVTVSDLCLLAIVGSLRTYDTFMRGTWR

SEQ ID NO: 2408 - protein, 844 aa, synthetic construct
  source 1..844: note = Description of Artificial Sequence: Synthetic polypeptide
MFVLATVYRPPGHHTDFIKEFADFTSELVLAADKVLIVGDFNIHVDNEKDALGSAFIDILNSIGVRQHVSGPTHCRNHTLDLILSHGIDVDGVEIMQPSDDISDHYLVLCKLHIAKTVNSTSCYKYGRTITSTTKDCFVSNLPDVSQFLSISKTSEQLDDVTETMDSLFSSILNTVAPLRLRKVKENSLTPWCNEHTRTLKRAARKMERSWRKTKLEVFRIAWRESNLSYRKALKTAKSDYFSSLLEENKHNPRYLFNTVAKLTKNKASTSVDISQHHSSNDFMNYFTSKVDTIRDKIVTMQPSATVSHQTVHYRSPEEQFHSFSTIGEEELYKLVKSSKPTTCMLDPIPSKLLKEVLPEVIDPLLTIINSSLLLGYVPKTFKLAVIKPLIKKPQLDPKELVNYRPISNLPFLSKILEKVVSSQLYSFLEKNGICEDFQSGFRPYHSTETALLRVTNDLLLSSDRGCISLLVLLDLSAAFDTIDHTILLHRLEHFVGINGSALAWFKSYLYDRHQFVAVNEEVSYRSQVQYGVPQGSVLGPLLFTLYMLPLGDIIRKHGVSFHCYADDTQLYISSRPGETYQFEKLTECIVDIKNWMTSNFLLLNSEKTEVLIIGPKSSACNDLERCLSLDGCSVNSSSSVRNLGVLFDSNLSLESHVSSICKTAFFHLKNISKLRPMLSMSNAEMLIHAFMTSRLDYCNALLGGCSARLVNKLQLVQNAAARVLTRTRKYDHISPVLSTLHWLPIKHRIDFKILLITYKALNGLAPQYLNELLLHYSPPRPLRSQNSGNLIIPRISKSTAGGRSFSYLAPKLWNNLPNIVREADTLLQFKSRLKTHLFNLAYT

SEQ ID NO: 2409 - protein, 965 aa, synthetic construct
  source 1..965: note = Description of Artificial Sequence: Synthetic polypeptide
MCFLIPVVTNTRKTREVRCRRNPHNLRSIHVSTISQLSLSVGLWNCQSAVNKADFITSIATYSDYNLMALTETWLRPEDTATHATLSANFSFSHTPRQTGRGGGTGLLISKEWKFTLIPSLPTISSFEFHAVTIIHPFYINVVVIYRPPGKLGHFLDELDVLLSSFSNFATPLLVLGDFNIYVDKPQAADFQTLLASFDLKRAPTSATHKSGNQLDLIYTRHCFTDQTIVTPLQISDHFLLSLNIHITPEPPHTPTLVTFRRNLRSLSPNRLSTIVSDSLPPSRKLTALDSNSATNTLCSTLASCLDRLCPLASRPARASPPAPWLSDALREHRSKLRAAERIWRKTKNPAHLLTYQTLLSSFSAEVTSAKQTYYRLKINNATNPRLLFKTFSSLLYPPPPPASSTLTTDDFATFFCTKTAKISAQFAAPTTNTQDTTPTPHTLTSFSQLSESEVSKLVLSSHATTCPLDPIPSHLLQAISPAVIPTLTHIINTSLDSGLFPTTFKQARVTPLLKKPNLDHTLLENYRPVSLLPFMAKILEKVVFNQVLDFLTQNNLMDNKQSGFKKGHSTETALLSVVEDLRLAKADSKSSVLILLDLSAAFDTVNHQILLSTLESLGVAGTVIQWFRSYLSDRSFRVSWRGEVSNLQHLNTGVPQGSVLGPLLFSIYTSSLGPVIQRHGFSYHCYADDTQLYLSFHPDDPSVPARISACLLDISHWMKDHHLQLNLAKTEMLVVSANPTLHHNFSIQMDGATITASKMVKSLGVTIDDQLNFSDHISRTARSCRFALYNIRKIRPFLSEHAAQLLVQALVLSKLDYCNSLLAGLPANSIKPLQLLQNAAARVVFNEPKRAHVTPLLVRLHWLPVAARIKFKTLMFAYKVTSGLAPSYLHSLLQIYVPSRNLRSVNERRLVVPSQRGKKSLSRTLTLNLPSWWNELPNCIRTAESLAIFKKRLKTQLFSLHFTS

SEQ ID NO: 2410 - protein, 1010 aa, synthetic construct
  source 1..1010: note = Description of Artificial Sequence: Synthetic polypeptide
MNPLRNCVNARASPGSDALYGLNTVTSVQGPLHRRPGAVLNRQGFPHQGRMWAKKLVHETKIRIGTWNIGSLTGKLMELIDIMIHRKLNILCIQETKWVGEKAKEIDSLGFKLWYSGRSRTRNGVGVIIDKSLKDNVIKINRIGDRIIALKIVVDDKIVNIISAYAPQVGLDMSSKLNFWNDLEELIQNIPLEERVFIGGDLNGHVGREVDDFKSIHGGHGFGTTNEGGKTILDFCLAYDFLIANTLFKKRNEHLITYKNGYSTTQIDYFLIRKLNRLDCKDCKVIPSENLCTQHRLLVLDFKIKGHKIKNKVKQFSRIRWGHLKNINKNIFESKILDLKILSVHEDANIMWEKVASDIKNIAKDVLGVSKGKAPNSKNSWWWNPNVQEKIKNKKICYKNWFNFKNSDNWEIYKVARKDSKKAICDAKTLAFSDLYNRLDTKEGERYMYKLAKQRDRSSKDLVQVKCIKDEDQKILFLEDDIQQRWMRYFAKLFNEDCENKIDYSDLSTLNENKDFCFYRRISKTEVREALKKMKGGKAVGPDDIPIEVWKCLGDEGISWLTKLFNTILKTKKMPDEWRMSVLIPIFKNKGDAQDCANYRGIKLMCHTLKLWERVMEHRLRRDTNVSQNQFGFMPGRSTMEAIHLLRGLMEKYRENKEDLHMIFIDLEKAYDKVPREVLWRVLEKKGVNNAYIQIIKDMYAGAITCVQTQGGLTKYFPISVGLHQGSALSPYLFALVMDVLTRHLQEDVPWCMLFADDILLVDKTREGVEGKLELWRSTLESKGFRLSRSKTEYMECNFSSNRPSEGIVTLGDQVINKSTRFRYLGSIVQSDGEIDGDIISRIQVGWLKWRNASGLLCDRNVPLKLKGKFYKMVVRPAMLYGAECWPLKEKHNTKLSVAEMRMLRWMSGFTLRDRIRNEHIREKVGVAPVEDKIRESRLRWFGHIKRRPSDDPVRRVEVLDLTYVKKGRGRPKKTWLENIRNDLSLLDLNENLTFNRTQWRKRIHVADPT

SEQ ID NO: 2411 - protein, 618 aa, synthetic construct
  source 1..618: note = Description of Artificial Sequence: Synthetic polypeptide
MCIMSEISTSNNKIKTIWNIITRETGQPRTQEDSITIKVNEKITNKKSEVENTFNNYFLNVVENIGSKCSLEEARQLMEQGVPRQFDTMEIPPTSQSEIRKLINSLKSKSSHGIDGISSRVLKACSQEICRILSHICNSSLEQGIFPDRLKYAIVKPLHKKGDTLDVNNYRPISLLTALSKILEKVMYSRVASHINKNKVLTKCQFGFQKGFSTENAIYIFTNEILNALDNRKSPVGIFCDLSKAFDCVNHGILLDKLKYCGMSGKVHKWFKSYLTGRVQKVDISNSHNIQKQPSPQTGELSSMGCHRVRYWDLCCSYTKTAESSNWGTIKHGVPQGSVLGPLLFLIYINDLPFYIHKDAKLVLFADDTSIAITPESQELTDEIVNEVFQRIIRWFSVNGLSLNFEKTQYIQFHTINGITPLINIDFNQKSVAKVEYSKFLGLCIDEGLNWKKHIEDLLKRLSSATYAIRVIANFGDVQLSKLAYYAYFHSLLSYGIIFWGNSSFSKKVFIAQKRVIRIIAGAHPRSSCRHLFKDLGIFTIYIYIYSLMKFVINNPTEFKCNSSVHSYNTRRKGDLHYSRLNLALSQKGVNYSATKVFGHLPSSIKILTDSQLAFKKN

SEQ ID NO: 2412 - protein, 986 aa, synthetic construct
  source 1..986: note = Description of Artificial Sequence: Synthetic polypeptide
MMASSWVKYSGGKIVPHSDLRAGTTQEDVVIKKNKTGILRIGAWNVLTLNRVGKLENLKREMDRLKLDMVGISEVRWQDEQDFWSGEYRVINTKSVGGNAGVGLIMNKKIGMRVSYYEQHSERIIVVKIDTKPTPTTVVQVYMPTSSADDEDIEEMYEEIKEIIQKVKGDENLIVMGDWNSVVGKGREGNVVGEYGLGKRNERGDRLVEFCAEHNLMITNTWFKHHERRLYTWKRPGDTGRYQIDFIMVRNRFRNQVLNCKTYPGADIDSDHNLLVMNCRLKLKRLQKGRKVRRWNLDKLKEPEVVESFRGSIRQGLAETGESNTVEEEWVALRDRVVKAAEDHIGRRTRPNRNPWITQDILNLIDERRKYKNSASETGKREYRRLKNEIDRKCRLAKQEWLEDKCRTVEECITRGKIDTAYRKIKEIFGDKKSSCMNIKNSDGKPVLSKEGKAERWKEYIEGLYKGNKLEGSILEMEDEVEEDEIGDTILREEFDRALKDLSRNKAPGVDDIPSELLISLGEPVMKKLFHLVCKMYETGEIPSDFKKNIVIPIPKKASADKCENYRTISLISHGCKILTRIIYRRMEKLVESDLGEDQFGFRRNVGTREAILTLRLILEDRLRKGKPTFLAFVDLEKAFDNVDWNTLFQILKVAGVKYRERRVIFNLYKNQTAVIRVEGHERDAEVGKGVRQGCSLSPMLFNLYIEQAVKESKEKFGEGIKVQGEEIKTLRFADDIVILSETAKDLEEQLNGMDSVLKGRYKMNINKSKTKVMECSVRKSGDAEGIRLGNETIKVVDEFCYLGSKITSDGRSKEDIKCRMAMGRKAFLKKRNLLTSNINLNVRKSFLKAFVWSVALYGSETWTIRSSDKKMIEAFEMWCYRRMMKIRWVDHVTNEEVLNRIGEKRSFWHILTKRRDRLVGHILRHQGIVNLALEGSVWGKNRRGRPRDEYSKQIQKDVGCRTYSQMKRLAQDRVAWRAASNQSAD

SEQ ID NO: 2413 - protein, 600 aa, synthetic construct
  source 1..600: note = Description of Artificial Sequence: Synthetic polypeptide
MAGVLEAKCKSVEECIKGKSRYRLQENKRTFGTRKQLYEYQELDGKPVLSKEGKAERWKEYIEQLYKGNELRDDVVGREEEVDQDEIGDTILRDEFDRALKDLGRNKAPGVDDIPSELLKSLGEPAMTRLFELVCRMYETGEIPSDFKKNVIIPIPKKSGADRCENYRTISLISHGCKILTRIIYRRMEKLVEADLGEDQFGFRRNVGTREAILTLRLILEDRLRKGKPTFLAFVDLEKAFDNVDWNTLFQILKSAGVKYRERRVIYNLYKSQTAVIRLEGHEREASVGKGVRQGCSLSPMLFNLYMSRRPFSDVIQFVHEQAVKESKEKFGIGIKVQGEEIKTLRFADDIVILSETAKDLEEQLNGMDSVLKRAYKMNINKSKTKIMECGLRKSGDAEGIRLGNETMKVVDEFCYLGSKITCDGRSTEDIKCRMAMGRKAFLKKRNLLTSNINLSVRKSFLKAFVWSVALYGSETWTISSADRKRIEAFEMWCYRRMLKIRWVDRITNEEVLNRIGEKRNFWHTLTKRRDRLVGHILRHRGIVNLALEGSVWGKNRRGRPRDAYSKQIQVDVGCRSYEEMKRLAQDRVGWRAASNQSPD

SEQ ID NO: 2414 - protein, 744 aa, synthetic construct
  source 1..744: note = Description of Artificial Sequence: Synthetic polypeptide
MQLLVLGIDSKQIMKTAKSTYRRVVNPPKIENFRKLLKDMNWKDVYSAHGMNEKYNVFINNVSIMFENCFPLKVTRIKQKSIIKPWITQGIKISCKTKRKMYLSAKSSCNDDDLTKYKEYCKILKKVIQASKQMHYEKKIATSGNQIKTIWDIVKEETGRTRKEQEQVALRVDETLVTDGHSVANLFNKYFISVTDSMGLSGSVNNALEYLKLAFTNNFTYMNMSLTSPQEITSIIKSLKTKHSSGYDEISTKLIKACSCELSTILSYLCNQSIITGTFPDWLKYADIKPLFKKGDKEIPSNYRPISLLPAFSKILEKVMYKQLLNHLTTNDILSRTQFGFLKGSDIEKAIYTYSENVLNSLDNKLQAAGIFCDLSKAFDCVNHNILLSKLEFYGVTGNAAKWFKSYLTNRKQRVSVQVTSELSQQSSSDWEEITCGVPQGSILGPLLFLVYINDLSSVTLPEAEFVLFADDTSIAIKSTSSIVIERSANDIFMNINKWFKANSLSLNFEKTHYMQFRTCKRFPDSICIKYEEEQIEEVDSIKFLGLQLDNKFSWEEHTTELQKRLNKSVFSIRVLSDIGDIKITKLAYFAYFHSIMSYGIIFWGNSSSQSKVFRVQKRVIRIICGVNSRTSCRSLFKELGILTTASQYIYSLMKFVINNISLFPTNSSVHTYNTRNKNDLHKDLKALTLVQKGVHYSGTHIFNNLPSSIKNLATNKDQFKRNLKDFLVANSFYSISEFLNCTK

SEQ ID NO: 2415 - protein, 433 aa, synthetic construct
  source 1..433: note = Description of Artificial Sequence: Synthetic polypeptide
MQIPVAPEGVRTKEEFALVDEDWVRDQLCNLDIYKSMGPDGMHPRVLRELAEVIARPLSIIFGKSWETGEVPEDWKMANVTPVYKKGKKEDPGNYRPVSLTSVPGKVMEQLILDSISRHIKDEGVIKNSQHGFMRGKSCLTNLIAFYEEVTRWRDDGRAVDVVFLDFSKAFDTVSHSILIDKLRKCGLDDQVVRWIKNWLKGRRQRVVVNGAESSWRSVTSGVPQGSVLGPVLFNIFINDLDEGTECTLSKFADDTKLGGVADTPEGCVAIQRDLDRLESWAGRNLMKFNKGKCRVLHLGKNNPMYQYRLGVDLLERSEGERDLGVLVEGRLRELGLFSLEKRRLRGDLISVYKYVKGGCQDDGARLFSVISSDRTRGNGCKLEHRRFHVNIRKNFFTVRVTEHWNRLPRGVVESPTLEIFKARLDKFLCDVL

SEQ ID NO: 2416 - protein, 1110 aa, synthetic construct
  source 1..1110: note = Description of Artificial Sequence: Synthetic polypeptide
MDSTAHPNQGRGLEKVSQTLPALQTPGQHTAAGGSSPLSGRNQRKNTKKLLLGAWNIRTLLDRENTPRPERRTALIGKELARYNIDIAALSETRLPEEGSLSEPTTGYTFFWKGRASNEDRIHGVGLAIKTSLLKQLPDLPVGISERLMKIRLPLSKDRYATIISAYAPTLTSTEETIEQFYSDLSAVLHSVPTNDKLILLGDFNARVGQDHERWKGVLGKHGVGKMNNNGLLLLSKCSEFELTITNTVFRMANKYKTTWMHPRSKQWHLIDYIIVRRRDIQDVKITRAMRGAECWTDHRLVRATLQMRIAPRHPKRAQTVRAFYNVSRLRDPSYLQTFQSCLDDKLSAKGPLTGSSTEKWNQFRDAVKETSKAVLGPKQRNHQDWFDENNTAIEDLLSKKNKAFMEWQNNPNSAPKKDRFKSLQATAQREIRKMQDRWWEKKAEEIQRFADMKNYKQFFSALKTVYGPLKPTTTPLLSSDGDTLIKDKKGISNRWKEHFSQLLNRPSSVDQSALDQIPQNRTIEQLDVPPSIEEVQKAIKQMSAGKAPGKDGIPTEVYKALNGKALQAFHIVLTSIWEEEDMPPELRDASIVALYKNKGSRAACDNYRGISLLSTAGKILARVILNRLLSSVSEQNLPESQCGFRPDRSTIDMVFTVRQMQEKCLEQNLSLYIVFIDLTKAFDTVNRDALWVILSKLGCPAKFVKLIQLFHVDMTGEVLSGGETSDRFNISNGVKQGCVLAPVLFNLFFTQVLRHAVMDLDLGVYIKYRLDGSLFDLRRLTAKTKTTERLILEALFADDCALMAHQENHLQTIVDRFSTATKLFGLTISLSKTEVLFQPAPGRPTNQPCITIDGTQLSNVNTFKYLGSTIANDGSLDHEINARIQKASQALGRLRCKVLQHRGVSTATKLKVYNAVVLSSLLYGCETWTLYRKHMKQLEQFHQRSLRSIMRIRWQDRITNQEVLDRANSTSIEVMVLKTQLRWSGHVIRMDPQRIPRQVFYGELSAGLRKQGRPKKRFKDQLKSNLKWAGITPKQLELAASDRSSWRTHINHAATTFEDERRRRLAAARERRHQATTAPPVTTGVPCPMCHKLCASAFGLQSHMRVHRR

SEQ ID NO: 2417 - protein, 687 aa, synthetic construct
  source 1..687: note = Description of Artificial Sequence: Synthetic polypeptide
MTNRIAYGGTSKKTVKEAANKVLGKKKKPKSKPWFDEECELWFERRKKAKLDSLQNRSDRTVEEYSNVRKQTSAIYRNKKREYQKNLIRRIETNSKENNPREMYRGINAIRKGFRSRAQLMKDENGDLVTNDNELLSLWKNYFDKLLNVHENSEELGDEIHTAELHVEEPSYQEVEAAIKKLKNNKAAGNDSIPAELLKYGGVELTFKIYKLVCAIWKNETIPENWKESIIIPIFKKGDKTDCNNYRGISLLATCYKVLSNVIQARLTPFAEDIVGDYQCGFRRNRSTSDQMFTIRQLLEKKWEFCETIHQLFIDFKKAYDSIKRSKMYQILVLLGVPKKLVRLIQICLNGSTGKVRVGGNVSEPFMIRDGLKQGDGLSTVLFNLTLEYAVRKMQVSQLGATLNGTTQILGYADDLDILGDCRETVARNAEILIKAVEYTGLEVSESKTKYMIVDKLGICRGEEDLRVGNFTFEKVSEFRYLGTTINDRNEINVEINKRLHSGNACFYAVSNLLKSRLLSKNVKIRIYRTIILPVVLYGCETWALTKQADNRFRVFENKVLRKIYGPKKDEETGEWRRLHNDELHNLYASPNINRIIKSRRLGWAGHVARMGDDRTAARVMKGRPMVTRPLGRPRRRWEDNVKADLVEIGRVGVDRRGASWVGLTQDRAAWKACVDEAMNFRVPNAT

SEQ ID NO: 2418 - protein, 866 aa, synthetic construct
  source 1..866: note = Description of Artificial Sequence: Synthetic polypeptide
MTIKLVVGECTLNVVSAYAPQVGLDEEIKRRFWEGLDDIVRSIPPSERLFIGGDFNGHIGSSAGGYTEVHGGFGFGERNGGGTSLLDFAKAFDLVIANSSFPKREEHLVTYQSSVAKTQIDYLLLRRCDRRLCEDCKVIPGETLATQHRLLVMDIGIMIRRKKRSVRGRPRIRWGALTKDKAQELEGRLSAMGAWRSSGDANTMWSTTADCIRKAAREVLGISSGRTGGHKGDWWWNAVVQGKVEAKKAAYLRLVGSTGEEEKRANSERYKVARKEAKMAVTEAKTAAFARLYEELGNKGGEKKLFRLAKVRERTARDLDQVRCIKDDDDKVLMGDDQIKRRWQTYFHKLLNEEGDQDIVLGELRNADSPHELSYCRDIEVDEVMEAMRKMRRGRATGPDEIPVELWRCVGRAGLEWLTGLFNVIFKTNRMPEEWRWSTMVPLYKNKGDIQSCNNYRGIKLLSHTMKVWERVVEMRVRRTVSISDNQFGFMPGRSTTEAIHLIRRMVEQYRDKKKDLHMVFIDLEKAYDRVPREVLWSCLEVKGVPVAYIRVIKDMYDGAKTRVRTVGGDSEHFPVVTGLHQGSAFSPFLFALVMDAITHHIQGEVPWCMLFADDIVLIDETRGGVNERLEVWRHALESKGFRLSRTKTEYLECKFGAEPTEAGVEVRLDSQVIPKRGSFKYLGSVIQGTGEIDEDVTHRIGVGWMKWRLATGVLCDKKVPPLLKGKFYRAVVRPAMLYGTECWPVKNSHIQKMKVAEMRMLRWMCGHTRMDKIRNEDIREKVGVAPMEDKMREARLRWFGHIQRRSTDAPVRRCERLAVVGTRRGRGRPKKYWGEVIRQDMARLRITEDMALDRELWRSSIKVVG

SEQ ID NO: 2419 - protein, 1067 aa, synthetic construct
  source 1..1067: note = Description of Artificial Sequence: Synthetic polypeptide
MPLVFQMPAGLHMVHRFQWSFQTKTDSEEGRGHPLLKELARENLMNSSETLSDTLLENFMNSPETLSDTVPEDEPLRLEGTQNMTGKELPHQSRTNLNDMDKVKLSGPPFADVARLKLRRNSCKHPLIIGTWNVRSMNLGKLEVVKNEMECIKIDILGISELKWTGFGHFESDNHMIYYAGNDKLKRNGVAFIITKNVSRSVLKYNAVSDRIISICLQGRPVNTTIIQIYAPTTKAKDEEIEDFYQLLQSEIDQTCNQDVLIITGDWNAKVGNKEESPVVGKFGLGDRNNAGDHMIEFCKTNDLFIANTFFQQHKWWLYTWTSPDGVHRNQIDYICGKRRWKSSISSAKTRPGADCGTDHQLLICKFKLKLKTIKTSPREPKYDLEYIPPEFRDHLKNRFDALNTNDQKPEELWDDIKNIIHEESKRSLKRQERKKRPKWMSEETLKLALEWRVAKANGRNDKIKELNRRFQRAAREDKANYYNEMCKDLELENQKGRTCSAFLKLKELRKKFKPQVAILKDSMGKILNDAGNIKRRWKEYTESLYQKELVDVHPFQEVAYDQEPMVLKEEVEAALKELAKNKAPGIDGIPIEMFQQMDAPLEALTQLCQEIWKTATWPTDWKRSIFVPIPKKGDPTECGNYQTISLISHASKILLKIIQKWLQQYIDRELPEMQAGFRRGCGTRDIIADVRWILAQSKEYQKDVYLCFIDYAKAFDCVDHNKLWITLRRMGIPEHLIVLMRNLYIDQEAVIQTEQGDTAWFKIKKGVCQGCILSPYLFNLYAEQIIREAGLYEEEHGIRIGGRLINNLRYADDTTLLAESEDDLKHLLMKIEDYSLQYGLHLNIKKTKILTTGPISSITINGEKIEVVKDFILLGSTINTNGSSSQDIRRCIALGKSAAKDLFQVLKSKDVSLKTKVCLTQAMVFSIASYACESWTMNKEDRRRVDAFELWCWRRMLKVPWTAKRTNKSVLEEVQPECSLEARMARLHLTYFGHVVRRDHSLEKDVMLGKVEGQRKRGRPSTRWIDTVAATMGSSIARIVRLAQDQAVFHSAVHRVAMSQRRLDGT

SEQ ID NO: 2420 - protein, 997 aa, synthetic construct
  source 1..997: note = Description of Artificial Sequence: Synthetic polypeptide
MRIIHNTLDIPDRSRPGLTTTATDAVNLQGVGGNLTTVGRRKRGGRRVRGQREKGKGRNIGLRIGTLNVGTMTGKGRELADMMERRKVDVLCVQETRWKGSKARSIGGGYKLFYHGVDRKRNGVGVILKGEFVNSVLEVKRVSDRMMSLKLEIEGVMVNVVSGYAPQVGCELEVKERFWSELDEVIESIPRGERVVIGADFNGHVGEGNRGDEEVMGRFGVKERNLEGQMVVDFAKRMEMAVVNTYFQKREEHRVTYRSGGRSTQVDYILCRRGHLREVNDCKVVVGESVARQHRMVVCKMTLEVRKKKRGKTEKKTKWWKLQNEETCEEFRQKLRQVLGGQDELPDDWETTAEIIRETGRKVLGVSSGKRKDGKDTWWWNEEVQECVQRKRLAKRKWDVERTEEGRQEYKEAQRRVKREVAKAKQKAYDELYDRLDTKEGEKDLYRLARQRDRDGKDVQQIRVIKDRDGKVLTTQESVQKRWKEYFEELMNEENDRERREEDVVVVEQEVAEIGKDEVRKALKRMKSGKAVGPDDVPVEVWKCLGETAVEFLTSLFNRILESEKMPEEWRRSVLVPIFKNKGDTQNCSNYRGIKLMSHTMKLWERVVEARLRKKVEICEQQYGFMPRKSTTDAIFALRMLMEKYRDGQKELHCVFVDLEKAYDRVPREELWYCMRSSGVAEKYVRVVQDMYERSMTVVRCAVGQTEEFKVEVGLHQGSALSPFLFAMLMDRLTDEVRQESPWTMMFADDIVICSESREQVEEQLERWRFALERRGMKVSRSKTEYMCLNERDQGRSVRLQGAEVKKVQEFKYLGSTVQCDGECGKEVKRRVQAGWSGWRKVSGVLCDRRVPARLKGKVYKTVVRPALLYGLETVAVRQRQEAEMEVAEMKMLRFSLGVTRLDRIRNEYIRGTAHVACVSDKVREARLRWFGHVQRRDSGYIGRRMLEMELPGRRARGRPKRRYMDVLTEDMKLANVRVEDVHDRVRWKRMIRCGDP

SEQ ID NO: 2421 - protein, 1058 aa, synthetic construct
  source 1..1058: note = Description of Artificial Sequence: Synthetic polypeptide
MKRNNEDPITSPGLASPGPHSGARPRVGARRRAPGGRGSSHGPRSGTARRSDVGPLSHGPTTRRRPQKGPVQCGLGGSRGRVPRRPKPRSWNLAFGTWNVTSLGGKEPELVREVERYRLDIVGLTSTHSLGSETQSLERGWTLYHSGVAQGERRRAGVGLLVSPQLSRQVLEFTPVDERVMSLRLRVGDRSLTVVSAYGPNSSSEYQAFLVSLEGVLESAPTGDSIVFLGDFNAHVGNDSGTWRGVIGRNAPPDLNPSGVLLLDFCARHSLSITNTMFEHKGVHQYTWHQDTLGRRSMIDFVVVSGDLRPCVLDTRVKRGAELSTDHYLVVSWIRWRGRRPERLGRPKRTVRVCWERLAEPSVREVFNSHIRENFKQVPREVGDIESEWTMFSTSIVSAAARSCGRKVSGACRGGNPRTRWWTPEVRDAVKLKKESYQAWLACGTPEAADRYRQSKRAAARTVAEAKTRSWEEFGEAMEKDYRLASKKFWQTIRRLRRGKQFSTGTVFSAGGELLTSTGDIVGRWKEYFEDLLNPTDTPSFEEAESEDFGVGLSITRAEVTEVVNELLGGKAPGVDEVRPEHLKSLDAVGVSWLTRLCSIAWRSGTVPLDWQTGVVVPLFKKGDRRVCSNHRGITLLSLPGKVYARVLERRVRPIVEPRIQEQQCGFRPGRGTVDQLYTLSRVLEGLWEFAHPVHMCFVDLEKAFDRVPRGILWGVLWEYGVRGALLRAVRSLYDRSRSLVRIAGSKSDLFPVHVGLRQGCPLSPVLFIVFMDRISRRSQGPEGIWFGDHRISSLLFADDVVLLASSNRDLQRALGRFAAECEAAGMRVSTAKSEAMVLDRRKVVCHLSVGGVSLPQVEEFKYLGVLFTSEGRSEREIDRRIGAASVVMRSLYRSVVVKRELSRKAKLSIYRSIYVPVLTYGHELWVMTERTRSRIQAAEMSFLRRVAGRSLRDRVRSSVTRGELGVEPLLLHIERSQLRWLGHLVRMPPGRLPGEVFRACPTGRRPRGRPRTRWRDYVSRLAWERLGVPPEELEEVAGVREVWASLLSLLPPRPGPG

SEQ ID NO: 2422 - protein, 878 aa, synthetic construct
  source 1..878: note = Description of Artificial Sequence: Synthetic polypeptide
MFFFSIRGGKKGGGTASIAHKTILSENILLSKYCSFEHHAFLFGDPPVLTVTVYRPPTPPSCFIEEFSEFLSSLHIRYNRILITGDFNLHVDKNDDIYACEFLNLLNSMDFQQHVTQPTHNRGHTLDLVITYGLSTGVSSVVDLAISDHYCVFFNVTSEIQQEASVRTVRKRYLTPEVAASFIDIFKQTPAQILPAPCDFIVDHFNNRLQSSIDAVAPFKTKTLRTTPKMPWKTDDIKGLKQNCRRAERRYRKTKLIIHKDILKEQLKIYNNSVKRARTSYFSKIISENKNNPKFLFKTIDILINKDFNKSSMPSSNAACEDFADHFMGKINAIRSNISSMQYTDLNRPPALFLPEETLGSFVLVDAEMLGRVVSQVNTTTCLLDPIPTSLFKTFYGFFESELLNIVNCSLQTGVFPSACKTAVVRPLLKKSQLDPKNLDNYRPVSNLPFLSKINIEKSVATQLHEFLNAQKILEKYQSGFRKNHSTETALLKIVNDLRLNYDSQKLSVLVLLDLSAAFDTVDHQILLDRLRSLVGLSGNVLKWFYSYLTDRHFYVSMDTCSSGIHEISCGVPQGSILGPILFNLYMLPLGEVIRRHGVDFHSYADDTQLYIAVSPDDLEPVNTLLNCILDIKSWMAENFLQLNQDKTEVLIIGSEDKREMILPHLHNFKPSQCVRNLGVLFDSELNFIPHIKNVVKTGFYHLKNIARVRPFLSLASTEVLMHAFIFSRLDYCNALLSGLPKKSISNLQLLQNSAARVLTRTRGREHITPVLKSLHWLPVRFRIDFKILLMVYKCFYGLGPSYLNDILLKYEPSRTLRSSGAGLLVVPKVRTKTYGEASFCHYGPRLWNGLPENLRAAETVEVFKKRLKTHLFNLAFS

SEQ ID NO: 2423 - protein, 844 aa, synthetic construct
  source 1..844: note = Description of Artificial Sequence: Synthetic polypeptide
MSSFEYVSFKIELKQTPPLLCIVMYKPPQHSQSFIDDFTEMLSVVCTDFDGLVITGDFNVHVDNVNDRNAKELNAVLETFDLIQHVSCPTHSRGHTLDLLITKGVNIYNVSVVDVALSDHFCVFFDLSVAPKPPPGPAVVQRRQINESTRAQFVEMINPENASGANVDEMLNSVTSSILNVLDAIAPMKVKLRKHRQKAPWRNDDLVRAQKQQCRRAERKWRKSKLQVHYGMYKGELYAYNQILCRTRERYFSEIIGSCSSNSRVLFTTVNRLTNPPTQLPIELVCTPKCNEFAVFFNDKVQGIKKAINSTTHITIERPPTHSKLTHFVPVTDQTVQETITRLSSSTCCLDVLPTRFLKSVLNSVLPSITQIVNMSLQSGIFPEALKTAVIKPLLKKSGLDPTVLNNYRPISNLPFLGKVLEKVVYQQLTDFLLLNNSFDVFQSGFRPHHSTETALIKVTNDIRLNTDDGKVSVLILLDLSAAFDTVDHGILLHRLQDWVGISGSALSWLKSYLEDRKYFVEIGSCVSDYMALTCGVPQGSILGPLLFNLYMLPLGQLIRSNNISYHNYADDTQIYVSLTTGEYGPVDSLSHCLQQISAWMQNNFLQLNSNKTEVIIFGPQKQREIVSSYLHSLSLKPSNQVRNLGVIMDSDLNFNSHIKSVTSAAFYHLKNIAKIKNIVSKPDLEILIHAFVSSRLDYCNGLLTGLSKRAVKQLQYIQNAAARVLTRTRKYDHISPVLRSLHWLPVPQRIDFKAALLVYKSLHGRAPKYISDMLVPYEPSRTLRTSGAGLLLIPRVRTKQGESAFQYSAAKIWNSLPEVVRQASSVFMFKSRLKTFLFSRVYD

SEQ ID NO: 2424 - protein, 979 aa, synthetic construct
  source 1..979: note = Description of Artificial Sequence: Synthetic polypeptide
MLYTIFLVYGILCFFFVYFCIYLYITVYLCFLFFLFLLLCGDVESNPGPGRARGCRLLYCNIRGLHANLAELDFVSRGVDVVCCSETLVAGRRHDAELALAGFQSPFRRLCGSGPGFRGMAVYVRSGFCAYRQSVHECACHEIIVVRVCGRLNNYYLFSLYRSPATDDSLYDCLLTAMASIQSTDPKAAFVFVGDVNAHHRDWLGSASPTDCHGVAALDFCTLSSCVQLVRGSTHIAGNCLDLVMTDVPDLMTVTVGSPIGSSDHSHLVVSLDLNQVVPVVDTRRVVFVKSRANWVAITRAVRTLPWRQIIHSEDPVSELNDLTVSILERFVPKRTILVRSRDKPWFDDQCRLAFEAKQAAYRAWRRSRDRTLWQTYVDRRAEAKRVYEEAQRRLRQRSRESLLSIDHPHRWWSELKGSVFGAEPSLPPLVGPGGGIITDPLARAELLSAHFDGKQSRDVIALPHGCHPEPRLTSLAFRSGAIKVLLEGLDPYGGVDPVGMFPLFYKQLADVLAPKLAVIFRRLIRLGNFPRCWRTGNITPIPKGPVSPYVANYRPITLTPILSKVFEKLIAGKLGRFAEVTGLLPAGQFAYRIGLGCCDALLSVSHHLQSALDCRSEARLVQLDFSAAFDRVNHRGLLYKLESFGVGGRVLSIIRDFVSERTQSVSVDGVLSASVGVVSGVPQGSVLGPLLFVLYTSDMFSSLENTLINYADDSTLMAVIPAPRLRDAVAQSLNRDLSRISAWCSAWSMKLNASKTKSMIISRSRTLVPQHPQLEIDDTLLQESSSLEILGVVFDEKLTFEPHIRRLVSRASTKIGLLRKVNSVFGDSQVARRCFYAFLLPVLEYCSPVWASAADTHLRLLDRLVSSASRLCADNDLVNLSHRRRVAELCMFYKVYNNERHWLYSSLPALKVFGRETRAACGAHSFTLEAVRCRTNQFCRCFVPWSAKVWNLLPASAFGRIGLQAFKSAVNGFLLDFL

SEQ ID NO: 2425 - protein, 1015 aa, synthetic construct
  source 1..1015: note = Description of Artificial Sequence: Synthetic polypeptide
METGGGYTFFWRGRSSDERRESGVGFAVKNHLVRKLASLPKGVNDRLMTLHLPLPRGKQATLISAYAPTMTNPDEVKDKFYEDLDALLSSVKRTDRLILLGDFNARVGSDHTAWDGVIGKNGIGKCNSNGLLLLKTCAAHDLIITNTIFRLPTRKKTSWMHPRSKHWHLIDYVIVRRKDRQDVRVTKAMPSADCWTDHRLIISKLSFRIKPKRRPQGNKAVMKKINVSRLRNPNTATLLAEDLGNQLLELQLEENAEKDWERFRDIVHSSALKVLGPSHRKQQDWFDENDEEIKAILAEKHRLHRAHQNDPSSTAKKNAFNNIRRIVQNKLRKMQDSWLSAKADEIQKFSDRNDAKRFYEALRSLYGPQPSGSSPLLDSDGATLITEKALILQRWAEHFQSVLNRPSSINNEAIDRMPQADINHSLDVSPSETETLQAISQLSSGKAPGSDAIPAEVYKGGGAVLVNKLTQLFQSFWNQGSIPQELKDASIVHLYKRKGNRQVCDNHRGISLLSIAGKILARVLLNRLINHLEQGLLPETQCGFRKERGTVDMIFAARQLQEKCQEQNRELYTTFVDLTKAFDTVSREGLWRIMSKFGCPDRFILMVRQFHDGMTARVLDDGEASEAFPVTNGVKQGCVLAPTLFSIMFSAMLSDAFQNSSLGIRLRYRTDGKLFNLRRLQAVTKIKETVLRDLLFADDCALNAGSEQEMQASMDKFAAACDNFGLLINTKKTEVMHQPAPKAQHQVPTITVKGQKLQAVDQFTYLGSTLSRSVTIDIEVNCRVAKASSAFGRLLTKVWDRRGISLATKLKVYRAVVLTTLMYASETWTVYRRHARQLNHFHTICLRRLLRIRWQDKVPDTEVLSRAGLPSVYTLLMKAQTRWAGHVARMPDHRIPKQLFYGELFQGKRSHGGQKKRYKDTLKASLKSLDIDTTSWETLAQDRSTWHTLIYQGCQTSEARRTTIAQEKRALRKARVAKAATVVPTHVCPTCGRTFRARIGLISHLRTHHEQSITC

SEQ ID NO: 2426 - protein, 748 aa, synthetic construct
  source 1..748: note = Description of Artificial Sequence: Synthetic polypeptide
MKLISSLAFLKRCRDSKVIPNAVKITHHIKSSKANQILHKASELLLIERIQHNRSELSYISESLKQLHLDISNSVSMHYWNIIDNITQQSADNVFKLTKTNQINKFSRLHNKQIPTENQKCKNKTVLNLTNTVLTGDMVSILSKGLNFAVTPRTIPVDEIIAEVESAVRLLPHNEAEMTRHEVAKIIENSKVPKVNISSNEAKALRELRVNKDIQILAADKGRTTVVMSRADYDNKIRNLLEESTYIKIKRDPTNTLERKTTAIIANSLIPKNEQYLIKPRASKPPRLYGLPKIHKIGIPLRPIVSTIGSATYQLAKYITKQIQPYIGKTSSFIKNSEHLVNVIKDIKLTPDDILVSFDVISLFTKVPVDESLKLLDTLVKNTGLQKDIPKLAGHCLNNTYFLWRGDFFKQKEGAAMGSPLSPAIANLYMENFEIRALASSTLKPSFWFRYVDDTLVVWPHGKDTLNDFLNHLNAQNPAIQFTMEMEVNNTLPFLDILLGHGLNGKITHSVYRKQTHTDAYLNAESHHHPAQKSSLIKTLVHRAKTVSDGESLVREIKHVKDALRQNGYNNAQINRALNAKSRSQSNTTESDQIVKTIKIPYISGVTDKLARVLQKQNITVRFGTVHKIQKLVSCTKDALPKLSTEGVYRINCSCGSCYIGQTGRNISVRLKEHQRNIKLSQTQLSAVAEHACQQGHSIDFDNVAVVCKTNYYWQRLIRESIEIERNKNNFNRSDSYRLSAAWKRIIK

SEQ ID NO: 2427 - protein, 593 aa, synthetic construct
  source 1..593: note = Description of Artificial Sequence: Synthetic polypeptide
MVDEIIAEVESAVRLLPHNEAEMTRHEVAKIIENSKVPKVNISSNEAKALRELRVNKDIQILAADKGRTTVVMSRADYDNKIRNLLEESTYIKIKRDPTNTLERKTTAIIANSLIPKNEQYLIKPRASKPPRLYGLPKIHKIGIPLRPIVSTIGSATYQLAKYITKQIQPYIGKTSSFIKNSEHLVNVIKDIKLTPDDILVSFDVISLFTKVPVDESLKLLDTLVKNTGLQKDIPKLAGHCLNNTYFLWRGDFFKQKEGAAMGSPLSPAIANLYMENFEIRALASSTLKPSFWFRYVDDTLVVWPHGKDTLNDFLNHLNAQNPAIQFTMEMEVNNTLPFLDILLGHGLNGKITHSVYRKQTHTDAYLNAESHHHPAQKSSLIKTLVHRAKTVSDGESLVREIKHVKDALRQNGYNNAQINRALNAKSRSQSNTTESDQIVKTIKIPYISGVTDKLARVLQKQNITVRFGTVHKIQKLVSCTKDALPKLSTEGVYRINCSCGSCYIGQTGRNISVRLKEHQRNIKLSQTQLSAVAEHACQQGHSIDFDNVAVVCKTNYYWQRLIRESIEIERNKNNFNRSDSYRLSAAWKRIIK

SEQ ID NO: 2428 - protein, 977 aa, synthetic construct
  source 1..977: note = Description of Artificial Sequence: Synthetic polypeptide
MALMMVASAGRCALFCLVLSVNSVFCQDFRSSLTRDELLNIRETTPVDLIPTFLLPAAELVGILVNAALGFAQATKRRPRGKRSGALVRLRRRGIRTVLPSFFLSNVRSLYNKMDELQLLMVKNKDFLSASALCFTETWLCDLIPDTSLQLAGFHLVRSDRDIALSGKTKGGGICFYINSGWCVDVTVILQHCSPLLESIFITCKPFYSPREFASLILVGVYLPPCPQVKEAQRMLADQILSVERANPDSLVIVLGDFNKGNLSHELPKYIQFIKCPTREGNTLDHCYTTVSRAYHAVPRAALGHSDHAMVHLIPAYRQKLKLCKPAVRTSKQWTSEAVEDLRACLDCTDWDMFTTATNSLDELTEAVTSYISFCEDCCIPTRTRVNFNNNKPWFSAKLRRLRLEKEEAFRSGDRDRFKESKNRFSKAVREAKRLYSERLKHQFSTNDAASVWRGLRQITNYKPRAPHTTNDSRLANDLNEFYCRFERQLDCPEPPLPTQEAPSPTNTTETTISFQEGEVNRLFKRQNPRKAAGPDSVSPATLRHCADQLSPVFTNIFNTSLETCHVPACLKSSTIIPVPKKLRPTGLNDYRPVALTSVVMKSFERLVLAHLKAITDPLLDPLQFAYRANRSVDDAVNMALHFTLQHLDAPASYARILFVDFSSAFNTIIPALLQDKLFQLNVPYTTCKWITDFLSDRKQCVKLGTQVSGSRSISTGTPQGCVLSPLLFSLYTNSCTSNHLSVKLLKFADDTTLIGLISGGDESDYRWEADNLVTWCSQNNLELNALKTVEMVVDFRKNTAPLTPITLLDSPVKIVESFRFLGTILSRDLKWELNISSLTKKAQQRMYFLRQLKKFNLPKTMMVQFYTAIIESILTSSITVWYAAATAKDKSRLQRIIHTAEKVIACNLPTLEDLHTTRSMRRARKIMADFSHPGHSLFQLLPSGRRLRSIRTKTSRHKNSFFPSAAGLLNKAKGLH

SEQ ID NO: 2429 - protein, 837 aa, synthetic construct
  source 1..837: note = Description of Artificial Sequence: Synthetic polypeptide
MNSSQTLSDMVPESEPPRLEGTQKTTGEELPPQSRVNLNDVDGVRPLGSSFADVARLKMRRNSCKHPLIIGTWNVRSMNLGKLEIVKNEMECINIDILGISELKWTGLGHFESDNHIVYYAGNENLKRNGVAFIIKKNISRSVLKYNAVSDRIISIHLQGRPVNTTIIQIYAPTTKAKDEEVEDFYQLLQSEIDQTCNQDALIITGDWNAKVGNKEGSVVGKYGLGDRNNAGDHMIEFCKTNDFFIANTFFNQHKWRLYTWTSPDGIHRNQIDYICGKRRWKSSISAVRTRPGADCGTDHQLLICKFKLKLKKIRTSPREPKYDLEYIPPEFKDHLKNRFDVLITNDRRPDELWNDIKDIIHEESKRSLKRQERKKRPNWMSEETLKLALECRAAKAKGRNGEVKDLNRRFQRAAREDKRKYYNDMCKELEMENQKGRTHSAFLKLKELKKKFKPRVAIVKDSTGKLLNDSESIKRRWKEYTESLYQKELVDVQPFEEVAYDQEPMVLKEEVEAALKALAKNKAPGIDGISIEIFQQTDAALEVLTHLCQEIWRTATWPTDWKRSIFMPIPKKGDPTECGNYRTISLISHASKILLKIIQKRLQQYIDKELPEIQAGFRRGHGTRDIIADVRWILAESKEYQQDVYLCFIDYAKAFDCVDHTKLWLTLQRMGIPEHLIVLLRNLYMDQEAVVRTEQGDTAWFKVRKGVHQGCILSPYLFNLYAEQIIREAGLYEEEQGIRIGGRLINNLCYADDTTLLAGNEEDLRHLLMKIKDHSLQYGLHLNIRKTKILTTGPVSNIVINGERIEVVKDFILLGSTINALGSSSQEIKRHIALGK

SEQ ID NO: 2430 - protein, 1103 aa, synthetic construct
  source 1..1103: note = Description of Artificial Sequence: Synthetic polypeptide
MITRLSMPLLNVNMPCPLLFWLVFIGLFHCRASSPAHYTLSNLSVPPPTHAMTSPGFNDVSRDNISLIITQCLGLPPLYSHPTIPLSVHYTLNLFYRPQKPAPFTLCSGRARRPILIAFSRTLILLLLCSSGDVEVNPGPAVPSSTPTPQALSFDDFCNRKSLGFMHVNIRSLLPKFVLFTALAHSANPDVLAVSESWLRKTTKNSEISIPNYNIFRQDRTAKGGGVAIYCRDSLQSSVLLSRSVPKQFELLLLKIHLSKNKSLTVAACYRPPSAPSCALDTICELIAPHLSSELVLLGDLNWDMLNTPAILQSKLDALNLTQIINEPTRYNPKAVNTGTLIDIILTNLPSKYTSAVFNQDLSDHCLIACIRNGSAVKRPPLITVKRSLKHFSEQAFLIDLALVSWKDIDLIPSVEDAWLFFKSAFLTILNKHAPFKKFRTRNRYSPWFSPDLTALNQHKNILWRSALASNSPRDMQLFREVRNQYTQAVRKAKASFFKQKFASCNTNSKKFWDTVKSMENKSTSSQLPTALRIGNSVTTDKSTIIENFNKHFSTAGHAFHLATPTPVNSTAPPTATRPSLPHFSFSQIQSADVLKELQNLDPYKSAGLDNLDPFFLKLSAEIVATPITSLFNLSFVSSEIPKDWKAAAVIPLFKGGDTLDPNCYRPISILPCLSKVFESQVNKQITDHFESHRTFSAMQSGFRAGHGCTSATLKVLNDIITAIDKKQYCAAVFIDLAKAFDSVNHHILIGRLNSLGFSNDCLAWFTNYFSDRVQCVKSEGLLSGPLAVSMGVPQGSILGPTLFSVYINDVALAAGESLIHLYADDTILYTSGPSLDTVLTNLQTSFNAIQLSFRGLQLLLNTSKTKCMLFNRSLPAPARPSSITTLDGSDLEYVDNYKYLGVWLDCKLSFQTHIKHLQSKVKSRIGFLFRNKASFTHAAKHTLVKLTILPILDFGDVIYKIASNTLLNKLDAVYHSAIRFVTKAPYTTHHCDLYALVGWPSLHTRRQTHWLQVIYKTLLGKVPPYLSSLVTIAAPTCSTRSSRYISLVTPKANSSFGRLSFQFSAANDWNELQKSLKLETLISLTSFKHQLSEQLTDHCTCT

SEQ ID NO: 2431 - protein, 982 aa, synthetic construct
  source 1..982: note = Description of Artificial Sequence: Synthetic polypeptide
MAASLRVPRKLCSILFFYVLFLTLLPQVILGFITYSREELLDIRATSTHQHYDQEYDFPEADPLFGPPPRTMDRIPAGDPKQRRRRRRGRRSGLLVRLRRRAHRAPLPSILLANVQSLDNKVDEIRARVAFQRDIRDCNVLCFTETWLTRDTLSESVQPPGFFTHRADRNKHLSGKKKGGGVCLMINETWCDHNNIQELKSFCSPDLEFLTIKCRPHYLPREFSSIIITVVYIPPQADTSTALKELHWTLCKLETTYPEAAFIVAGDFNKANLKTRLPKFYQHIDCATRAGKTLDHCYSNFRDAYKALPRPPFGKADHDSILLLPAYRQKLKQEAPALRSVQRWSDQSDSTLQDCFDHVDWDMFRIAANNNIDEYADSVCEFINKCIGDVVPTASIKTFPNQKPWIDGSIRAKLNARTTAFNQGKVTGNMTEYKQCSYSLRKAIKQAKRQYRDKVESQFNGSDTRGMWQGLQSITDYKRKTSPVADHDALLPDRLNNFFARFEDNTVPLTRPATKTCGLSFTAANVSKTFKRVNPRKAAGPDGIPGRVLRACADQLAGVFTDIFNQSLSQSAVPTCFKRATIVPVPKKAKVTELNDYRPVALTSVIMKCFERLVKDHITSTLPDTLDPLQFAYRPNRSTDDAIAITLHTALTHLDKRNTYVRMLFIDYSSAFNTIVPSKLVIKLETLGLDPALCNWVLDFLTGRPQVVRVGNNISTPLILNTGSPQGCVLSPLLYSLFTHDCVAMHASNSIIKFADDTTVVGLITNNDETAYREEVRALGVWCQENNLTLNVNKTKEMIVDFRKQQREQPPIYIDGTVVERVESFKFLGVHITDKLKWSTHTDSVVKKAQQRLFNLRRLKKFGLSPKTLTNFYRCTIESILSGCITAWYGSCSAHNRKALQRVVRSAQRITGCKLPALQDTYTTRCHRKAKKIIKDNNHPSHCLFTPLSSRRRGQYRCIKAGTERLKNSFYLKAIRLLNSHH

SEQ ID NO: 2432 - protein, 1131 aa, synthetic construct
  source 1..1131: note = Description of Artificial Sequence: Synthetic polypeptide
MCSFAQYISPPQNPHITQRRSSPPRIPILLRGDISPPQNPHITQRRYPPLRIPILLRGDIPPSESPYYSEEIFPTLEEETCHFQAQGNVLICGDTNARTGTLPDLTSTRGDSFITGHTVSNCLHLPHRNNSDSTVNKNGRDLLQLCRSLGLYFVNGRLRGDSLGRFTYCSPLGHSTVDYMITDIDPFSLSSFTVKPLTPLSDHSQITLFLKRTDMETTTHSQPSKLYNIRNSYRWAQNSTEEYQKATWNQNIQTLLDNFLDTTFTHSKEGINLAVKNINYIFRQTAKEAQLKLIKNKTKKITDDNWFDADCKIIRKKLRTLSNQKHRDPNNGELRLHYCETLKLYKRTLRTKKAQYNSKQLTLIEESINTNNFWQNWKKLKKSKQEELAIQNGDIWTTHFKTLYNTVQIDTNAEQRQIHEKLNGLEKAIKDNQNPLDSPITDQELYKKLQALKFKKACGPDGILNEMLKLTSAKFQLAILKLFNLILSVGYFPDIWNQGLITPIFKNGDKFDPNNYRGICVNSNLGKVFCSIINVLSKSQIGFIPKHRTTDHIYTLHTLIDKHVHQNNTKIYACFIDFQKAFDSIWHTGLFYKVIESGVGGKTYDIIKSMYTGNTCSIKIGKKRTEFFNQGRGLRQGCNLSPALFNIYINELATILEKSSAPGVSLHNSEVKCLLFADDLCLLSPTAHGLQQSLDLLEQYCQTWALAVNPKNTCPREDPGPVRPVLQDLCLLSPTAHGLQQSLDLLEQYCQTWALAVNPKKTKIMIFQRRSRSQGIRPKFSIGTKYIEYCTHYNYLGLKISSTGHLNEAVNELREKARRAFYAIKKQIQIEIPIKIWLKLIEYVIEPIALYGSEVWGPLAKQDFIKWDKHPIETLHAEFCKILLHVQRKTTNNACRAELGQYPLIIKTQKRAIKFWKHLKYSDPLSYHYQALQCQELSKEKSPLIQLVLGLSSQTCSTNTLKPQDQNIQSIRINQITTQSKQNYIAYWETQAQTQSKMQCYLALNRQYTVANYLTMVTDQNLRKTLTKYRLSEHSLAIEKGRHRKTWLPVEERLCNHCTTAEPETELHFLTKCQKYKTIRECHFPKFETLIQGFKDLSDEDRLPVLLGEDAESCGLAAHYIAACHKMRDSV

SEQ ID NO: 2433 - protein, 1102 aa, synthetic construct
  source 1..1102: note = Description of Artificial Sequence: Synthetic polypeptide
MITRLSMPLLNVNMPCPLLFWLVFIGLFHCRASSPAHYTLSNHLVPPPTHAMTSPGLNVSRDNISLIITQCLGLPPLYSHPTIPLSVHYTLKLFYRPQKPAPFTLCSGRHRRPILIAFSRTLILLLLCSSGDVEVNPGPAVPSSTPTPQALSFVDFCNRKSLGFMHVNIRSLLPKFVLFTALAHSANPDVLAVSESWLRKTTKNSEISIPNYNIFRQDRTAKGGGVAIYCRDSLQSSVLLSRSVPKQFELLLLKIHLSKNKSLTVAACYRPPSAPSCALDTICELIAPHLSSELVLLGDLNWDMLNTPAILQSKLDALNLTQIINEPTRYNPKSVNTGTLIDIILTNLPSKYTSAVFNQDLSDHCLIACIRNGSAVKRPPLITVKRSLKHFSEQAFLIDLAGVSWKDIDLIPSVEDAWLFFKSAFLTILNKHAPFKKFRTRNRYSPWFSPDLTALNQHKNILWRSALASNSPRDMQLFREVRNQYTQAVRKAKASFFKQKFASCSTNSKKFWDTVKSMENKSTSSQLPTALRIGNSVTTDKSTIIENFNKHFSTAGHAFHLATPTPVNSTAPPTATRPSLPHFSFSQIQSADVLKELQNLDPYKSAGLDNLDPFFLKLSAEIVATPITSLFNLSFVSSEIPKDWKAAAVIPLFKGGDTLDPNCYRPISILPCLSKVFESQVNKQITDHFESHRTFSAMQSGFRAGHGCTSATLKVLNDIITAIDKRQYCAAVFIDLAKAFDSVNHHILIGRLNSLGFSNDCLAWFTNYFSDRVQCVKSEGLLSGPLAVSMGVPQGSILGPTLFSVYINDVALAAGDSLIHLYADDTILYTSGPSLDTVLTNLQTSFNAIQLSFRGLQLLLNTSKTKCMLFNRSLPAPARPSSITTLDGSDLEYVDNYKYLGVWLDCKLSFQTHIKHLQSKVKSRIGFLFRNKASFTHAAKHTLVKLTILPILDFGDVIYKIASNTLLNKLDAVYHSAIRFVTKAPYTTHHCDLYALVGWPSLHTRRQTHWLQVIYKTLLGKVPPYLSSLVTIAAPTCSTRSSRYISLVTPKANSSFGRLSFQFSAANDWNELQKSLKLETLISLTSFKHQLSEQLTDHCTCT

SEQ ID NO: 2434 - protein, 979 aa, synthetic construct
  source 1..979: note = Description of Artificial Sequence: Synthetic polypeptide
MAPEGMAAVLSALNQPCYFVCFFALFVTCFVHNVAATVSYDRKELLDIRTAITHLKLDKEFFFNESDGRDILQTPDQAQIPVIRWRRKRRFRGKRSGCLVRIRRRVANLPLPSVLLANVQSLENKWDELKARISYQRDIKNCNILCFTESWLNDDIKNIQLAGYTLYRQDRTAASGKTRGGGLCIFVNNSWCTISKEVSRFCSPEVEYLMISCRPHYLPREFSSVFFVAVYIPPQTDAGTKTALNELYTAISKQENAHPEAALLVAGDFNAGKLKSVLPNFYQHVKCATRGKKTLDHLYSTHRDAYKALPRPPFGKSDHNSILLIPAYKQKLKQEAPVTRSIKKWSDEADAKLQDCFASTDWNMFRDSSDGIEEYTTSVTGFINKCIDDVVPTVTVRTYPNQKPWITGNIRTELKGRAAAFKERDSNPEAYKKSRYALRRTIKQAKRQYRTKIESYYTGSDARRMWQGLQTITDYKGKHSRELPSDTSLPDELNNFYARFEASNTETCMRASAVPDDCVITLSAADVSKTFKQVNIHKAAGPDGLPGRVLRACADQLASVFTDIFNLSLSESVIPTCFKQTTIVPVPKNTKVTCLNDYRPVALTSVAMKCFERLVMAHINTIIPETLDPLQFAYRPNRSTDDAISIALHTALSHLDKRNTYVRMLFIDYSSAFNTIVPSKLITKLRTLGLNTSLCNWILDFLTGRPQVVRVGNNTSATLILNTGAPQGCVLSPLLYSLFTHDCTARHDSNTIIKFADDTTVVGLITDNDETAYREEVRDLTVWCKDNNLSLNVIKTKEMIVDYRKRRTEHAPILIDGAVVEQVESFKFLGVHITNKLTWSKHTKTVVKRARQNLFPLRRLKRFGMGPQILKRFYSCTIESILTGCITAWYGNCSASDRKALQRVVRTAQYITGAKLPAIQDLYTRRCQRKALKIVKDSSHPSHRLFSLLPHGKRYRSAKSRSKRLLNSFYPQAIRLLNS

SEQ ID NO: 2435 - protein, 1037 aa, synthetic construct
  source 1..1037: note = Description of Artificial Sequence: Synthetic polypeptide
MCLSIPVLSSLHRPYKRFTPRGRCHSNLVVPARTTHVEFQVSGSLWNCRSAANKAEFISAYATLQSLDFLALTETWITTDNTATPTALSSSAHVFSHTPRASSQRGGGTGILISPKWTFSLSPLTHLSISSFEFHAVTVTSPFKLNILIIYRPPGSLGEFINELDALISSFPEDGSPLTVLGDFNLPTSTFDSFLSASFFPLLSSFDLTLSPSPPTHKAGNTLDLIFTRCCSSTNLIATPLQISDHYLVSFSLLLSSNTSHSAPTRMVLRRPNLRSLSPATLSSSILSSLPSAQTFSNLSPDSASSTLLSSLSASFDFLCPLSSRPARSSPPAPWLDDSLRAHRTGLRAAERKWRKTRLPADLASFHSLLSTFSSSVSAAKATFYHSKFQASASNPRKLFATFSSLLNPPPPPPPPPSLRMTSSTILKRRLTISDPRLLSQTTPLVLLTLPYPVLEALCYLLLPPESSSPSPPSSLSADDFVNHFEKKVDDIRSSFAKSNDTAGPAHTALPCALTSFSPLSPDEISRLVTAGRPTTCPLDPIPSSLLQTISGDLLPFLTSLINSSLTAGYVPSVFKRARVAPLLKKPTLDPSDVNNYRPVSLLSFLSKTLERAVLGQLSCYLSQNDLLDPNQSGFKTGHSTETALLCVTEALRTAKANSLSSALILLDLSAAFDTVNHQILLSTLSELGISGAAHAWIASYLTGRSYQVAWRESVSAPCALTTGVPQGSVLGPLLFSLYTKSLGSVISSHGLSYHCYADDTQLIFSFPPSDNQAANRISACLSDISVWMTDHQLKLNLGKTELLFLPGKDCPFHDLAITVDNSLVSSSQSAKNLGVILDNTLSFSTNIKAVTRSCRFMLYNIRRVRPCLTQEAAQVLIQALVISRLDYCNSLLAGLPACAIKPLQLIQNAAARLVFNLPKFSHVTPLLRSLHWLPVEARIRYKTMVIAYGAVKGTAPPYLQALIRPYTQTRALRSSTSGLLAPLPLRKHSSRSAQSKLFAALAPQWWNKLPHDARTAESITTFRRHLKPHLFKEYLG

SEQ ID NO: 2436 - protein, 1016 aa, synthetic construct
  source 1..1016: note = Description of Artificial Sequence: Synthetic polypeptide
MLPPIMNTEAVFLKPRTPFKLASFNVRTLMQIRQQIGLAMSLEGLNVDVCCLSETRIQDSSEVLQIRSPSVASKSLFHVRLSGDPVASSSGLAGVGVALSARAEAALIDWIPINSRLCAVRLESSIKVRRNRREKRCLFVISAYAPTDCSPDAIKDEFYHQLTVLLQKARSTDIVVLAGDLNAQVGRLGTEESRLGGRWGLVGRRTDNGDRLLQLCTDHNLFLASTNFRHSHRRCATWRPPSASQAWTQIDHIAISYRWRGCVQDCRSFWSTYLESDHALVCANLTLLFSGRRIDHHQRIDVSKLAATSVASKYRAELASRLATIPPKSIDEHWLHLHDAMKMASKAACGFAKRPAYKHWVSSGSLQLMEARRSTPGDREFDHKRRLLRNEIGQSLRKDREAWWSERANEMEAAAASGNCRKLFQLIRATGSKKSGVSETIYEDDGMPITNISRRLGRWAEFFEGQFNWPAAPATSTSLSCPPWPVTTDPPNEAEVRKELQLLKRYKSPGPDDLPPALFKDGGDFLTKELTVLFAKVWEQESVPTSWNESIVVPIFKKGSRCSCNNYRGISLLPIASKLLASIILRRLFKTRERLTREEQAGFRSGRGCIDHIFTLRQMLEHRHTYRRPTIVVFLDIRAAFDSLDRTVLWDCLLKKGVPEKFINILKALYTNTSGRVRAYNHLSPLFHSSSGVRQGCPISPFLFNFAIDDILETALMDVSNGGVDMLPGERLLDLEYADDIVLLCDNAQGMQSALNQLAISVRRYGMCFAPSKCKVLLQDWQDSHPVLTLDGEQIEVVEKFVYLGSYISAGGGVSDEIDARIMKARAAYANLGHLWRLRDVSLAVKGRIYNASVRAVLLYACETWPLRVEDVRRLSVFDHRCLRRIADIQWQHHVSNAEVRHRVFGRRDDNSIGVTILKHRLRWLGHVLRMSSQRLPRRALFADSGTGWKKRRGGQCMTWCRGMKESCKGLASVGPSRLPGWGPRDGATQWLETLSDMAQNRSQWRSCCNLLLLST

SEQ ID NO: 2437 - protein, 2266 aa, synthetic construct
  source 1..2266: note = Description of Artificial Sequence: Synthetic polypeptide
MKIEIGEFAALFQRFFEQLNAKSKQEEEFRNESVPGSRVPSEDMPVFQINERFHALERSNELLNGKMDSIVNTLNYLISGLNGNFDNNNKLNCICKTNHVKEPLSIVKTNLVSELPSALLVQNKVPCLKLSEEDLIRKIPTKIVPSKKVSKKTIEHTSRVNFSLFVRVLDSNERQQFFKLFPNLFALLKSKESEKKSEVLNIELTKISKKDNPLNIAGFKNFFFRNNNICVTIDFYNSSKVKSKITKNLKIKTSLINSKIVKNYNTNKFIPASLSIKKFLFVLSDKLAETTNISNVTVREEQINKIITLLKIKNSLPDYLVKSQIKYKDGDFLMLDLLNSCEIEGELGQKITELSRSQIKELFNSFPEIQELFFIEKKANSGTFFHRKKSIDENPEKLINLINKFKIEKTFPQQISFVGGKFVKIDKLNDSQFPQVESESDIMFNLGLFSLFGLSEYDNILNSLLCQPKSPEKLVDIIFHLNYLNLKGNFDTSTNGTYENYVQNYIVNCLLMHSILDLETCAFLNLDNIELWAPKLIELIPSSSHYSSSCKEKLLKLKQWKLSGEIDRIHNIICPETIIEINNFLGVIDQSYTTKSDQLKFLTSLGEKINNIEIDNDVDDLVKAKRMLYFIIRDKKRFLNKDNFNYRIPFNCRKICTLKMSDFITKLIQSNELFEEREAVVDNNIDVSPNENLNILIVEPVNPTPDTVIVGQMDTFPTDIDETEPVTIDKPLKKITSKQAVKPKAQKSKREVPASVSISVPISEETDADSTIINYFFPERDPKIWFTDDDIDYYLESHIGNPNFAPVKCFIVEILSSNCKDEIFPMPDNLFKAQIILCPLNINESHWILFVYCKLTKISYFVDPILRKRHNLINKSSALKITMALNNLFDLKAAVTFHPHDNLVYQDNNYDCGPYICAYAMLISQEWQTFPNNFIETIRKNVHRFQTSKFQNPPKVSGGGITTLPIFKRFQNVTRPPKVALPYKASLQNENSCVPSLIKEWFSNKNYITVLSPELTLNLIAHNNQFIRENVTFRQFTRVKYVIAVIPNNPHWCLYIFSPVFEHSYILNFQGRVLNERLVSIGESMTDYLNKFFISTAKVNFIVNHNQTHFSFRSEDPHFFASAFIEFLERFFFGNILSFTKINETLKSFKLQITNEICKNLNLINFSINDEIITKYFKNLNLPSNFIFLNSAMCTAIMDDCTRYLNDFLNYDNIIKAQVIFAIVAPPKFREILFIIDYNTDEYYLLNPTTLLGNDNYLSTCKILRNKINEIRESPNRVLNLGECPHDIRGSGLVSKILFCSYMSNYANDLPLVGLNLRQIGNVVSSFLPIVSEIKKVKSLENNIINQNHKESENLKERKNKIDQLLIKVFKMNVDEIVDVILDQISIKTVPTHKPYLGNKERVESQINKSNLIKNFNSDMKTTVNTIINDVDVDVRPKYENIITNFEHKIPLDRTWDKVFKFCNRSDKKLKLKYLSNSEVLFELKKADNTSPGVDGIKYRDLVMLDPEGKLLTFLFNKIISKKVIPDSWKSFKTLLIPKPDKGDKYDNVSSWRPIALLSVIYKLFASCLANRLTFWINKNNLLHIGQKGGSRHDGCVEHNSILSSALEHSKYSKNSPLAIAWLDIKDAFGSVPHAYMWSLLRFVGVDEEFVTILERMYSDTSTFYSCGPILTPNIAIRQGVKQGCPISMILFALAINPVLEAVSRSKCEPFMIGESAVKILAYADDIALVSKSAYDLQRVTNIAVAIASEIGFEYRPEKCGYIELPLIETESQILINDIKIKKLASSEFYQYLGVPVGEETDQSPYDILKKVVSDTRKIADSDLLGWQKLKAYKIFLHSRLVFPFRTREIKTSALAKSNANNNLTVNITSQLRNCFRKMMSLPNHSEVCYFYNSTENGGANCVDLLDEYHTQTITHFFRLFTSSCEFARKVNLDSLNFVAGPRLGIINPTLQERFDWINGKEPKPRHSGKKTRFQRARIAIAFFKKEHDINIMFIVTKGQPSLFITSEKRGTFILTPDLRKTTSKVLHMALCDSYLSKWEKSCTSNFIASAIKLSPKINKAIYRGDISEFAWHFIHRARTNTLSINAKPHNKGNKRLCRLCHTEDETMSHIIQSCKIHLTLGSERHNDCLDLISSHLSKNSNLIVVVDHVCSLVPESKERVDLMITDMVRKKIFLVDMKCPCDTINNFALVDLLNLQKYDSLKMQIQDAKPDFKVELDTCIIGSLGSFPPKTPELLLKIGVDRTHLKGLLKDCALSNISHSARRWH

SEQ ID NO: 2438 - protein, 1251 aa, synthetic construct
  source 1..1251: note = Description of Artificial Sequence: Synthetic polypeptide
MSVNLKLLSINVRGLRDRVKRKKIFQWCKMSANMIFLQETFSTEDIEYSWKGDWEGSMFFSHGSNHSRGVIVMFKPGITFVVEKTLIDEGGRYVIIKGKCQGEKLILGSVYFPTRNKENAQCDFLSDLNKIICSVFSQEYSLIIGGDFNVIMNHNLDYMGASNISKSKYRDSLLDFLDKLDLIDVWRKRHPNKKEFTFRQKQPLVQSRLDYIFISSKVDKLIRKSEILPSITPDHAGVRIEFNNLVDSFVYGKSYWKFNSSLCNEKDFVDGVKKKISEIEETWRNQITSKIKFWDFMKMKLREYIMKFSRERAKLRRVHIAKLEKEIKDLEYRLTINIDCHKSIQDEIDMKKMELEKLFDYSRQGLKVRSRTEWSEEGEKNSKFFEQLLKSNKRKSVIKEIYNENKETVRDGKGILKIIREFYENLYACKNGEITEDIENMFLNELPKLSKENKEYCEGKITLAECYQAVKEMKWNKSPGNDGFSTEFYFTFWPILGKTIVEAFNESFETKMLSNSQRQGVITLIEKEGKDPLYMKNYRPITLLNVDYKILSKVLATRVKEVLEDIIHYDQVGYVKDRNIGEAVRLIDDTFFQSLYQPVGFLIAVDFEKAFDCISHKLLFKALEQFGFGKVLCSWVKTLYTNVSSCVMNGGHSTGYFGINRGVRQGDPLSPYLFVIVIELLARYIRKDESIKGVGFGNKEIKQVLYADDITLFLKDMDSINKVKKVFKNFEKLSGLKINMDKTNFMWLGEESDRPGLPFFGHRVQHIKILGVYFARHSKIKDDLNYKEILSKIKRLIGWWKQRDLTMFGKIKLLKIYVFSKLNYVSSLMTVPQNIFEEIEKISFNFIWGGRDRIKRKILYQDYCAGGLRVTNFKIFIKTQRIMWIKRLLYGEKYSGWKVTFDHFFRSLGGRIIFLCNYDINKMDLKGIPSFYKDMLKAWQELDKCRHFGENKNNPIIFSNKCICLSNKTFFDVELFQKGILQASDIIVRGHLKPILHFLNLGFETKSLLRIQKIFSAIRNDWIQSDFMEVDTENFEIELMIFGRLQKLCDIKSRRLYDYFIEDLQKEYTLHVTDGNCQFDLGMTELKETFTRMKCAMLCNKHREFQYKQLQGAVYTKRELFKFGFESDHFCSFCRLEVETYQHLFLDCLKVKRLWQEVIQKLHLIEIDIDDWKPIFMGISGNTARIFVINCIIFLVKYIIFISRKEGTLPSVQKTVHMLKNYRDEEYKIAFKKGKLGMHLQKWEQIDAFLL

SEQ ID NO: 2439 - protein, 456 aa, synthetic construct
  source 1..456: note = Description of Artificial Sequence: Synthetic polypeptide
MQVNKALRRINTRKATGPDNIPGRALRACANELTDILTSIFNLSLSQRVVPSCFKTTTIVPLPKKSPPTCLNDYRPVALTPIIMKCFERVMLTHIQSSIPDTLDPLQYAYRPNRSTSDAIAAALHTSLSHLENKDSYIRMLFIDYSSAFNTVVPHKLTHKLFSLGIHPIICDWLLDFLTGRPQSVRIGNRTSASIITNTGTPQGCVLSPILYTLFTHDCVASHKDNIILKFADDTAVIGRITGGDEAAYRREVASLVTWCEDNNLTLNTDKTKEMIVDMRKERRNPHQPLLIRGLEVERVSSFRYLGVHLSQDLTWTLNTSQLVKKAHQRLYFLRRLRRFGMSPKILSNFYSCMVESILTSCITVWYGSSTAADRKRLQRVVKTASKITRTPLPSLQSIYKRRVCRRAASIIKDPTHPQRGLFTLLPSGRRYRSVKCRTTRLKNSFFPSAIRLLNS

SEQ ID NO: 2440 - protein, 850 aa, synthetic construct
  source 1..850: note = Description of Artificial Sequence: Synthetic polypeptide
MANTIESMTFWGCLDDLVRSITLDQFLFVGGDFNGHIGARADGYQGVHGGFGYGVRNDNGSTLLEFATAHDLVIVNSCFRKRDDNLITFRSGGHATQIDYLLIRSRDFRFCSYCKVFPVEACASQHRLLVMDLSLDGPPMEGLRVVTPRILWRNLHGSKVAEFKDMLEGFFRLEDDVDQMWIRMADLIRGVARRTLGVASGNVKEQRESWWWNDDVQAKVQFKKGCFLEFMSCPEGPDRHIKRELFKLAKRMAKQAVAEAKTKAYQDMYRRLGTKEGVNEIFKLAKARNKRSQDIGAVRYIKDEGDRVLLYDGDIIARWGRYFSELFNAARGREIVFEQENVNVSHNDVGMSQDITMAEVRVALGMMGKGKTVGLDEIPIEVWQCLGEQGVRWLTALFNVIFRTSRMPSEWRLSVVVPIYKNKGDAQSCSNYRGIKLLSHTMKLWERVIECRIRRIVTISVNQFGFMPGRSTIEAIYLIRCLMEKYRECRKDLHMVFIDLEKAYDSVPRVVLWRCLAARGVPEVYIRTIQDMYSAVGTCVRTPVGDTQYFPVEVGLHQGSVLSPLLFIIVLDVITRDIQAPVPWCMLFADDIVLIAESRSEVNVKLEQWHMSLEGYGLRLSRSKTEYLWANFSEEIHEADVAVCIAEGRVPQTNTFKYLGSIIQSNGDISADVTHRISTGWLRWWAATGVLCDKNVPLKLKGKFYRVAIRPSLLYGSECWPLRKAQERRLETAEMRMLRRICGNTMTDHIPNDTFRRLLGVESISKKIREGRLRWYGHVRRKCNSAPVRRVEHISVRGKRKRGRPRRTWADQLSLDMGALNLTGDMTLDKNDWRRRIRVVETRSRGSQRL

SEQ ID NO: 2441 - protein, 655 aa, synthetic construct
  source 1..655: note = Description of Artificial Sequence: Synthetic polypeptide
MRSTMLSNEFLTKSVINLSQKNLTDEQINLLSRGLKFSPVTKLKNHDDFIVNIERGLHQLAPGGHINYLRHQVTEILAKNKIQPNNLTKVQRDALTDLRQDNKIAILPADKGKATVIMDKKEYQETVTELLSDAKTYRRLRKNPTSIYKDRLDKKLNELESSNQITNQLKFKLRSSRHPRSPYARATIKIHKNPIKARLLICSRDSVFYNIAQHLSRILAPLGKTADSFIKDSEEFVTKLKELQITGKMYSYDVVDLFTNVPCKDVLSIIRDKISKLETPLDTTLTTDSIVDLIQMCMSSTYFTWGDEIYEQIHGLPMGSPLSPLITEIYMTAFEEKTMETSPISPICWFRKVDDTFVMLRAEDDPSALLLNAQHKRINFTMEAEEDDSIPFLDVRIKRLGGQLKTCVYRKPTHTDQYVNYHSNTPQHVKRAAITALVRRAKRICDPEYFQQELQHIKKVFCLHNNYPPAFVHQAFRSVLMAKPTNQQPNPNRPSTRLAIPFIGKASYQIKKILKKSVGIETVFSGNSTLKDLLRASGKLNPSNNQKPKGCVYQVECSCGSSYIGETKRPLDVRLKDHQDKPGNEGTSAVAEHLAMGRKTGHKVNFDNTNILTINKHIDKTRRLHEAIHIRRYQPDLNRDEGVRLSHAYDKLINL

SEQ ID NO: 2442 - protein, 964 aa, synthetic construct
  source 1..964: note = Description of Artificial Sequence: Synthetic polypeptide
MIPELCSTGLKICHININSLPHKMDELKILLGNDPFDIVAISETHCDSTITDLDISLDNFCVTRKDRSRHGGGIALYVKNNISYEVISQLDNELEVIFVKVKQKQTHPLYLGVVYRPPNSPNEFFDKLSEIIHSISENAGEIIIIGDFNCDLLPEICTPFSRALLSLMDTNLLHQLISVPTRVTPHTKSLIDHVFSSIPEEHQHTGVVKTHISDHYLIFTVFGYARAKQKNDDNIIEYRCFRHFSNDNFVTMLQNLPFNENLNDKDPNHAWQCWVDLLISAVNKHAPVKSKRIRSKLCPWITGDLIEAMNRRDWLYTMATKPSNPDSSEFWSEYKSLRNEITCMIRNAKNDYINALLHENGGTPNAMWKTLKLISSSKKESNLKLEVDGEEVIDAEKIANHFNNYFVDAVDTMFNPLNFENDVNNSTIDRASEPSVHSDTVDTVPPVNSFDLPVITDEFVMKEIERIPIKKATGPDDVSIKLLKFACNSQNVIQSLTYILNSSLDQGIFFDEWKIARVQPIYKAGSKLSVENYRPVSLLSIPSKILEKAVNTEFQEYLKVNKILTERQFGFRPNHSCETALLCMVDLWAQNVDKGNLNGVAYIDMRKAFDAVNHSTLLMKLKNVGCTDRAIKWFRSYLGGRSQFVSIKGKKSSTRTINYGVPQGSVLAPLLFSIFINDLPTSIHSADMFLFADDATMSVQGKTLSEIQTKLNLALDEVYSWTQKNKLLLNTTKTKVMVIGSKQKLQTLNENNLNVRIKTTPIECVTQYKCLGVIVDSNLLFSKHVEKVALQMKQKLGILRRLKGTFNKHYLSMIYWGYILPHAMYCCTVWTNRSLHNYETINKLHKRAAYIISGCSWSTPSHEVLLQLNWSTLEALYSRAMGIMAFKCVHHLAPALLANKFILHDDVAQRMTRNSHELKLESNRCNTEFFKRSFVNSAITLWNNLPIETRFSPNLNVFKSNLSH

SEQ ID NO: 2443 - protein, 1112 aa, synthetic construct
  source 1..1112: note = Description of Artificial Sequence: Synthetic polypeptide
MATTQASVKPTAVATCVCGKICKNPRGLKIHQTKMGCLASVQPEQRARFSLSESREVPARAEPYGPQQPHSPEALGETQEERGQESPHSAQNLRAQVAQAPDNPQHHRRVKWPPASKVSEWQQLDEDLEGILESTAKGGVDRKLQTMTTLVISFATERYGTMEKRAAPEKYTKNRRAEKISQLRQELRVLKKQFKGASEDQKPGLAELRCTLRKKLLTLRRAEWHRRRAKERAKKRAAFLANPFGFTKQLLGQKRSGHLECAKEEVDSYLHDTFSDAERENSLGECRVLISPPEPACSFNTKAPTWKEIQTVVRAARNNSAPGPNGVPYLVYKRCPKLLARLWKILRVIWRRGKVAHQWRWAEGVWVPKEEKSTLIEQFRTISLLNVEGKIFFSILSHRLSDFLLKNQYIDSSVQKGGIPGVPGCLEHCGVVTQLIREAREGRGSLAVLWLDLANAYGSIPHKLVEMALARHHVPGPIKTLIMDYYDSFHLRVTSGSVTSEWHRLEKGIITGCTISVIIFALAMNMLAKSAEPECRGPITKSGIRQPPIRAFMDDLTVTTTSVPGCRWILQGLERLMTWARMRFKPGKSRSLVLKAGKVTDRFRFYLGGTQIPSVSEKPVKSLGKMFDGSLKDAASIRETNDQLGHWLTLVDKSGLPGKFKAWVYQHGILPRILWPLLVYEFPISTVEGLERRVSSCLRRWLGLPRSLSSNALYGNNNKLTLPFSSLAEEFMVTRAREVLQYRESKDPKVALAGIEVRTGRRWRAQEAVDQAESRLHHKELVGAVATGRAGLGTTPTTHLSRLKGKERRDQVQLEVRASIEEQRASQWVGLRQQGAWTRWEEAMARKISWPELWRAEPLRIRFLIQSVYDVLPSPSNLFLWGKVESPSCPLCQGRGTLEHILSSCPKALGEGRYRWRHDQVLKAIAESISSAMEYSKRLPLPGRGVRFVRAGEQPPPQPRAQPGLLATARDWQLRVDLGKQLKFPENIVETNLRPDIVLHSQSSKQVILLELTVPWEERMEEAYERKAGKYAELVEDCRRAGWRSRCLPIEVGGRGFAGKSLCKAFSLLGITGMRRRKAICAASEAAERASRWLWIQRDKPWTSASWTQAGN

SEQ ID NO: 2444 - protein, 1037 aa, synthetic construct
  source 1..1037: note = Description of Artificial Sequence: Synthetic polypeptide
MNDHLSANMHRTLSHSGRTTSSTMEAPTPPSTVESLQPALISRPDPVVGRGGGVFQPVLSGKYNKITDSLLPDISPPSSLRIYYQNIRGLRSKIDSFFLAISELDYDVIVLSETWLDDCILSSQLFGSNYSVFRTDRSALNSDKGRGGGVLIAVSSRISCSVDSAPVSNQLEQLWVKIVLPRNNVSIGVIYLPPDKKNDIDTIQRHIESIGAVHSHLHENDMAMLFGDYNLSDVHWTSDANDNVFVDLTRTRLNPASSTLLDGFCFHGLSQVNTIVNSGGRTLDLVLLNDVVLPNHSIHEAVEALTTVDVHHPPIELVVSCPLPVVYETVSDNTGFDFKKANFESLNVALRSMDWDRLDSIEDVNEAVAFFTNSVMQAVAEHVPPRRPPSKPPWSNSRLRLLKRRRSAALRFYRSHRSQQSKLHFNRSSSEYRSYNAYLFAQYKSRTEQNLRSNPKQFWSFVNTKRNEDGLPTSMYLDELSADSASDKCELFAMQFKRAFNDYASPASQIDRALQDTPQDVFSYDMFHVSEEEVIGAIGKLKFSYNPGPDGIPPALLKRCSSTLLAPLTKLLNHSLRQQVFPACWKKSFLFPIHKKGDKRCVSNYRGITSLCACSKVFEIIVNDSLFESCKRYISTDQHGFFPKRSVSSNLVEFSTLCIRAIDAGKQVDAVYLDLKAAFDRVDHRILLQKLRKCGVAINFVDWFRSYLTERSLCVRIGESESASFTNISGVPQGSNLGPLLFTLFINDVSLLLPTGNRIFYADDAKIYMIVESLDDCYRLQHLLNLFEAWCTRNCLTLSIEKCQVISYGRKRSPIRFPYELSGTTLERVKCVRDLGVTLDEKLTFNCHLNDVISRANKQLGFVLKVSSGFKDPLTLKALYCALVRPILEFAAIVWCPFQNYWISRIESVQRKFVRHALKNLPWRDPENLPPYHERCRLLGIDTLENRRHVAQTMFVAKVLRNEIDSPSLLADVNIYAPERTLRRRQFISLGSRNTRYGQHDPVRFMALKFNEAYHLFDFNVTITTLRNHFIQYFRRN

SEQ ID NO: 2445 - protein, 997 aa, synthetic construct
  source 1..997: note = Description of Artificial Sequence: Synthetic polypeptide
MKINQANWDKFATHTNNNNNLYPPSTNINKETAQINKIIMKSAHLAIPQTLPHRHTHTVPWWNKDLADLQEKKKQTWKALKRDTTQENIIKYRKTNALFKRAVKIRKKEATSKFTSTIQPNTPTTKIWNNIRRFCGLNPVKQIHCITNNNVTTNDKQKIANLLAQHWSQLSKDSNFSQEFTSHKYNTTTLNHIPSKSAMEIDKPITKLELTIALRSLKGITPGINRISYPMLKNSPLAIQNRILSHFNHIFENYIPQSYKTSLIIPILKAQKDKTDIASYRPISLNCCVGKTLDKIIANRLWWYLNSNKLLHPHQYGFKKGKSTSDNLLYADHIITKSLNTRKHTSLISLDFARAFDRVGIHSIVDQLIEWKCSHKIINYIINFTKNRKIAVRIGSSISNFYPLENGIPQGSPISVVLFLIAFNKLANILTIYKEIKFSAYADDFLLLVNLKNQKNTTINLTHIFRKIYDWGSYSGASLSQTKCQHLHICRKHRCNCTITTQNSNIKNVTSLKILGLTINNRYNWSSHINSLIPSLSNKHNIIKCLASHKFNCNTSTLLNITKSILISKIDYALHIYGYTPKNFLNKLKTTLNAALRTVLGAFRTTPTHNLLYEANIPTIEQQRDHLTTKLFTNLTRSKDTPLHKHIQPKTNNKKWTSTLERTIENCQLHNIPFKPTKLYKTKPPWQLPQNIINTSLHNYKKTNTSSDTFQKLFFEIKETYKNHTFIYTDGSKINLNTAFAVTTETDVLRYGILPPSSSILTGEMIGILEAIKISTTKRGKSVICSDSLGAIEAIQNPLNLNKYPTYIRSLLQTKQPKIKILWIPGHSNIKGNDLADRTAREATKMPLIYTPNENITDINKMLKNILIQEKETLINKCNTWYKNINTNNTHISALSKIQQEEISRIDQIKFIRLRLGHTSLTHKHLLDPNTQRNCYRCQSSTPTNMEHILDSCPAISQNKQNLLKNRPATEYLKNPTAENIKVIIKFLKETNLYNEI

SEQ ID NO: 2446 - protein, 1237 aa, synthetic construct
  source 1..1237: note = Description of Artificial Sequence: Synthetic polypeptide
MVVSKDTTQAINTAIEVLRKELIERIIKVEKENERLNTENESLKKQLAEQCNQNNNKPLFSSLIKKTSEGAPPISDSETRLLNAISAEQKEKIKKEKNVLVFGLKESKRKSKDEIKEDDDESVGEVFDAIGLDKSCIVKHFRLNSRDKNRPGPLVIELVDPSYQKQVLSVARDLNKVEAYKNKVFINPDLTYRQRASLKLLLGERNSLNKIEEGQKFDISICYQKRYAAENNRGRSKVRHFDLLSETICCRKLKSKNTKKINAPSSLISKLSEITCLYMNATSLNNKFDELIEVINSNKANVVMICETWWNNESVTNINGYTLFRRDRGVGRGGGVCIYVQNNIKAYEVSEKCLNDPNIEQIWCVIELGSEKVLCGSMYRTGISNISNCINITKSINFAHSMNLLNKYTGILICGDFNFNAIKWTEDYYGTLTSETDTPAKIFLECLNNCFMHQNVIKPTFQNNIGNETNVLDLIIAENKNRVYKLVHLPPLGGINHGHHIIKFNYSHEECIDNIVLIKEKFNFNRGKFDKLNNYFKILNWDNEFKGLEINKCYEKWLSLYEEGCKLFIPIIKSGSIQINTKPLWINRELKALSKEKRNVWFECRRQKFRDNCLLAKYKELNKVYKKKSESKNTRFIKKKVNQRIKDFEYDLALNSKFNPKKVYSYINNKSKVKDNIRAIQLKNGSIETDLKVIANTLNGYFASVFNKPQTLSAPIIDIETQKICKNPDFNASVVEEYLNKLDTNKATGMDRVHPKVLKECKSTLAKPISLLFNKSFETGKLPKLWLCANIVPLFKNGDKLNPCNYRPTCIFNICSLTHATIDLPVSLTSVVCKVMEKIIKDKMMKHLVENKLINKNQHGFVNNKSCVTNLMESLDFITSSIDNGLDVIVLFLDLAKAFDSVDHERLLLKLNALGFKSKLFDWCQGFLKNRLQRVVIGNNKSEWEEVVSGVPQGSVLGPLLFVVYINDISNKIKSSCKLFADDMKILRAIKNDNDVIELQQDIDLLMEWSNEWLMKFNQQKCKVMIIGNSQHKVLMNNTALAYTSMEKDLGVYISDDLEWKHHVNKAVNKANQKLGQIKHTFKYLDEKTMKLLFIALVRPYLEYAAPIWNPYRQYDKDKLECVQQRASRIKILKGYSYEERLKKLDLLSLENRRRRGDLIQMFKYLKGYDIINFYTKPEMLDNGYKTRGHNSKLRRQYTGNIKRHNFFTNRVVNDWNNLEQETIDAVSINQFKKKIG

SEQ ID NO: 2447 - protein, 489 aa, synthetic construct
  source 1..489: note = Description of Artificial Sequence: Synthetic polypeptide
MIPVQLIRDSAPYISHPLAYIFNLSLETGKVPDEIKIAKVTPLHKKGPREDPGNYRPISVLPVIGKVLEKLINIRLIQFLEKNDIFYYHQYGFRKKYSTKLSLINLINSTLKSIDQGKVTLGMFIDFKKAFDTINHNILLGKLSSYGIRGLPLEWVKDYLSNRFQFVQCGQTLSERKKIRCGVPQGSVLGPTLFLIYINDLPTVTDYFNFRLFADDSNLFHTFSADQGEIDVNEVNNNIQKIHKWCTANKLTINSMKTNFMLICSRRKKIGINGKLKIAGEEIKEVDVATFVGVHIDRHLSWKSHIRFVNQCIRKKVGVLFRLRHFVPSRTLILLYKAFIQPHISYGIEVWGSTYKTSLRSILYSQKMAVRAITFSEWRTPSDPLFKRLRILNVYNLHDLSISTFMFDLVNGNLPHILIEYCDIIEHSYSTRQKEDGQLRLPKLRTTQGQFSLSFVGSEFWNRLPVDVRLTRSRNRFRNSVTSHLLNKS

SEQ ID NO: 2448 - protein, 1004 aa, synthetic construct
  source 1..1004: note = Description of Artificial Sequence: Synthetic polypeptide
MLCRARFVQCLNEKHVSVSTLREFLSPSDPQSTNNFTQSHYTPDEFNTFVTQKSLDKDVNNKLSFININCRSLQHNFDALSVLMMSLRMQVSIIGVSETWLRDENSQYSLCNLDNYVFVGNNRRLGRGGGVGIFIRKDINFKRRTDLDINESFLESIFIEIERFNSSILICVMYRPPSQPVDDFLMSLVNVFDVVNVEKKLFYLMGDFNIDLLNVGKVQSVNDFLNILMLHSMIPLINEPTRVTDRSSSLLDNIFTNDSCYIYSGILFTDISDHFPVYCICDTDIPKSSCETDFYKRHLNENNIRMYFLQLLYSTEWYLSSDVNSSYNNFVFKFMKVYNLCFPVKLVRMKYKRKNKPWITNEIIKLSKKKCRLYKLLIKNPNVYRKEVYRKIRNELNNKIKIEKKNYLKKSFKDSTGNMKKTWDIINKAMGKKCKMTNIKEINNNDTVITDKNDISNNFNEYFVDVGYNLNCKFDCFDDSECIKYIGMNDKSMFFKLVTSSEIEDIVKKIKNNTSAGYDDVDVKIVKKCIYLLSSHLCTIFNQCLEQGVFPDKMKIAKVIPVFKNGVSETMSNYRPISVLTVFSKILEKCMYNRLYAFLTKCNIINDNQYGFRAGHSTSCAIIDFIHKVASAIDNNEVMLGLFLDLSKAFDTLDHHILLVKLYQYGIRGIGLDLFKSYLLHRHQIVSIANVKSNYQEIKCGVPQGSILGPLLFILYINDLPSVSRILKSILFADDTSIFLSHQNIQSLQDIFNQEIKLINTWFSVNKLSINISKTHYMIFTNKKCDTDSIIIRLCNTEIKQVSSLKFLGITIDNKLKWTDHINAVCNVLSKNIGVMYKLKSFPKCILKMIYNSLILPFLYYGILAWGNAHETHIRKVILLQKRAIRTICHTSYLAHSHPLFKEMKILNFTDMYNYQCAIFMFQCYLQILPKSLLKLFILNCNIHHYSTRNAENFHLPLVHTTSYKRTVIFNGPCLWSTIPRNIRELKFVNTFKRKYKKYLMDVY

SEQ ID NO: 2449 - protein, 1033 aa, synthetic construct
  source 1..1033: note = Description of Artificial Sequence: Synthetic polypeptide
MAIITGEGDCHLLKKSLLKLKTMKNKTNKLNVNKGNDLDVTFPCDFCGLSFPTKIGRGVHISKAHRVERDAKLSGHASAKKAYYWSTEEETRMAKIHLQEESRGDSNHVLRAMHSACSTGRTLESIRLHMKAKRYVKIYTELRNEKQIQSSGVENILNNISDASPLTLPSETETLTSYLLNLPLKKGVSKWREQDLDFIIHSVSDSEEQKRLLDVYCKTVTEGYRKGKTGPLKKSTKVSPHHATTTKSKKFLKKKLKRELYGKVQQLWIKDRCEAAKLVLSGKVSTLICEEDRSARQGEYWKKIFERESEPDIRPVPEVYADPMLVRPISEDEIKKVVKDIKLKTSSGPDNISTEVLREIPVLVLVKLFNLIILLSHLPSEFKSSRTTLIPKVETPKDPGDYRPISVSSVFVRALNKILASRVSNGNKGAHAQKGFKALDGCLENTVLLNCILGDAKINNKSIALSFIDMKKAFDSVNHDSILRAATIAGYPKLLLGYIKESYNGADTEVEKIKATFKRGVKQGDPLSPVLFNNIVELAIKKAYESGIGYRMNGTVFPIMAYADDIILLSESKEGLQDLLDIVLTELRHNGLEANADKCASIIAKKDGKQKKWVISSDSVLAAGKTMPCMNANSMYKYLGIYFGPLGITTERLTKIYSNQLYNIGIAPLKPQQRLEMINDFLLPGILHEAVLGNTNVGELKDLDKMTRVAIRKWLHLPKDTCSSFIYTGVKQGGLGVRSILAEVQFGKISRLESLNKSKDTRIQALTTCEVVKKAFRQWSKPIRVGDSIATSKVQFYEANRELLLSKCDGKGLREAGKIPFAHDWLRAKGKLMKGRSFINSIKVRGNLFGTPVRLNRLNKSGIPLIKCKMGCLMPCSLNHIAQTCPKVHGLRVERHNKVMNYIADVARKGEWKTLVEPIIPYGATIRKPDLVVIKDKKAMVLDIQVVSDVGNLNERNTLKSEVYNDKIIADWVKNAGADSVEFGAITLNWRGLWASDSWETVSKIGVNKSDAMIISLKVLNWTARMYCAWNKG

SEQ ID NO: 2450 - protein, 1002 aa, synthetic construct
  source 1..1002: note = Description of Artificial Sequence: Synthetic polypeptide
MATNDNDDQFVAEAQGRTHGSLSGPALSIISSNIEGLSGAKQELLADLCITTNCDILCLQETHRGPTRVRPRISGMTLIAERPHDQYGSAIFARNGLAVDKSYLSDINNIEVLSIDLMGITVSSVYKPPQEPFDLPGRATDGRMNVVIGDFNSHSISWGYREMNEDGELVETWADANQLSLIHDAKLPASFNSARWRRGYNPDLIFTSTRIANQCEKVILDPIPHSQHRPIGLKVNAVITPRAVPFRRRFNLRKANWEKFAKDFDSYIQDLPATPQNYDTFVELMKKSSRRNIPRGCRTSYIQGLTDHSKVMYEDYIEHFQMDPFSEETLESGENLTKEIGESRRRKWQEFIQSTDMTHSSRKAWKTIRILGNDYTKAQPRSEVTADQVAHQLLLNGRGNPDHHPRRARLPKVPDALSSQDDPGFTRPFTMDDLLAAIKAMKNNKAAGLDDILCEQIKQLRPGALNWLLKMFNECLGTNNIPKLWRKSKVIALLKPGKDAASPKSYRPISLLCHTYKLFERLILNRIAPFVDEHLIPEQAGFRPGKSCTGQLLNLTQFIEDGYESKLITGAAFVDLSAAYDTVNHRILTRKIFELTKDVRLTGLIQTLLSNRRYFVVLNGNRSRWRRQKNGLPQGSVLAPLLFNVYTNDQPIHPNTRSFLYADDLCIATQNQSFVKLEESLSDALAGLIPYYATNHLRANPDKTQISAFHLKNRDANHQLRISWYGKRLKHTPNPVYLGVTLDRSLTYKNHIANTKAKVGARNSILKKLANTNWGTDARTIRTTALALCFSAAEYASPVWSRSAHAPKIDPALNSSCRAITGCLRPTKVEDIYLLCGIAPPHVRRLVLSQKEKDKQENNPLHPLFEQQPVGKRLKSRHSFLHSVEPLNTSPHNQRMTLWSNHLQTTPHKLSLSPKESLATGSSETWPTWLSLNRLRTGYGRCRVLMQRWGLGDEQTACECGQEQTMEHLLVCPLLPEPCTQDDLEAVNCRAKACVDHWTGLV

SEQ ID NO: 2451 - protein, 1235 aa, synthetic construct
  source 1..1235: note = Description of Artificial Sequence: Synthetic polypeptide
MTLTIIQWNLRGYINNYNELQIIIKQYQPHIIALQETHLFNIHNIPIPINFSLYAKNYSPNFGGAAVLIHNSIESKEIHLQTDFDATAIEVESKKKFKIISAYISPSQNFNESNLHNVLSNNSSSLILGDFNSWSKLWGSPKNNARGNTVAKFLNNTNFILLNDKSPTHFTTHNTYTHIDLSFCSPDLFQYANWKIIDDLHGSDHFPILITLFNNNKQNKTQNNPIFKINSANWDAFKDKTDYFNTKNSPSNNINKESSCLNKILLQSAHLTIPQTSIKNHPRNVPWWNNGLQTLNNERKQAWNKLKKHITTTNIIRFRKAAAKFKKEIKSAKNKSLSSFTSEIQPQTKTSQTWSNIRRFCGLNNMKNIHTIIHPTTLQPTSDNPSIANSFAEYWSDQSKDSNFSSMFTNNKYSISTYQSSPPSQSAQKIESDITSIELSSALSSLKGHTPGIDRISYPMIANTSPAVKDRILKHYNNILNNYIPQAYKIGLVIPIAKPGYIKTSITSYRPISLNSCFAKVLDKIIAKRLWWFVTTNKHIHTNQVGFKRGKSVTDNLAYLDHLITDALSHKQHLSIVSLDFNKAFDKIGLHAITKQLQEWNIGPKILNYIINFMSKRKIKCRVANNLSSTFPLHNGIPQGSPISVIIFLIAYNKLANLITIQRNLTFTAYADDFHIIVKFKKNQTQENFNLDDLFQKIDEWCSFSGSSLSFDKCKHLHICRKHNCKCTITTRNLNIPSVDHLKILGLTFDSKYRWTRHIEDLASSLSNKINIIKCLSSNKFNCNTHTLISITKAIIVSKIDYGLVFYGNSSITWLKKIQTILNCAVRIALGAFRTTPITNLLMEANINTVADRRDFLQAKLIKNLYFPNNSPLHKISKSLQSRIHFNNKIPSAITYSLQHCKKQNISLLIKPEIKTKLPFWKFQPNTINTELEKLDKNNTHDSIYQQHFLTIKNQFNDHTFLFTDGSKTISTTSFAITTEKNTLKVGLLQNFSSIYSAEIIAIFEAIQIVKSMRGKYMICSDSLSSLQAIGNPDNFNYYESKIRSLLMQLHPKIKLLWIPGHKNIKGNELADQKAKSASTMPLTYTHNNNISDINKHLKTKMLKDKLIKLEQTSNWYQFINPNQITADKFTKRLDQNTTSRIKQTKIIRLRLGHTRITHQHYLDPTKINTCTHCLNNVPVTIEHLLKDCPSSQLTDIRFKIFANNNPLTFLSNPTKTEIDLIIKYLKETNLYPLI

SEQ ID NO: 2452 - protein, 1008 aa, synthetic construct
  source 1..1008: note = Description of Artificial Sequence: Synthetic polypeptide
MSLRVLQLNLHKSKVASAELLIAMEQGSADVALVQEPWIASGNAVAGLKSSNYNAFYTPSVSRNRTAVLVRKGLQANLMSHYSSDDLTVVLLESKKKRLLVASCYMAHDRPAPPEELRSLVEPGPKDQQLIVGADANAHHSVWGSPDINDRGESLLDFILSTNLYIANVGEEHTFVGPTSSNVLDITLVAGQSTMVSDWKVLERPSFSDHRYIQFQCEFDHSPKPTVFRNPRNTNWGKFQDIISRKLATSPGTVKSDEDIEKSLETLSKELLGAYHASCPISRSKKRTRPPWWNKDLSLQRDDLREFFKLAKQAKDDIINEEYKILLRNYKKEIRRAQRSSWRNFCSNIETAPETARLRKLLSKQPTIQSQLKRDDGQWTEGSEEALTALMHGHFPGCTKITNTHPAISFWIGNLLSCRRVQSDWGTASMVKGAHRGTPQGGVLSPLLWNLVVDDLIRRFERKAPKITAYADDISIIITGVCPSTLSSIMESTLREICEWTDKVGLSINADKTDLILFTKRYKVPPWIPPKINTTRLTPKTQVKYLGTVLDSKLAWKPNVLERVKKATIALYASKKMLSSTWGLSPALMHWVYISVVRPTLLYGVLVWWQAMEKRTYKKLMERTQRQALLCISGALRSTPTKALETIIGIDPLDIHAQLTAGKAAQRLVALGSMSTKGYGHSSIGRTMSSVSDYMTPRTCPDVKTSTFMGPEDWKTVQDHARYLNIYTDGSKMEGGVGAGIYCTDPETRLSYKLPSHCSIFQAEVFAIRKAAELAQEIARPCEAVNLFVDSQAAIRSMQSSAVSSKNVLASRDALDILSTTTSVRIYWVPSHQGIEGNEIADELAKEGVGLAIDRTENVPVSLRTLQSELERRADVRAKSRWRGNSATCKTSKIMCKERNDKLSHYVLHLSRKDCRLLVGLLTGHCLAAAHAVKLGITNNGNCRKCDESEATETLEHLICKCPALTQARVKHLGAPVLASLADASKRSPGELLAFAKTTAILKDFNTA

SEQ ID NO: 2453 - protein, 1734 aa, Murine leukemia virus
MGQTVTTPLSLTLEHWGDVQRIASNQSVGVKKRRWVTFCSAEWPTFGVGWPQDGTFNLDIILQVKSKVFSPGPHGHPDQVPYIVTWEAIAYEPPPWVKPFVSPKLSLSPTAPILPSGPSTQPPPRSALYPAFTPSIKPRPSKPQVLSDDGGPLIDLLTEDPPPYGEQGPSSPDGDGDREEATSTSEIPAPSPMVSRLRGKRDPPAADSTTSRAFPLRLGGNGQLQYWPFSSSDLYNWKNNNPSFSEDPGKLTALIESVLTTHQPTWDDCQQLLGTLLTGEEKQRVLLEARKAVRGNDGRPTQLPNEVNSAFPLERPDWDYTTPEGRNHLVLYRQLLLAGLQNAGRSPTNLAKVKGITQGPNESPSAFLERLKEAYRRYTPYDPEDPGQETNVSMSFIWQSAPAIGRKLERLEDLKSKTLGDLVREAEKIFNKRETPEEREERIRRETEEKEERRRAGDEQREKERDRRRQREMSKLLATVVTGQRQDRQGGERRRPQLDKDQCAYCKEKGHWAKDCPKKPRGPRGPRPQTSLLTLDDQGGQGQEPPPEPRITLTVGGQPVTFLVDTGAQHSVLTQNPGPLSDRSAWVQGATGGKRYRWTTDRKVHLATGKVTHSFLHVPDCPYPLLGRDLLTKLKAQIHFEGSGAQVVGPKGQPLQVLTLGIEDEYRLHETSTEPDVSLGSTWLSDFPQAWAETGGMGLAVRQAPLIIPLKATSTPVSIQQYPMSHEARLGIKPHIQRLLDQGILVPCQSPWNTPLLPVKKPGTNDYRPVQDLREVNKRVEDIHPTVPNPYNLLSGLPPSHQWYTVLDLKDAFFCLRLHPTSQPLFAFEWRDPGMGISGQLTWTRLPQGFKNSPTLFDEALHRDLADFRIQHPDLILLQYVDDILLAATSELDCQQGTRALLQTLGDLGYRASAKKAQICQKQVKYLGYLLREGQRWLTEARKETVMGQPVPKTPRQLREFLGTAGFCRLWIPGFAEMAAPLYPLTKTGTLFSWGPDQQKAYQEIKQALLTAPALGLPDLTKPFELFVDEKQGYAKGVLTQKLGPWRRPVAYLSKKLDPVAAGWPPCLRMVAAIAVLTKDAGKLTMGQPLVILAPHAVEALVKQPPDRWLSNARMTHYQAMLLDTDRVQFGPVVALNPATLLPLPEEGAPHDCLEILAETHGTRPDLTDQPIPDADHTWYTDGSSFLQEGQRKAGAAVTTETEVIWAGALPAGTSAQRAELIALTQALKMAEGKRLNVYTDSRYAFATAHIHGEIYRRRGLLTSEGREIKNKSEILALLKALFLPKRLSIIHCLGHQKGDSAEARGNRLADQAAREAAIKTPPDTSTLLIEDSTPYTPAYFHYTETDLKKLRDLGATYNQSKGYWVFQGKPVMPDQFVFELLDSLHRLTHLGYQKMKALLDRGESPYYMLNRDKTLQYVADSCTVCAQVNASKAKIGAGVRVRGHRPGTHWEIDFTEVKPGLYGYKYLLVFVDTFSGWVEAFPTKRETARVVSKKLLEEIFPRFGMPQVLGSDNGPAFTSQVSQSVADLLGIDWKLHCAYRPQSSGQVERINRTIKETLTKLTLAAGTRDWVLLLPLALYRARNTPGPHGLTPYEILYGAPPPLVNFHDPDMSELTNSPSLQAHLQALQTVQREIWKPLAEAYRDRLDQPVIPHPFRIGDSVWVRRHQTKNLEPRWKGPYTVLLTTPTALKVDGISAWIHAAHVKAATTPPIKPSWRVQRSQNPLKIRLTRGAP

SEQ ID NO: 2454 - DNA, 195 bp, Acropora digitifera
  source 1..195: mol_type = unassigned DNA
taatttattcacaacttcatgtgaccatatcttcaccaatggcaaagctcctctacactctcatataaaccacaacaacccacaattcctctattcgctctgacgaagggctaacgctcgaaacgtcagctttctaaatctttcacggtggtaattcaacctttatcaactcgtttgataaaaccaaatttttgt

SEQ ID NO: 2455 - DNA, 228 bp, Acropora digitifera
  source 1..228: mol_type = unassigned DNA
taatattgttacctcttatcatgttatttcattattttttcaccttatacttatctttagtttacactgtcaattatttttacttatttccggttattacaaaatatgcaacataaaaatcacgtaccaatgtaaaattctcattgtacctgaagaaggctggtttggccagccgaaatatagtacacctacaaaaaagatccttctacgttgtgtcgacttctgctt

SEQ ID NO: 2456 - DNA, 317 bp, Acropora digitifera
  source 1..317: mol_type = unassigned DNA
tgatttactctcacagtactgcccaacgtattctacgatacacgtactgaccttagacctgtagacggatcgaaacgcaccaatcactgtttagtctttccagccaattacatctaggctcaactgacagtcgaccaataacatcacgaataagttgaccaattacatctacgaccggagtttttatagtatctactgacgttacacaaatcacttgactctgaagatgacttccgctcaggttgtcgaaacgtcagtcaatgtcatctcaaacagtccttctcaggactacactcacccggacgatcgtactttac

SEQ ID NO: 2457 - DNA, 237 bp, Aedes aegypti
  source 1..237: mol_type = unassigned DNA
tgatcctgcccaatatgacgacgacattgatgccagcccacggatacgaaactgttttactaaattgtactatgtatagatgtaagcttgaaatgttagattgacagttatctccttttcatcggttcagtcttctgctgaccgtatttctccagggtctcagccttctgctgagccttctcccgtgttgaactagcataatgttaaaaaacacgttaataaagatgaaaaaaaaaa

SEQ ID NO: 2458 - DNA, 18 bp, Aedes aegypti
  source 1..18: mol_type = unassigned DNA
taagtaagtaagtaagta

SEQ ID NO: 2459 - DNA, 345 bp, Aedes aegypti
  source 1..345: mol_type = unassigned DNA
tgaatacataggtagatagttagggatttgtataattattattatcccccttttcaatttttgaccaagacatgacaggtatactcctgtcgaaaattttttcctaggtagtttgattgtgtaggtacttatctggtgttagtatttaaggtagagagatgcgacgatttcttcagtggatacgagtaactgacactgaagaagactgcaagtggtagtcgaaatacgcgtatctgtcaaagataagcatttaggagcggaattaaaaggtacacggtactccatctactttaaagtttctctattcgagattctgctcagaggattcgaacattcattaaagag

SEQ ID NO: 2460 - DNA, 123 bp, Aedes aegypti
  source 1..123: mol_type = unassigned DNA
taatgtatcctgttaagtgttgtccaagagttgatgcttagtttagtttagttttaattttattcattaagaccatgatgtcggatgaatcttcaatacaaatacaaatacaaatacaaatac

SEQ ID NO: 2461 - DNA, 476 bp, Aedes aegypti
  source 1..476: mol_type = unassigned DNA
tagtttgggccccgtatcactctgtacacatcaatcgacttgaacgagttcaaaaaagttttattaggtatgcactccagagactaccttggcgaaataggatgctgctgccgccatacgagcatcgctgtgcactcgtcgacttacctacactacgcaacaggagaactcttctaaagcagcttttcatttttgatctgctcgaaaataacatcgactgctctggtctgttaggcaaattaagtttcaacacccctgtgaggctcctacggaggactgcactattccgacacgctgctcatcgaacgttatatgggcaaaataatccgcttgatgtatgttgtgaaatgtttaataatgtgtatcacttgtacgattttaacatagctaaggaaacatttagattaaggattctacggaattgaagtctgtgcgatgtatttttatttaaatcgaagaccaaataaatcaaatca

SEQ ID NO: 2462 - DNA, 432 bp, Aedes aegypti
  source 1..432: mol_type = unassigned DNA
taatatgcattttttctaatgccacttccgtatctgttctttgtcattccacgccaccaccacccttcgccaccacccaccgccagccaccaatcaccaccacccactgctagccacccgccgccagccacccgccgccatcgccaccattcatcacttcacccatcgcttgccaccaacttcagtaaagatcaatgctcataaatatttataatgtgaattgaaagtttgtgaaaattctaaactatagcgcttccttcaaagagctacgctcattggaagtgcagttatcgctcaatcgttgaattatacttatttttttgaaaagatgagaaggttttatgcctatgggagaagtggcttaaagtagctacactctcacgggcttttcccttctccaagagaaaaaaaagcagtaaataaataaataaa

SEQ ID NO: 2463 - DNA, 115 bp, Aedes aegypti
  source 1..115: mol_type = unassigned DNA
tgatttttattgtgtacttgtttttatatatcttgacctattttgtcgtaaatttaagtaaccacacatcattgggactaattgtctgttggtgtaaacaaataaacaaaaaaaa

SEQ ID NO: 2464 - DNA, 145 bp, Aedes aegypti
  source 1..145: mol_type = unassigned DNA
tagaacattcaggaaaatcgaattcaggaacataattcgagttagttaaatagttttaatggaatcaccacagtgtaacatttcaagaaggagtttccttacgttacataaattcaaataaagaaataaataaaataaataaata

SEQ ID NO: 2465 - DNA, 71 bp, Aedes aegypti
  source 1..71: mol_type = unassigned DNA
taggatttagtttcaattcatgtagacaaaagtcagatggataatatacaaatatacaaatatacaaatat

SEQ ID NO: 2466 - DNA, 149 bp, Aedes aegypti
  source 1..149: mol_type = unassigned DNA
taatgttgttttatgttgttgtatttttatcgttgattgtaattttgttagtaactgcttcatatttgttaaactagaataagatatacataagttatacatcattgggacctgttttgtctgttgatgtcatccaataaataaataaa

SEQ ID NO: 2467 - DNA, 107 bp, Aedes aegypti
  source 1..107: mol_type = unassigned DNA
taatttttgtaatcttggtttgaatattttagtgtttgtattttgtttaagaaacaagggtcattggggtaatgttttacctgttgactaataaataaataaataaa

SEQ ID NO: 2468 - DNA, 63 bp, Aedes aegypti
  source 1..63: mol_type = unassigned DNA
taacagtctggcggattaaggtattgatccaagacgtagcaattaaataaataaataaataaa

SEQ ID NO: 2469 - DNA, 72 bp, Aedes aegypti
  source 1..72: mol_type = unassigned DNA
tagcttaagaaacagtctgtggaatgtaacaattcgagacggtgacaataaataaataaataaataaataaa

SEQ ID NO: 2470 - DNA, 94 bp, Alligator mississippiensis
  source 1..94: mol_type = unassigned DNA
tgatctcagcagtattcctgcccagagcaggggggttggactcgatgatctttcgaggtcccttccagcccttaatttctatgattctatgatt

SEQ ID NO: 2471 - DNA, 96 bp, Alligator mississippiensis
  source 1..96: mol_type = unassigned DNA
tgaccccagggttggtgactcttttcttgcctgccaggggcagggggtcagactagatggcccactgaggtcccttccaactctatgaatctatga

SEQ ID NO: 2472 - DNA, 27 bp, unidentified
  source 1..27: mol_type = unassigned DNA; note = Description of Unknown:Amborella trichopoda sequence
taattgggaaaaggctataatgatgat

SEQ ID NO: 2473 - DNA, 331 bp, Anguilla japonica
  source 1..331: mol_type = unassigned DNA
taaccaccaccattctgtatatttcactctttaatttaaaaaaaaaacaaaaaaaaaaaaaaaaaccccccccccctttttcatgtcacttgtatttgtctttgtcctaatactgtagcttactcttctgcctagttggctttgcacaggttaggttagaatagtgttcactgtgtgaactgtgttcttagctagaaatagctgtacaaaataagtattatacctttctgaacttgtgttcagcagatgcctacgaccatgatatgcacttttgtacgtcgctttggataaaagcgtctgcgaaataaatgtaatgtaatgtaatgtaatg

SEQ ID NO: 2474 - DNA, 84 bp, Anolis carolinensis
  source 1..84: mol_type = unassigned DNA
tagacacttgggaagtgtccgacgtgtgatccaatacaacagccagcagagtgtctgctgtggactcatcttgttgtgtttcaa

SEQ ID NO: 2475 - DNA, 172 bp, Anolis carolinensis
  source 1..172: mol_type = unassigned DNA
taaatcagatctaatttgccaaatagtcactgttgaatgtttttagttgaatgtttttatgttgaatgtttttatattgtggaatgatattttaaattgtaagtcgctcggagcactctggtggagagcgactaattaagaaataaagtgaagtgaagtgaagtgaagtgaa

SEQ ID NO: 2476 - DNA, 126 bp, Anolis carolinensis
  source 1..126: mol_type = unassigned DNA
gcttttcaatgctaattaaagtgattaactacacaacattcacactgacctctctcaccctagactttccacagatatatattaacctctttgcttagttttctccatacctcacaacctctgagg

SEQ ID NO: 2477 - DNA, 109 bp, Anolis carolinensis
  source 1..109: mol_type = unassigned DNA
tagtattaatgccaagtttttgtttttttttcttaaaaaaaatctctatgtttgcaaatccattacaacttgtaccctcggtttcgcttctgacacgagaaataaataa

SEQ ID NO: 2478 - DNA, 103 bp, Anopheles gambiae
  source 1..103: mol_type = unassigned DNA
taaatgttctgttcgttatctaatgtaatgtattgtaaacaaattttgactcgagagggcttcatagtccatcgattaataaactaaactaaactaaactaaa

SEQ ID NO: 2479 - DNA, 253 bp, Anopheles gambiae
  source 1..253: mol_type = unassigned DNA
tcctttataatccttttccctgatactcttccctatcctcttttttctcatcctcttttttccgactatcatatctaatattattcactcttcttttcttacgtttgtattttatcctaatatctgtctttcatgtgctcaaaagttcgctttagtattaggaatttagataggttaagttaggaattagttagatttaggaattgtgaaaccatcaggctgacaatttgaataaacttgaaatgaaatgaaa

SEQ ID NO: 2480 - DNA, 160 bp, Anopheles gambiae
  source 1..160: mol_type = unassigned DNA
taattttattttcaaaatacattttctattcttgtgcacctgttctcccctatcgatttatgtaccttacatagtctataagcactaatttaagtacattcatgtaggatcttcaagatcccgatggattaatcaataaacatattaaacatattaaaca

SEQ ID NO: 2481 - DNA, 13 bp, Aplysia californica
  source 1..13: mol_type = unassigned DNA
tgatgatgatgat

SEQ ID NO: 2482 - DNA, 106 bp, Aplysia californica
  source 1..106: mol_type = unassigned DNA
tgatttgtctagcctgcacgcaatgcattattgtcgttcattaccagatagttgaacaggctctacttagagcctcaaacaactaaatcgtcaatgtcaatgtcaa

SEQ ID NO: 2483 - DNA, 197 bp, Aplysia californica
  source 1..197: mol_type = unassigned DNA
taaagttggcagcagaggaaaacagtcgaactaacatggagacctcacatcggtgagggggctcggtgcgtcagaaaagctgtagagaggaagagcccgaaacagcgacgcattctctcctgatgatctccatgctagagtccgggatacggagcgttcgacggtgagcagtgcatacggctgtttagactacgtac

SEQ ID NO: 2484 - DNA, 653 bp, Aplysia californica
  source 1..653: mol_type = unassigned DNA
tagagacacttgagagtgggactgatgtgaacaaagatatattgcacttgatttggagtctacataatttgataagtaggcaccacgtcagagtagtcctacaatggattcctgcccacactgggataccgggaaatgaaagagctgatgctctggcaaagaaaggagctagcctccctcagcctgaaattcctacgaattacaccacctgctgccaaatgatcaagtcaaacctcaaggaagagtggatgaatgattgggccacaggtacgacaggaaggaggatgtatggccacatgaataaaccactggtcaaagatccaatcaatgagttgaggaggggagatcaatccataatcttccaacttagaacacaacatgtacccctcaaccaacatctcaaccgaattggagtaaagcagtctgctgcctgcccactatgtgactacccctcagagacagtggaacatcatctgttcttctgtagaaaactaactgatttaaggggatgttttcttcccaagctaccccacacatctaattgcctctactcctcaagacaacaattagaacaaacatgcaactattaccgaatggcatcatgcagaagagttaacgctcagatgctactggatcgctaacaacaacaacaa

SEQ ID NO: 2485 - DNA, 10 bp, Aplysia californica
  source 1..10: mol_type = unassigned DNA
tgatgatgat

SEQ ID NO: 2486 - DNA, 25 bp, Aplysia californica
  source 1..25: mol_type = unassigned DNA
taaagggatttgaaaacaacaacaa

SEQ ID NO: 2487 - DNA, 19 bp, Aplysia californica
  source 1..19: mol_type = unassigned DNA
tgagaaaggcaatgatgat

SEQ ID NO: 2488 - DNA, 46 bp, Aplysia californica
  source 1..46: mol_type = unassigned DNA
taagctaaattgaccgtctgcatagacgaaaagagccatatatata

SEQ ID NO: 2489 - DNA, 99 bp, unidentified
  source 1..99: mol_type = unassigned DNA; note = Description of Unknown:Blumeria graminis sequence
tgaaggttgacagacttctcccagtagcaaggaagtggacggtatccgcactggacatgacagtgatagtgcacttcttgaaggtaacacaacatcaaa

SEQ ID NO: 2490 - DNA, 183 bp, Caenorhabditis sp.
  source 1..183: mol_type = unassigned DNA
tgatttctcttgtctttccctttcttcacttgtcgcttttgtttgacctcccattcgctccattttaggcatatcccccgtttctctttctcccccggtgaggcctcgtgaggggcacttgccaggttcttctgatgtatcatattgatttttccctcttttggaaataaataaataaataaa

SEQ ID NO: 2491 - DNA, 36 bp, Caenorhabditis elegans
  source 1..36: mol_type = unassigned DNA
tgaagaacggatcgtctaagtatctaagtatctaag

SEQ ID NO: 2492 - DNA, 40 bp, Caenorhabditis elegans
  source 1..40: mol_type = unassigned DNA
tgaaaacggcgctgcgccgcctgttgcacaacaacaacaa

SEQ ID NO: 2493 - DNA, 256 bp, Caenorhabditis elegans
  source 1..256: mol_type = unassigned DNA
tgatctaatgttaccttatcctcacttctatccatcatttattcttgccttttatacatcgatatttgtgttttttgcttcttctccaatgtagccattattttcttctcatctcttttttatttttgttccgttttatttatgtaatttatttatgtaaccacttgtgatggtttgtatctatttatgtgtgttttttttctacctcacgatatcttactatcgtaataaattaaattaaattaaattaaaactt

SEQ ID NO: 2494 - DNA, 59 bp, Caenorhabditis sp.
  source 1..59: mol_type = unassigned DNA
taacttaatgtaaaaattgacttgtattagtggctttgcccttcaatcaataaataaaa

SEQ ID NO: 2495 - DNA, 39 bp, Caenorhabditis sp.
  source 1..39: mol_type = unassigned DNA
tgaggtcgaacctcacaagtatcacaagtaagtaagtaa

SEQ ID NO: 2496 - DNA, 211 bp, Caenorhabditis sp.
  source 1..211: mol_type = unassigned DNA
tgaccactgatgaccgaacgtttacgcmaaatctatcctctcctctctcccaaaatktkttwwtttcacgtgtactctaaccacatatccctgcaaattcctctattcttgccactccgttttctttgawtcctcttstacacctcttctgtatttattacttttcacgtaccgcaatgggcgtatacaaataaataaataaataaataaa

SEQ ID NO: 2497 - DNA, 334 bp, Caenorhabditis sp.
  source 1..334: mol_type = unassigned DNA
taaattaattcatttcaattgtaggattgaaacatatttaatctttttttttctatttctatttgtttttcttcatacttattgtacatttttattgaatttttccccccttcatttacaaaattgtactgttttatctctttctctttcactatagcgcaattgtaatctagcttaaattatctccaacatgactttgtttgattattatcgaaggatcctcttgcggggtgatgtcgagtaattttatttattcattgtgccattcccacctctttctctgatctcgaaatgtttttttttctcaacccgtgaataaataaataaataaata

SEQ ID NO: 2498 - DNA, 183 bp, Caenorhabditis sp.
  source 1..183: mol_type = unassigned DNA
taaattttgtgcttgtgatatcatcccacccgtctttctctcatctatttgaccgcggatttttccaattggtcatcttacttatttattttctctccccttatttttataccgttgtcctcttttccatgtgccatatacatatttttatgcgagaaatgaataaacatattattattatta

SEQ ID NO: 2499 - DNA, 50 bp, Caenorhabditis sp.
  source 1..50: mol_type = unassigned DNA
tgaccgaagatcgtcaaggaatgagtagagttgcacaacaacaacaacaa

SEQ ID NO: 2500 - DNA, 43 bp, Caenorhabditis sp.
  source 1..43: mol_type = unassigned DNA
tgatcgaagaacggatcgactaagtaactaagtaagtaagtaa

SEQ ID NO: 2501 - DNA, 202 bp, Caenorhabditis sp.
  source 1..202: mol_type = unassigned DNA
taactactgctgaacggacgtcaccaagatcctttatcacttctaccccacctttttttttctgctctcattcttgatctgtttctacccaactccttattgctctcattatttccctgcacatacctttaatgtatctgtgtacacaatatcaacacgtcacattggcgtaaataaataaataaataaataaataaataaa

SEQ ID NO: 2502 - DNA, 170 bp, Caenorhabditis sp.
  source 1..170: mol_type = unassigned DNA
taattttttgtctacatagattttcctaacatctctttttaacttctttcgtttgtttctaaatcttccgtcatatcgtttcttatacgtgtgtaatagtttgttatttatatatgtgctgatgaataagtggcagctgcccttcaatcaataaacaaatacaacaaata

SEQ ID NO: 2503 - DNA, 231 bp, Caenorhabditis sp.
  source 1..231: mol_type = unassigned DNA
tagagcttattcttattctgtactcccaaaccacctttccccgcattaccacattgctcaattcttaatgccttcttttattcccctcataccggtcattctttttttttgttgccccacatctctcactttaacccaccctttgaatggtctcgtgagggactcattctcagcctcccgccccatatattgataattttttataagaataaaatacaaatacaaaataca

SEQ ID NO: 2504 - DNA, 70 bp, Caenorhabditis sp.
  source 1..70: mol_type = unassigned DNA
taaattataactgtttctttttttcttatttgtataagtggtgaaagtccttcaaataaataaataaatc

SEQ ID NO: 2505 - DNA, 361 bp, Capitella sp.
  source 1..361: mol_type = unassigned DNA
tagggcaactacaagatcttattcctatgtaaaacaccctagctactcttacactttttcttctctttcctatttgattagtcctcctagttcttctagctctatccccgctctttattctttaaccgttttgtgtctcacttatatgtttaccctgttttcggtactttctttaacaatttctatttcttttgtacttttataactttactgtactatgtttgtattattttttgtattgtattaccatcatgataatcattcaattctcactcatttggtggcatacatatgttacgttcagttatgaacttcgtatgtctcctgacccttgtcgaataaataatctatctatctatct

SEQ ID NO: 2506 - DNA, 95 bp, Capitella sp.
  source 1..95: mol_type = unassigned DNA
taaaatgtatcaaaataaaataaaataaaaggagctgatcgtaagaggctatttaagcctgaagatcagaagaggacctgtaagtacctgtaagt

SEQ ID NO: 2507 - DNA, 225 bp, Capitella sp.
  source 1..225: mol_type = unassigned DNA
taaaaagaagttaaagactttttttattcaataatgcttttaataacgcagaacagttttaagtggaaatgaacttggcttgtttttatgtttctatgatcttttatccaaatacattttcatatgttttattttgtgctttgaaacttttatgtattttaagcacttgaatataataacatttatttatttatttatttatttatttatttatttgtttattta

SEQ ID NO: 2508 - DNA, 161 bp, Capitella sp.
  source 1..161: mol_type = unassigned DNA
tgattttaccctaatttccttgacacatattctttgttgccattgtatttttttaagctggcagttcttataggttttcctgttctgccatgctgttgcatgcattgattttattgtacatattatttttgcatgcatgaagcttaataaataaaaaaata

SEQ ID NO: 2509 - DNA, 114 bp, Capitella sp.
  source 1..114: mol_type = unassigned DNA
tgatgtttacatgttccccctttttattttcaaattgtattagcgttctgagcatttttatggaagcgacgctttataaaataaattttcattttcattttcattttcattttc

SEQ ID NO: 2510 - DNA, 127 bp, Capitella sp.
  source 1..127: mol_type = unassigned DNA
taatgttattatcatcattaatggcttaattgtcatattcatcattcattttactcattattatctgtttggcaaaatcattccttcgggcgaataaaatcatcttatcttatctcatctcatctca

SEQ ID NO: 2511 - DNA, 101 bp, Capitella sp.
  source 1..101: mol_type = unassigned DNA
taatgattttcctttttacctctgtttgtacagcgcatttgaatgttctttgatattgctgaaaatgcgttttaaatgtaataaatgaaatgaaatgaaat

SEQ ID NO: 2512 - DNA, 89 bp, Capitella sp.
  source 1..89: mol_type = unassigned DNA
tgacatggctttgtgaagcgcatagaaatgcatcatgcatcatgttgcgctatataaaataataaattcaattcaattcaattcaattc

SEQ ID NO: 2513 - DNA, 366 bp, Capitella sp.
  source 1..366: mol_type = unassigned DNA
tagtatcatcctcgatctacaactaacatatgaaacgaactatttcactctgaatatgcgctgcaccacccactattttttcatttttttttctctccgcaccaaagctgaataaaattttaaattgcacaatttgaacaggcgactcacaagtagccatacttagtcgcctattgacatgaccctattctttttcgcttctgtatttccatttctctagtatgtatttccatatttcattgtcgcttcctgctttctttaccaacctccctttttctattttggcatcttatatttgctaatatttcattctttctgtcgtgtcaataaatgcaattcaattcaattcaattcaattcaattcaa

SEQ ID NO: 2514 - DNA, 26 bp, Capitella sp.
  source 1..26: mol_type = unassigned DNA
taaataaataaatataaattaattaa

SEQ ID NO: 2515 - DNA, 202 bp, Capitella sp.
  source 1..202: mol_type = unassigned DNA
tgattttattaatacgtcctcatactgtttttatcacttttgtgctcttaaaagtcgctcattttgtttttagtcacttttaattttagttactttgttcactttttatatccattcagtgttcatcttcttttactcagcgctattgagcatttttggattttagcgctatagaaataaattattcttattcttattctta

SEQ ID NO: 2516 - DNA, 251 bp, Capitella sp.
  source 1..251: mol_type = unassigned DNA
taattatgttcttttccatttatatatatatgcatatatatatttgtttatttgtttgtttgtttttttttttctcgtttttaaatttttttgtcgctctctctttgtgcaagactcgttaaaactattattttctctcttccttttctatgtacttttcatgtggcgcaaaagcgatcacgcttctgccactacgttattttcgcaccttttatgttgtgattgaataaaattattattattataaaaaa

SEQ ID NO: 2517 - DNA, 120 bp, Capitella sp.
  source 1..120: mol_type = unassigned DNA
taaatttcacataattttatatttcaatatgtttttcggactattctatgtgaagcgcatagcagtgttttaccttttgcgctatataaataaataaattgattgattgattgattataa

SEQ ID NO: 2518 - DNA, 82 bp, Capitella sp.
  source 1..82: mol_type = unassigned DNA
taaatattctgcaaatttatgacctgtcaagaggacctcctcatgacatgtactgaataaagttttctattgaaaaaaaaaa

SEQ ID NO: 2519 - DNA, 224 bp, Capitella sp.
  source 1..224: mol_type = unassigned DNA
taaaatccttcacaatcccccctgctaaaattatctatccctaacagctcatctcctaacgcttttgtgaatatcctgtttgttagtttgtttattcgttgtttgtttgtaaaattgtaaatatccattgcgggcacatacccatgttctgggtcagcccctctcactccacttgtgtttttttcttttctttttgaataaacacatttttgaatttgaattga

SEQ ID NO: 2520 - DNA, 710 bp, Capitella sp.
  source 1..710: mol_type = unassigned DNA
taacgagcagacgacgccacagcaccagtagcggccaactgagtgttacacaatggtatgacgctaattataacgcccacaccccacctctcttccaaaaaagcaatgttttacctttgcacagcctgatcaatatcgaaattgccaaatttatgcacctgcactcaaaaaatagtttaccacctcgactctctgctatcctagactcacatgctcaacctcatcagtacgccacacgctccatcctaccataccgtcctcccagaataacctctctagccactgcaaaaagttttttatctgaaggtatcagaatctggtcctccctcaaccctgaaactcgcgcacttccccctcgccgcttctccaagcaactaaaacgaaaatatctgaatgaactcaccacctctctctaacttacacatgtccatcaccattttttttctctctctctctctctctctctctctctctctctctcctcctcctcctcctcctcctcctcctactcctccatctacattgtttttgtttttttttctttttgcttgacaaattccccaaaagtttcaatctgctttatttggccccctggccccgtacagacgtttgtgtctcgccggggggcctcaggtcacgtttaatgtccaaatttataataccctgtaatattctgccctgaaataaacattcattcattcattcattca

SEQ ID NO: 2521 - DNA, 163 bp, Chlamydomonas reinhardtii
  source 1..163: mol_type = unassigned DNA
taacatcctggcggggtgcaggcctggcctgcacgcccgccttcacatgctcggtagtgggggcgtacaggaggcgggcctggcccacctcctcatctccccccactcccttaatccacaccacttgcctacggcagggtgtctctatttctatttctatttc

SEQ ID NO: 2522 - DNA, 375 bp, Chlamydomonas reinhardtii
  source 1..375: mol_type = unassigned DNA
taatttgctcgtgggtggtgggagcggtgtgcctctggtgtgtgcgctgtgggtgtggggcgtcgacgtgggcgtcgccggactacgtgcccggtgtacctgcgttgacgcctcgccggtttgattgcgcctcgtgcgctagtgcggtttgctgtacgttggtggggctttggcgggcttgggcttagcttcgactcgctgtgcagctgccgagacacgctttacgcgaagacctgttgcacggttgtggaaggtcggtagccaactggggggagggtggtttcctttcgggccggagatggtccctcttgacctgggtgcacgggcacccttgcttggtcggattgtcccttctttgtaatatcgcaaccataa

SEQ ID NO: 2523 - DNA, 141 bp, Chlamydomonas reinhardtii
  source 1..141: mol_type = unassigned DNA
tgagccacggctcccccacacctcctcggagtgcgtggtgaggtggcagcgcgagggggatgggcctcctcgccctagccaccttaccccgataatccacgccaggccccatgggccggcgtttgaattattattattatt

SEQ ID NO: 2524 - DNA, 392 bp, Ciona sp.
  source 1..392: mol_type = unassigned DNA
taaatattataccgtaactgtccaatgccttagcaatattgtaacttcattaatttagattttccatacctcgatctctttaacacattgtaaatcactgttatatattcattatgcattttgtttgttttctttttttagggttttgttaaagtttttttgtcattgtaacgtttttgcacaaatttttcacactgctattctgtttatttcttatttatttatctttatattttaatttacatttattataaggtggcacctgcttcgataaccgcatggtttctcggtgtctccttgttaaacttcagtttaatttattttcgtattgtttattattttgttttctgtgcgtttaacaaataaaatatgtttgattgattgattgattg

SEQ ID NO: 2525 - protein, 29 aa, Betaretrovirus sp.
DMGALQPGLPSPVAVPKGWEIIIIDLQDC

SEQ ID NO: 2526 - DNA, 326 bp, unidentified
  source 1..326: mol_type = unassigned DNA; note = Description of Unknown:Copidosoma floridanum sequence
taagcgctggcttgttgttgtaatttattgtcagtcgatagcacgacaggtgacgagtaagtcaaccaaacttacgaattctcgcgtacctgcggtaacaatttacatcaaaatttattgtattttgtgtttgagccttccagatcactcattgtgtgtttttaattttaattttgtagcctgatgaggctgacgcatattgtcagcgaaacgttgcgcattaataaatcaacgcaagaaaatttaaatacactttacttgtatttatttattttctcacatttcgcccccaacggatcactgatcactttgaatttccaaattca

SEQ ID NO: 2527 - DNA, 492 bp, unidentified
  source 1..492: mol_type = unassigned DNA; note = Description of Unknown:Copidosoma floridanum sequence
taaattaatatttgtgtttttatatcctttattgtaatttgaatttatcgcgcgttttcactgtatagattgaatatatatgtaacacatgttggtttcgtctatatatgtatgtaaaatttgtatttgataatttgaatatgtaaggtcagtcgactatgtgccctcgttgggtactgacgttgtttgaatcttcgaacaaaataatctttttgtaagtctctaatttgtaactgtatttaaaattgtttattattgttcttagtttttaaaatgttattagatgtgataacgtggatgtattgttacctcaagttaatttatttcgtgtatattttataaaattaggacttgaaaaggctcctacccaaagaggagagaaacgtcgtcaggggatataataaaaaattatatacaacagcaatagccattggttttattatttgatgaatttcgtcttgctcgctgttgttggagtcataaacatcataa

SEQ ID NO: 2528 - DNA, 520 bp, unidentified
  source 1..520: mol_type = unassigned DNA; note = Description of Unknown:Copidosoma floridanum sequence
taacaattttcataatttgataattcataacaatttatatccatcaatctctttttatcggttagtggccactttccttgatattgagtttgattctttaaagtaaaaataaacttagtttcataaattaccgctgattttgtactacaccaggttcaccactgttgtagtactacacacacatgttctcacgtagctttaaaaagaattcccatatattgtactatatcgcagttgagtagaataaacatctcacattgacgacactctgcgattattgtttaatattgtaagtaaagataaaacttttatacattgttagtgcgttttctgttgtgtacatctttatatacatatttatattaccattgctgtatattaatttttagtgacttgataaggactgccttggagtagtcgaaacgtcgttttttaaaataaagtcaatttgaacagcatagcccttagtacttgtcattatttattgtattattagctgttcttggaatcaaacaatatc

SEQ ID NO: 2529 - DNA, 553 bp, unidentified
  source 1..553: mol_type = unassigned DNA; note = Description of Unknown:Copidosoma floridanum sequence
tgacgagtgttgcttgataggtgtgccacttgatggccacgtttctgttggtccgtgtttccttgtacatacattgaccgtgggtgcacccttatgtggtgacaagaccttaacaccatattactatttttaatatcttccagttacatgtgctgagtcaggatgtgacttatattgtagataacttaactgtacatacattttgactgataaagtttataatattaagattatttaattattagtattccattgccgtggttatgactgactagtctttatcagtcatgctgcgtttggcattttcatgttcgcatctgcataggtgacttatattttcatttaatgtaatttgtcataatgttttttatattataaatattgtaaattgtacagttccctgaagagggagtcaggatgactccgaaatattggatcacattgtccaactaatatatgaaataaatagccatgctccaagattccaagttttttcatttaaatttccttaattatggcaaaggagcaagaagacagtagttttattatcaaa

SEQ ID NO: 2530 - DNA, 264 bp, Crassostrea gigas
  source 1..264: mol_type = unassigned DNA
taatttattcattcsaggatatacactttgatgtaacattgtgatttaatatgtaccataacccaaatataagttaataattgatacaccttgtataacgcgtgatgaactataattgttaatattaccaaggtgacttataggcccaatgggccgggtgcccaatattcatgtacaagtagttgttataaaatttgtatcatacggcacaattgtacataatatgcacatgtcactataataaataatttacttacttactta

SEQ ID NO: 2531 - DNA, 256 bp, Crassostrea gigas
  source 1..256: mol_type = unassigned DNA
taaattcctttttgcttttgctttctatactgtacattaacgttatctactatatatttgcaattactttgtaaatgtatgtctatgaatttaattattataaagtcaataactataagtaacatgtaatattacatgtactatgacaattgtatatattgtatgtattatcattaggagaggaacttgtaagttgtaagaacttgtttccgatccttttgtgttacttacacaataaaatatgttcaaatcaaaa

SEQ ID NO: 2532 - DNA, 110 bp, Crassostrea gigas
  source 1..110: mol_type = unassigned DNA
tgattatgtacactttgtttttcttactgtttatttaatatgtatatgttcatatgtataacctatgagacatttgtctcttggaataaagaacttgaacttgaacttga

SEQ ID NO: 2533 - DNA, 293 bp, Crassostrea gigas
  source 1..293: mol_type = unassigned DNA
taatcacaaatctgagtatttttgttgataacattttgcttatttttatttatttatctcgttcatccttgcatacatgtaacattaagtagataacattaactttcttattactacatttatcaaatatctacgtactggtgtaatttattactgtataagtacaaactgagacgtatttgcaataatattgtatttgttgtttaacatgtagggagagggcgaattaagtttttataacttgtgcccaatcccattgcaatatataatgcaataaaatatgttcaaatcaa

SEQ ID NO: 2534 - DNA, 228 bp, Crassostrea gigas
  source 1..228: mol_type = unassigned DNA
tagaccataattaatcacctaattgtctacggacttttccggtttttttcccgattacgacaaagagcacacggcgggtgtgaccggtcagcagaggatgctcactcctcctaggcacctgatcctacctctatctatttggaggtccgtgttgctctgctttgaatttgtatttcgttttatggatttttgagatggttgacggtttgttattgtcattttttcatt

SEQ ID NO: 2535 - DNA, 144 bp, Crassostrea gigas
  source 1..144: mol_type = unassigned DNA
taatatgtgtatatttatgttataattgtatttgcagtgacatataggcccaatgggccgggtgtttcattatctattttgtataacattttgtaattgttataacacatgtcactataataaattatttacttacttacttac

SEQ ID NO: 2536 - DNA, 175 bp, Crassostrea gigas
  source 1..175: mol_type = unassigned DNA
taactttagatgttgttcttttttgattcttttcgcctttacttatgtcaatttttcatatttatgtatgtacaatgtaatagggtctcctgtaaaatacccacttctgtactttactatgtttaatttgtaaaatctgatgagctgcaaagcttaaagaaataaagaatgaatg

SEQ ID NO: 2537 - DNA, 401 bp, Crassostrea gigas
  source 1..401: mol_type = unassigned DNA
  misc_difference 170: note = a, c, t, g, unknown or other
taaaatgtgtttataatagctgcaaggaaattgtaagcaaataatgacaaaaaaatataagtctacttttatgtatcctcttgcatatgtatgagtttttgatagatagtgttcccctctctttctccaccctctttcacccccccccacctcataactaaaaatactcnaactttcatgggtgataaaagcaagttttcgagattgtttgtgcatatatatgtctgtctgtcggtgtatacacctgtctgtacgtgtgcttttttatgtgactgtgtttatattatacttatattctaaatctcaaatgaagtgaatatgtgatgtgtatgcactgtaaactaaacatataagaagatgtaaataacttgtacatgaaagtttgaataaaaaaaaaaaaa

SEQ ID NO: 2538 - DNA, 192 bp, Crassostrea gigas
  source 1..192: mol_type = unassigned DNA
taagcgtaaatcaagtttatatataactactgctttgttgatctttttgatattttttcatccactttataccttttatatatatttatataacctgcctcccacctgtacccacaattattgtaaagtactgttaaattgtatgctatggcaatgtatgtaatgtatacgccaataaactactactactac

SEQ ID NO: 2539 - DNA, 209 bp, Crassostrea gigas
  source 1..209: mol_type = unassigned DNA
tagttgttttcctattatgatcctttatactaaaatctaacataagtagtgattctatagtctgttcttttttatttatattttttccctgtatgaaaatgtacctgtttgtctgtacctctgacgatttgtatttgtatgtattatatatatgttcctcttgtaccaaattatttggtctgagtgaataaactgaacttgaacttgaa

SEQ ID NO: 2540 - DNA, 207 bp, Crassostrea gigas
  source 1..207: mol_type = unassigned DNA
tgatcttataactactagtacaccgttgtttactatatacatgtcaattgcatatatgtatacgtccattctatccactgacctttatttatgttgtgtacacatattttgtattatatctttgtattgggagagggcggtctaagttatggaacttgtgcccaatcccaattgtatttttgtacaataaaaatatgttcaaatcaa

SEQ ID NO: 2541 - DNA, 426 bp, Culex quinquefasciatus
  source 1..426: mol_type = unassigned DNA
tagaagtgacccacgatggtactgtgacgaagagcacgttatgacggtcggccatcttcattatcggtacacatcgcatgggatcactttgggccgcatatgataaatttattcaaaagtaacgcgaatctgggcgcggtttaaccctatgggctcatatgtgcgtggaatagcaaatggttccaataccctaaatggataaaaatactgcaatctgattgataaaatgactcgacactggatttgttagagcgccttgagataggacacgagagaaatggatgggcatacacggaagtagagtcaagattacaggacactctcaaaacacgaacgacgaattatcgaaagatatctgctcgtaaaccttccatgctacaaaaactgtgtatgggtaagaggtgggccatccaaggaaaaaaaaaa

SEQ ID NO: 2542 - DNA, 63 bp, Culex quinquefasciatus
  source 1..63: mol_type = unassigned DNA
taaatttagttttaagtkcatcattggggcaaaataagtgcctgttgagaagaaataaacaac

SEQ ID NO: 2543 - DNA, 66 bp, Culex quinquefasciatus
  source 1..66: mol_type = unassigned DNA
taatgttagttttttaagattatacagcctgagcattttagatggaggcggtgaaataaataaata

SEQ ID NO: 2544 - DNA, 121 bp, Culex quinquefasciatus
  source 1..121: mol_type = unassigned DNA
taatctgtttttgtgtttcatgttgttagcatttgtctttagttaagttaagttttatcattaagaccacaagttgtcggatgattcaaataaacaaataaacaaataaacaaaaaaaaaa

SEQ ID NO: 2545 - DNA, 72 bp, Culex quinquefasciatus
  source 1..72: mol_type = unassigned DNA
taatttatgtattagtttgtaaggtaaaacaccattggggcccgagcctgttggtgtccaaataaataaata

SEQ ID NO: 2546 - DNA, 13 bp, Culex quinquefasciatus
  source 1..13: mol_type = unassigned DNA
taagtaagtaagt

SEQ ID NO: 2547 - DNA, 98 bp, Culex quinquefasciatus
  source 1..98: mol_type = unassigned DNA
tgatgaagtctgcaagtagtagacgaaatacgtatctgtcaagatattaaaaatatatagcggaattaaaaggaacaactcgtctctttgtattcaca

SEQ ID NO: 2548 - DNA, 54 bp, Culex quinquefasciatus
  source 1..54: mol_type = unassigned DNA
taagttgtagtctgtgcggcgagtgccgaagatgaaataaataaataaataaaa

SEQ ID NO: 2549 - DNA, 232 bp, Culex quinquefasciatus
  source 1..232: mol_type = unassigned DNA
tgacaaaggtttagaccggtttatttttagtcagttttatttatttatttatttattttttacattgtgctagtttagtttgwtagcttaagtttgattgtatatatcctctatgtcatttggattgtaaaatctgttgataataaaaaagaggttttgtgcctatttgagaaggacccatcggtaggcgttccactcaaacgggcttttccctcatataaaacataaaaca

SEQ ID NO: 2550 - DNA, 299 bp, Culex quinquefasciatus
  source 1..299: mol_type = unassigned DNA
tgagttttgttttggtttttgattaagcaatgccttgtattacacactcttttataactacatacacagctgataatcagtcttaaatttattactgaattctacttaaacaagtaatttgtcgtattatcgacatttttatatctttagcttatttcgttttagtttttaatttagttgttagtttttagttttaatgaaacataaggtccttatcatttaagtcaatgtatacaaaaaaggttgtaccttcggtatattgttgaaaaataaaatacaaatacaaatacaaatacaat

SEQ ID NO: 2551 - DNA, 109 bp, Culex quinquefasciatus
  source 1..109: mol_type = unassigned DNA
tagaaacatccaaagttaaattatctctaccgagcttatttgtcgtcttattagcaagtggtgaaatgtaaattcaagaaaaatgttgtaaaataaagtgaaaaaaaaa

SEQ ID NO: 2552 - DNA, 45 bp, Culex quinquefasciatus
  source 1..45: mol_type = unassigned DNA
taggaaacagtctgttcaagacgaagataaataaataaataaata

SEQ ID NO: 2553 - DNA, 21 bp, Culex quinquefasciatus
  source 1..21: mol_type = unassigned DNA
tgattggtatggtatggtatg

SEQ ID NO: 2554 - DNA, 507 bp, Cyprinus carpio
  source 1..507: mol_type = unassigned DNA
tgaacccccccaccccccctccctctaacatacgatgtcatgcaccagtcactttgtgcagcagtggtctgctcactacctcattcaccatggaactgacgtcattctaccacctcatcagtcagtttaaataaaataactgctcttgagccctttgtcactttgtcacttttaatcagactgaataagctatttttttatgcactaaaaatctttttatctgcactgtttgttcactggtttgcactctatctgccatgtgccttgcgctgcttttatttaaccttatttttattttattttttctattatgtcttttttacattcccttattgtatagttttatcttatattttatatttgatctagattttaggctctactgttagtgttatctgtatgcaccgggggtctgagagtaacgcaatttcgattctctgtatgtatgtactgtacatgtggaagaattgacaataaagcagacttgacttgacttgacttgacttg

SEQ ID NO: 2555 - DNA, 32 bp, Danaus plexippus
  source 1..32: mol_type = unassigned DNA
taatgctgggataattgccaggaagaagaaga

SEQ ID NO: 2556 - DNA, 344 bp, Danio rerio
  source 1..344: mol_type = unassigned DNA
taaattgagggtgtttctggccaaaattattttaatctttttaacttgctgctaggatatgcacttgccactttatacacttggacattaaattgtatgccttcctggctcacattttattaacttttaaatttgaaaagctgcttggaaatgcacttgccactttatatgcacatcatacgcacttttaatattgtattgtaactcttcatttgattttatatttttatctctttttaattattgttgttgttttagataaataggactgcactgaagggaagggcaaatgtaaatttcgttgtattttgtacaatgacaataaagattctgattctgatatt

SEQ ID NO: 2557 - DNA, 619 bp, Danio rerio
  source 1..619: mol_type = unassigned DNA
tgactcttttgcccccccaatacaccccccactctcctctaacttaaactcctcgcaataactgcactgtttaacatttgcacatttaaaatttgcacattcactgcaccacattgaactgtttacttattgaactgtacatacccactgcatatgggcatttgtaattatgtacacacccactatacatatacacttgtaatcatgcttatttatctgcatactactgattattaatagcaacctgtacatatattcatatattgtaacatatacacttgtaatcatgtttatctatccctgtacatatattcatatattgtaacatatacacttgtaatcatgtttatctatctgcacactactgattattaatagcaacctgcacatatattcatatattgtaaatctgttcatagcttatccaacctgtatataatgttcatagtacatccatctgtaaatatcaccatagttttctataactgcactttataacttattcctgtatcctgcacttgctgctattgcactgctggttagacctaaactgcatttcgttgcattgtacttgtacatgtgtaatgacaataaagttgaatctaatctaatctaatct

SEQ ID NO: 2558 - DNA, 391 bp, Danio rerio
  source 1..391: mol_type = unassigned DNA
taatatattcaaaaaacatttaaaaatctggtttatagagaatcagacgtgtcatcattccgattaaaatgaacctagcatgtttccaattgtgccyaccatcttaatgatctgttgtttaaatgtgtttcaactatttttatctctattacaaaatgttggtgttttagyttaatttgtaaatattctcttttaacatctayatraccatgtctattttagtactttttaactatgtttgatwgattgtataattcttgtattgttttttttaggttgttcagggacaacagataaaaaatagccttckggctaattctggtgcatttgcagaaatgctaattaatgtacactgtccctgccaaataaacaaataaataaataaataaat

SEQ ID NO: 2559 - DNA, 242 bp, Dicentrarchus labrax
  source 1..242: mol_type = unassigned DNA
tagggctggatcaggtgagtcctgaaccatcccttagttatgctgctataggcctagactatcgggggatttcccatggtgcactgagctcctctcttcctctctctttctgcactcattcatgtcccattaatgcatgttactaacttcacttcttccccggagttcttgtgctttctcgtctcgcaggttctcatggatcctggtggagcctcctgccatggtcctgcttgactgccatt

SEQ ID NO: 2560 - DNA, 388 bp, Drosophila sp.
  source 1..388: mol_type = unassigned DNA
tgaccaaaaagacgatttaagattgtgttgatgggtttccgcattaggattattaggattcccacaatgttttggagcaatttcttgatctgcagcgaagtgtttgccaaatgctgtatcagcaatttcagcatacgttaactgagagacataattagcgtcaaatgtattgacttatgtattcttatgttaccttgcaaaccatttacttaatctcgtttaaaaattatctgattttgacaaaattaatgataattgttataagccgaggtttgataattaaccaaatgcaatccagttgggctttccagtttcgaatccgaatgaatttagttgtgttcagaagaattattgcacaactaaagatgttatgaaaaaatagattcat

SEQ ID NO: 2561 - DNA, 16 bp, Drosophila sp.
  source 1..16: mol_type = unassigned DNA
taaaggaaaaaaaaaa

SEQ ID NO: 2562 - DNA, 222 bp, Drosophila sp.
  source 1..222: mol_type = unassigned DNA
taggtttagtttataactccacgtcacttggcgcagacgtgtcaaaatgtatgtcaatatttaaattgtaacaaaaaagtgtattttgatgttgattgttttttgttttcgattagttgccctgaagacggttgccgaggagcaaccgaaatatattggtcaaaaaacataaattgtgtttttaatatcacccagaccttgagccggcaaaacaccaaatat

SEQ ID NO: 2563 - DNA, 23 bp, Drosophila sp.
  source 1..23: mol_type = unassigned DNA
tgatggccaattattattattaa

SEQ ID NO: 2564 - DNA, 152 bp, Drosophila kikkawai
  source 1..152: mol_type = unassigned DNA
taggggtcacagcgcccgcgaagcaatgccaggcggcggtaccgctgggcgtccgattcgtattctttctgttaattgttaagccatccatgtttatgtgtagtgtatgtatatattgtagagtaataaatataacgaatataaaaaaaaaa

SEQ ID NO: 2565 - DNA, 514 bp, Drosophila kikkawai
  source 1..514: mol_type = unassigned DNA
tagagccctttcatttttccacaaaatagtgacaacccatgagccttcttacttgtttaataaattaataccggcagcctcgcaaaggactaaaaattttatatgccctcgagtccaaatgctcaactccgagaggcagttctttgtcaacgctatccgtctatggaaccaattaccccatgaacttaaaactattaggaatgcaactcaatttaattccaaagtaaaactatttttaagaaacaacgcataacaaacaaataaacaaacagcaaacttcatattaatacgtaattaaagatataaaaataaataaaataaaataaaataaaataaaaataactaaaaataataatataaaataaaataaataaataattagttcatataataattaatgtactaggtattaagtagaaatcctgtctaattttaactcaagtgaccagggcattaataataagtattttatacttgtagcactgggctaattttgtcaaaataaataaataaa

SEQ ID NO: 2566 - DNA, 136 bp, Drosophila kikkawai
  source 1..136: mol_type = unassigned DNA
taattataacatattccacacacatatctttgttaatacactgtagagcggaaggcctcggtagccattgctcattatcctttgttaacttttagtttataactattagttagcattaaataaataaataaataaa

SEQ ID NO: 2567 - DNA, 68 bp, Drosophila sp.
  source 1..68: mol_type = unassigned DNA
tgatgtgagtcgggtactatgtttatgttggcagatatttgttaactttaatgtaataaataaataaa

SEQ ID NO: 2568 - DNA, 138 bp, Drosophila simulans
  source 1..138: mol_type = unassigned DNA
  misc_difference 73: note = a, c, t, g, unknown or other
tgagcaaatcctgatcgtcctcgcgaagcaatgcttcacggccataccgcggggagtcctggatttgccctcntaaatgttattatgttgtatagtatatagtttagaataagggttcaataaacgaattaaaaaaaa

SEQ ID NO: 2569 - DNA, 1401 bp, Drosophila sp.
  source 1..1401: mol_type = unassigned DNA
taacaaamgtcgacacaaaccgctccccaaaaatgcagctcattctacaaaataggaataaacaggctacatggaagattcttaaaatctacactaaagccatggatgcgggttatttcactgaaacaataatacttaagcgccagcaaagtgtcttcatctctatcctgatgacctgcaaaacccggacgaagtatccctccgacgacgcatccctgctgaccccgacgaagcgcaagtgaaggatgtcatccactaggactggcaaagaagtatctagaagcagagggacacgtgaaggatcaacgtgcggcaaaaacatgatgaatctaagtagactcattgcagcagcgcatgcataatgtcacttacctgaaccttttgctgcaaatcccttgaaatgtcctgaaataacagctgcaatctccccgaaaaccgtactcaatgacaaaagacgacccgacttgtcgcaatagataaactaactttttggcacttagaacacaaaaaacatacaaggttttgatccagtctctttattgggattcccccacgtcctcacagaccctaggcgtgttgctgccgacccggcaaaagatcgaaatcgtaacccctgaaattgaccttttttttcccttagaattaatatcaacgaaatctttgttaaagatcgaaataatttaatcaaaacataaaacagagtattatataataatatataawaaaaaattcacaatgttttgaagccgtctcaacgtcaagaagcccactcgattttattgacccttggcgcggcmctgccgacccgacaaaaggtcaaaatcgtgacccttgaatttcgactttttcctggtagcaacgattatactgacaatatccctgaaaaagaataacagatcaataaaagcttaaaactacgcaacctactactcccctactaggcgcaacataaaacgaagatttggcacctaaaacagtaaaaacctaaaatgttttgatgtcgtttccatgwtgggatgccccctcgtccttctgaaccctaggtgcgccgctgctgacccggcaaagggtcaatctcgcgacccttgaattcgactttttcctggcagcaacggtaaacagacaaaatccctgaaaaattataaaacaaattataaaacaaattataaaagcataaaaccacgactcggcgaaatgaawaacgacgattttggcacctaaaacattaaaaacctaaaatgttttkatgccgtttccatgctgggatgcccccccgcccttmtgaattccaagcgcggcgctgctgacccggcaaaaggccaaaatcgtgacccttgaattcgacttttcctggtagcaacggcatactgacaatatccctgaaaaagaacaataaattaa

SEQ ID NO: 2570 - DNA, 55 bp, Entamoeba histolytica
  source 1..55: mol_type = unassigned DNA
tgaacaataagttgaaaggtattaaaccttaatttaatatttattctttattctt

SEQ ID NO: 2571 - DNA, 74 bp, Folsomia candida
  source 1..74: mol_type = unassigned DNA
taaagaatttcatttatatatctattgtagttatgctaatattatggattacaattatgtattatgataaagta

SEQ ID NO: 2572 - DNA, 372 bp, Gasterosteus aculeatus
  source 1..372: mol_type = unassigned DNA
tgactataacactccaccggtcactccccctcatactgcacatgccactttaactgcaattcatcactttgtcgtcactcgtcactttgtctcttgtctgttacttgttcgttagtgcactttatgcttaatatttttctttttaactttttaatatttaaaattttttaactttattcccttgttttatactaacccatagccttagccttattctactaacccattgcattagcatttcattccactttattttattacttgtgcactgttgtcttgtctgtctactgtcgcgcactaaccgccaagacaaattccttgtatgtttgacatattttggctaataaatgtttcctgattcctgattcctga

SEQ ID NO: 2573 - DNA, 39 bp, Gasterosteus aculeatus
  source 1..39: mol_type = unassigned DNA
taagcggttgaagatggatggatggatggatggatggat

SEQ ID NO: 2574 - DNA, 87 bp, Gavialis gangeticus
  source 1..87: mol_type = unassigned DNA
tgatcccagcagtctttcctgcccacgtgcaggggggctggacctgatgatctgtaaggtcccttccagcccctaacaactatgaaa

SEQ ID NO: 2575 - DNA, 91 bp, Gavialis gangeticus
  source 1..91: mol_type = unassigned DNA
tgaccccagtgctcttcctgccatggcagggggtcggactagatgatctgctcaggtcccttccgaccctagaaactatgaaactatgaaa

SEQ ID NO: 2576 - DNA, 91 bp, Gavialis gangeticus
  source 1..91: mol_type = unassigned DNA
tgaccccagcatccattcctgcccaaggcagggggtcggacttgatgatctgtttaggtcccttccgaccctagctactatgatactatga

(The sequence listing continues in the following parts.)

What is claimed is:

1. A fusion protein comprising:
   a) a reverse transcriptase (RT) domain having the amino acid sequence of SEQ ID NO: 3225; and
   b) a Cas9 nickase domain,
      wherein the RT domain is C-terminal of the Cas9 nickase domain.

2. The fusion protein of claim 1, wherein the Cas9 nickase domain is a SpyCas9 nickase domain.

3. The fusion protein of claim 1, wherein the Cas9 nickase domain is a SpyCas9 (N863A) nickase domain.

4. The fusion protein of claim 1, wherein the Cas9 nickase domain comprises an amino acid sequence having at least 99% identity to SEQ ID NO: 3269.

5. The fusion protein of claim 1, wherein the Cas9 nickase domain is an NmeCas9 domain.

6. The fusion protein of claim 1, wherein the Cas9 nickase domain is an St1Cas9 domain.

7. The fusion protein of claim 1, wherein the Cas9 nickase domain is a SauCas9 domain.

8. The fusion protein of claim 1, which further comprises a peptide linker disposed between the RT domain and the Cas9 nickase domain.

9. The fusion protein of claim 8, wherein the peptide linker is between 2-40 amino acids in length.

10. The fusion protein of claim 8, wherein the peptide linker has an amino acid sequence according to SEQ ID NO: 1589.

11. The fusion protein of claim 1, which further comprises a nuclear localization sequence (NLS).

12. The fusion protein of claim 11, wherein the NLS is fused to the N-terminus of the Cas9 nickase domain.

13. The fusion protein of claim 11, wherein the NLS is fused to the C-terminus of the fusion protein.

14. The fusion protein of claim 11, wherein the NLS is a monopartite NLS or a bipartite NLS.

15. The fusion protein of claim 11, which further comprises a linker disposed between the NLS and the Cas9 nickase domain.

16. The fusion protein of claim 1, which comprises an amino acid sequence according to SEQ ID NO: 3561.

17. The fusion protein of claim 1, wherein the Cas9 nickase domain has an activity at least 50% of that of an otherwise similar Cas9 nickase molecule that is not fused to an RT domain.

* * * * *

UNITED STATES PATENT AND TRADEMARK OFFICE
CERTIFICATE OF CORRECTION

| | | |
|---|---|---|
| PATENT NO. | : 12,157,898 B2 | Page 1 of 1 |
| APPLICATION NO. | : 18/355017 | |
| DATED | : December 3, 2024 | |
| INVENTOR(S) | : Bothmer et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 9 days.

Signed and Sealed this
Thirtieth Day of September, 2025

John A. Squires
*Director of the United States Patent and Trademark Office*